United States Patent
Tainsky et al.

(10) Patent No.: US 10,302,646 B2
(45) Date of Patent: *May 28, 2019

(54) NEOEPITOPE DETECTION OF DISEASE USING PROTEIN ARRAYS

(71) Applicants: Michael Tainsky, Southfield, MI (US); Sorin Draghici, Plymouth, MI (US); Madhumita Chatterjee, Lake Orion, MI (US)

(72) Inventors: Michael Tainsky, Southfield, MI (US); Sorin Draghici, Plymouth, MI (US); Madhumita Chatterjee, Lake Orion, MI (US)

(73) Assignee: Wayne State University, Detroit, MI (US)

( * ) Notice: Subject to any disclaimer, the term of this patent is extended or adjusted under 35 U.S.C. 154(b) by 107 days.

This patent is subject to a terminal disclaimer.

(21) Appl. No.: 14/078,912

(22) Filed: Nov. 13, 2013

(65) Prior Publication Data
US 2014/0141992 A1    May 22, 2014

Related U.S. Application Data

(60) Division of application No. 11/816,471, filed as application No. PCT/US2006/005830 on Aug. 16, 2007, now Pat. No. 8,614,169, which is a continuation of application No. 11/060,867, filed on Feb. 17, 2005, now Pat. No. 7,964,536, which is a continuation-in-part of application No. 10/004,587, filed on Dec. 4, 2001, now Pat. No. 7,863,004.

(51) Int. Cl.
*G01N 33/574* (2006.01)
*G01N 33/68* (2006.01)

(52) U.S. Cl.
CPC ....... *G01N 33/57449* (2013.01); *G01N 33/68* (2013.01); *G01N 33/689* (2013.01); *G01N 2800/36* (2013.01)

(58) Field of Classification Search
CPC ......... G01N 33/57449; G01N 2800/36; G01N 33/68; G01N 33/689
See application file for complete search history.

(56) References Cited

U.S. PATENT DOCUMENTS 6,255,048 B1 *  7/2001  Hosoi ................. C12Q 1/6834
                                                            435/6.12

FOREIGN PATENT DOCUMENTS

WO      WO99024836 A1 *  5/1999
WO      WO-9957270 A2 * 11/1999 ........... C07K 14/705

OTHER PUBLICATIONS

Chen et al., CP110, a Cell Cycle-Dependent CDK Substrate, Regulates Centrosome Duplication in Human Cells, Developmental Cell, vol. 3, 339-350, 2002.*
Hansen et al., Identification of immunogenic antigens using a phage-displayed cDNA library from an invasive ductal breast carcinoma tumour, International Journal of Oncology, 19: 1303-1309, 2001.*
Zhao et al., Expression of NPAT, a novel substrate of cyclin E—CDK2, promotes S-phase entry, Genes & Development 12:456-461, 1998.*

* cited by examiner

*Primary Examiner* — Andrea S Grossman
(74) *Attorney, Agent, or Firm* — Kohn and Associates, PLLC

(57) ABSTRACT

A biosensor for use in detecting the presence of diseases, the biosensor comprising a detector for detecting a presence of at least one marker indicative of a specific disease. A method of determining efficacy of a pharmaceutical for treating a disease or staging disease by administering a pharmaceutical to a sample containing markers for a disease, detecting the amount of at least one marker of the disease in the sample, and analyzing the amount of the marker in the sample, whereby the amount of marker correlates to pharmaceutical efficacy or disease stage. Markers for gynecological disease. An immune-imaging agent comprising labeled antibodies, whereby the labeled antibodies are isolated and reactive to proteins overexpressed in vivo. Informatics software for analyzing the arrays, the software including analyzing means for analyzing the arrays.

4 Claims, 15 Drawing Sheets

Specification includes a Sequence Listing.

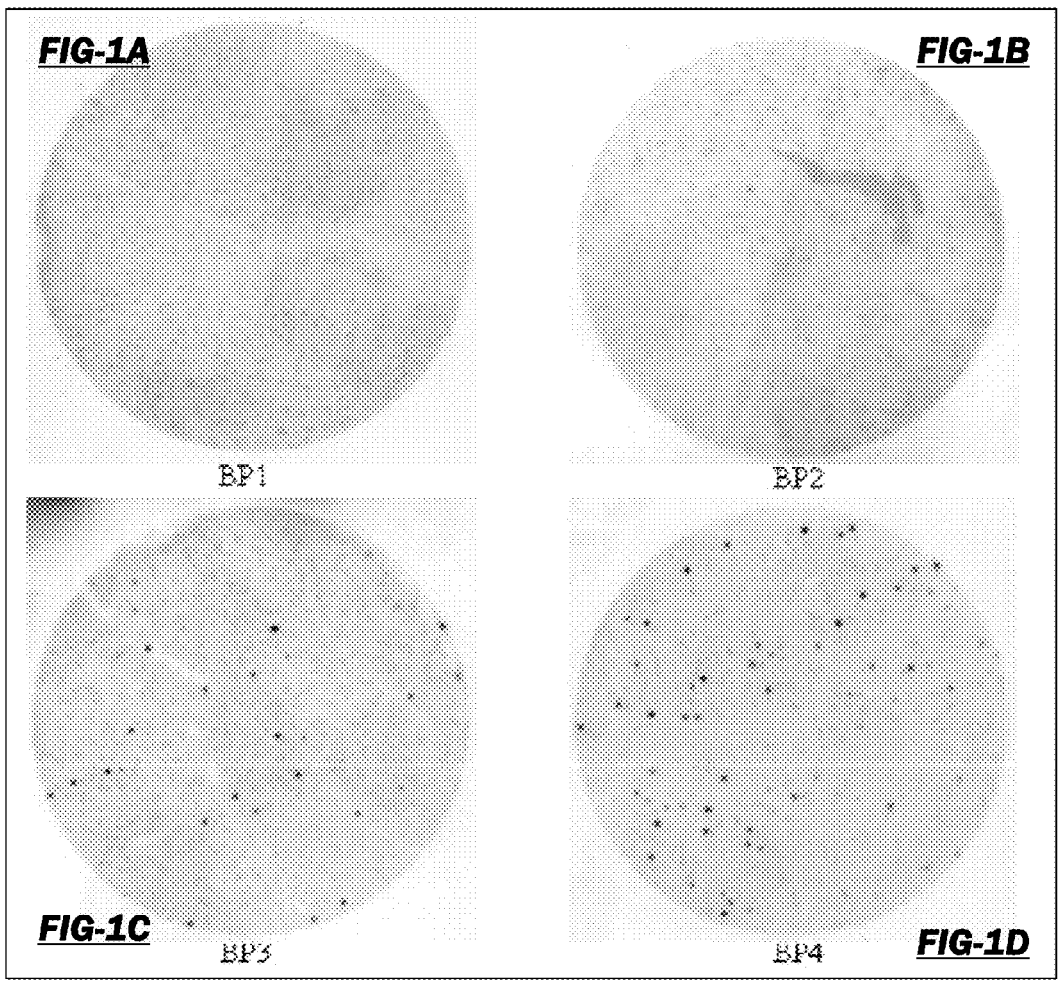
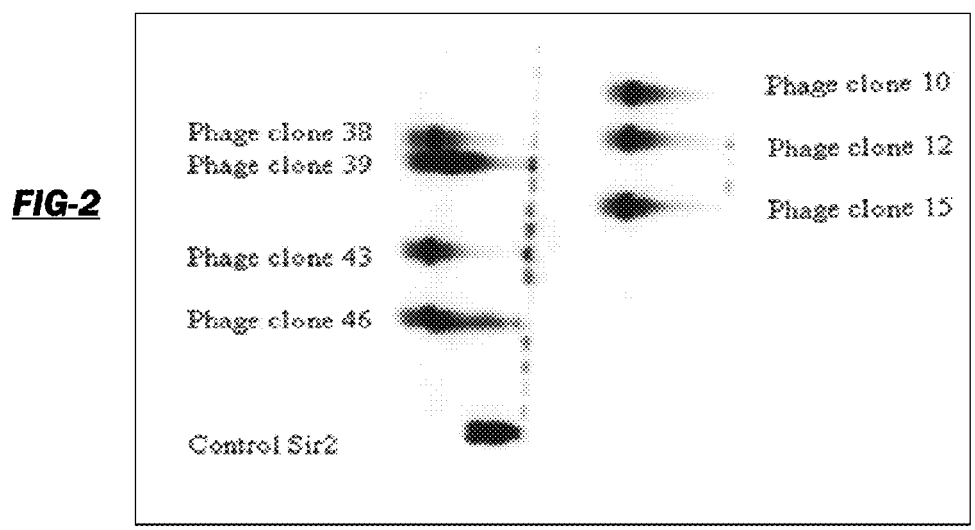

Library

BioPan I

BioPan II

BioPan III

BioPan IV

| Clones from patient | Source of sera | | | | | | | | | | | |
|---|---|---|---|---|---|---|---|---|---|---|---|---|
| | 1 | 2 | 3 | 4 | 5 | 6 | 7 | 8 | 9 | 10 | 11 | 12 |
| 1 | 1 | | | | | | | | | | | |
| 2 | | 1 | | | | | | | | | | |
| 3 | | | 1 | | | | | | | | | |
| 4 | | | | 1 | | | | | | | | |
| 5 | | | | | 1 | | | | | | | |
| 6 | | | | | | 1 | | | | | | |
| 7 | | | | | | | 1 | | | | | |
| 8 | | | | | | | | 1 | | | | |
| 9 | | | | | | | | | 1 | | | |
| 10 | | | | | | | | | | 1 | | |
| 11 | | | | | | | | | | | ? | |
| 12 | | | | | | | | | | | | ? |

FIG-10

| Clones from patient | | | | Source of sera | | | | | |
|---|---|---|---|---|---|---|---|---|---|
| | 1 | 2 | 3 | 4 | 5 | 6 | | 8 | 9 | 10 |
| 2 | | 1 | | 1 | | | | 1 | | |
| 3 | | | 1 | | | 1 | | | | 1 |
| 5 | | | | | 1 | | | 1 | 1 | |
| | | | | | | | | | | |
| 8 | | | | | | | | 1 | | |
| 9 | | | | | | | | | 1 | |
| 10 | | | | | | | | | | 1 |
| 1 | 1 | | | | | | | | | |
| 4 | | | | 1 | | | | | | |
| 6 | | | | | | 1 | | | | |
| | | | | | | | | | | |

FIG-11

Late Stage Mec1

Late Stage OVC015

Late Stage Mec23

Stage I 4679

Stage I 4387

Con OV019-c

Con 2 R2

Δ: Serum Dilution 1:3000; ▲: Serum Dilution 1:30000; for others 1:10000 serum dilution was used.

Late Stage Sera, Stage (II-IV) ———————————————— Stage I sera

| Clone | Mec1 | Mec2 | Mec16 | Mec20 | Mec23 | Mec35 | Mec37 | TB01-060 | TB01-108 | 42501 | 400162 | 40036 | 42780 | B755 | 40015 | OVC075 | OVC015 | OVC035 | OVC007 | OVC005 | OVC063 | OVC045 | 4387 | 4679 | 4555 | 4283 | OVC019 | OVC087 | OVC078 | OVC070 | OVC049 | OVC079 | TP |
|---|---|---|---|---|---|---|---|---|---|---|---|---|---|---|---|---|---|---|---|---|---|---|---|---|---|---|---|---|---|---|---|---|---|
| 1B5 (SEQ ID NO: 44) | | | | | | | | | | | | | | | | | | | | | | | | | | | | | | | | | 1 |
| 1F6 (SEQ ID NO: 11) | | | | | | | | | | | | | | | | | | | | | | | | | | | | | | | | | 1 |
| 1H1 (SEQ ID NO: 48) | | | | | | | | | | | | | | | | | | | | | | | | | | | | | | | | | 2 |
| 2A3 (SEQ ID NO: 27) | | | | | | | | | | | | | | | | | | | | | | | | | | | | | | | | | 8 |
| 2B4 (SEQ ID NO: 12) | | | | | | | | | | | | | | | | | | | | | | | | | | | | | | | | | 12 |
| 2C1 (SEQ ID NO: 40) | | | | | | | | | | | | | | | | | | | | | | | | | | | | | | | | | 5 |
| 2C7 (SEQ ID NO: 33) | | | | | | | | | | | | | | | | | | | | | | | | | | | | | | | | | 7 |
| 2D1 (SEQ ID NO: 38) | | | | | | | | | | | | | | | | | | | | | | | | | | | | | | | | | 2 |
| 2E1 (SEQ ID NO: 34) | | | | | | | | | | | | | | | | | | | | | | | | | | | | | | | | | 6 |
| 2E10 (SEQ ID NO: 37) | | | | | | | | | | | | | | | | | | | | | | | | | | | | | | | | | 8 |
| 2E11 (SEQ ID NO: 30) | | | | | | | | | | | | | | | | | | | | | | | | | | | | | | | | | 6 |
| 2E12 (SEQ ID NO: 43) | | | | | | | | | | | | | | | | | | | | | | | | | | | | | | | | | 7 |
| 2F7 (SEQ ID NO: 13) | | | | | | | | | | | | | | | | | | | | | | | | | | | | | | | | | 11 |
| 2F10 (SEQ ID NO: 49) | | | | | | | | | | | | | | | | | | | | | | | | | | | | | | | | | 3 |
| 2F12 (SEQ ID NO: 52) | | | | | | | | | | | | | | | | | | | | | | | | | | | | | | | | | 7 |
| 2G2 (SEQ ID NO: 41) | | | | | | | | | | | | | | | | | | | | | | | | | | | | | | | | | 13 |
| 2G4 (SEQ ID NO: 14) | | | | | | | | | | | | | | | | | | | | | | | | | | | | | | | | | 12 |
| 2H5 (SEQ ID NO: 51) | | | | | | | | | | | | | | | | | | | | | | | | | | | | | | | | | 8 |
| 2H9 (SEQ ID NO: 22) | | | | | | | | | | | | | | | | | | | | | | | | | | | | | | | | | 13 |
| 3A9 (SEQ ID NO: 15) | | | | | | | | | | | | | | | | | | | | | | | | | | | | | | | | | 3 |
| 3B12 (SEQ ID NO: 23) | | | | | | | | | | | | | | | | | | | | | | | | | | | | | | | | | 9 |
| 3C8 (SEQ ID NO: 47) | | | | | | | | | | | | | | | | | | | | | | | | | | | | | | | | | 3 |
| 3C11 (SEQ ID NO: 16) | | | | | | | | | | | | | | | | | | | | | | | | | | | | | | | | | 5 |
| 4A3 (SEQ ID NO: 35) | | | | | | | | | | | | | | | | | | | | | | | | | | | | | | | | | 9 |
| 4A4 (SEQ ID NO: 25) | | | | | | | | | | | | | | | | | | | | | | | | | | | | | | | | | 4 |
| 4A11 (SEQ ID NO: 17) | | | | | | | | | | | | | | | | | | | | | | | | | | | | | | | | | 5 |
| 4B2 (SEQ ID NO: 45) | | | | | | | | | | | | | | | | | | | | | | | | | | | | | | | | | 4 |
| 4C10 (SEQ ID NO: 28) | | | | | | | | | | | | | | | | | | | | | | | | | | | | | | | | | 1 |
| 4D9 (SEQ ID NO: 29) | | | | | | | | | | | | | | | | | | | | | | | | | | | | | | | | | 2 |
| 4G8 (SEQ ID NO: 36) | | | | | | | | | | | | | | | | | | | | | | | | | | | | | | | | | 1 |
| 4G9 (SEQ ID NO: 42) | | | | | | | | | | | | | | | | | | | | | | | | | | | | | | | | | 1 |
| 4H3 (SEQ ID NO: 18) | | | | | | | | | | | | | | | | | | | | | | | | | | | | | | | | | 6 |
| 4H4 (SEQ ID NO: 32) | | | | | | | | | | | | | | | | | | | | | | | | | | | | | | | | | 2 |
| 5A3 (SEQ ID NO: 26) | | | | | | | | | | | | | | | | | | | | | | | | | | | | | | | | | 8 |
| 5C3 (SEQ ID NO: 19) | | | | | | | | | | | | | | | | | | | | | | | | | | | | | | | | | 8 |
| 5C6 (SEQ ID NO: 46) | | | | | | | | | | | | | | | | | | | | | | | | | | | | | | | | | 2 |
| 5C9 (SEQ ID NO: 53) | | | | | | | | | | | | | | | | | | | | | | | | | | | | | | | | | 3 |
| 5C11 (SEQ ID NO: 20) | | | | | | | | | | | | | | | | | | | | | | | | | | | | | | | | | 2 |
| 5C12 (SEQ ID NO: 50) | | | | | | | | | | | | | | | | | | | | | | | | | | | | | | | | | 4 |
| 5D8 (SEQ ID NO: 24) | | | | | | | | | | | | | | | | | | | | | | | | | | | | | | | | | 1 |
| 5F8 (SEQ ID NO: 21) | | | | | | | | | | | | | | | | | | | | | | | | | | | | | | | | | 3 |
| 5F9 (SEQ ID NO: 54) | | | | | | | | | | | | | | | | | | | | | | | | | | | | | | | | | 4 |
| 5G9 (SEQ ID NO: 31) | | | | | | | | | | | | | | | | | | | | | | | | | | | | | | | | | 5 |
| 5H6 (SEQ ID NO: 39) | | | | | | | | | | | | | | | | | | | | | | | | | | | | | | | | | 2 |

FIGURE 14A – TABLE 5A

|  | Mec1 | Mec2 | Mec16 | Mec20 | Mec23 | Mec35△ | Mec37△ | TB01-060△ | TB01-108△ | 42501 | 400162 | 40036 | 42780 | B755⊠ | 40015 | OVC075 | OVC015 | OVC035 | OVC007 | OVC005 | OVC063 | OVC045 | TP |
|---|---|---|---|---|---|---|---|---|---|---|---|---|---|---|---|---|---|---|---|---|---|---|---|
| 2B3 (SEQ ID NO: 56) |  |  | ■ |  | ■ | ■ | ■ | ■ | ■ | ■ | ■ | ■ |  | ■ |  |  | ■ |  |  | ■ |  |  | 10 |
| 2B9 (SEQ ID NO: 57) |  |  |  | ■ |  |  |  |  |  |  |  | ■ |  | ■ |  |  |  |  |  |  |  |  | 3 |
| 2C12 (SEQ ID NO: 58) |  |  |  | ■ |  |  |  |  |  |  |  | ■ |  |  |  |  | ■ |  |  | ■ |  |  | 4 |
| 2D7 (SEQ ID NO: 59) |  |  |  |  | ■ |  |  |  |  |  | ■ | ■ |  | ■ |  |  | ■ |  |  |  |  |  | 5 |
| 2D12 (SEQ ID NO: 60) |  |  |  |  |  |  |  |  |  |  | ■ |  |  | ■ |  |  | ■ |  |  |  |  |  | 3 |
| 2E7 (SEQ ID NO: 61) |  |  |  |  | ■ |  |  |  |  |  | ■ | ■ |  | ■ |  |  | ■ |  |  |  |  |  | 5 |
| 2G10 (SEQ ID NO: 62) |  |  |  |  |  |  |  |  |  |  |  |  |  | ■ |  |  |  |  |  |  | ■ |  | 2 |
| 2G11 (SEQ ID NO: 63) |  |  |  | ■ |  |  |  |  |  |  |  | ■ | ■ |  |  | ■ | ■ |  |  |  |  |  | 5 |
| 2H8 (SEQ ID NO: 64) |  |  |  |  |  |  |  |  |  |  |  |  |  |  |  |  |  |  | ■ |  |  |  | 1 |
| 3H1 (SEQ ID NO: 55) |  |  |  |  |  |  |  |  |  |  |  |  |  |  |  |  | ■ |  |  |  |  |  | 1 |
| 4C5 (SEQ ID NO: 65) |  |  |  |  |  |  |  |  |  |  |  |  |  |  |  |  |  | ■ | ■ | ■ | ■ |  | 4 |
| 4H6 (SEQ ID NO: 66) | ■ |  |  |  |  |  |  |  |  |  |  |  | ■ |  |  |  |  |  |  | ■ |  |  | 3 |
| 5A2 (SEQ ID NO: 67) |  |  |  | ■ | ■ |  | ■ |  |  |  | ■ |  | ■ | ■ |  | ■ | ■ |  |  |  |  |  | 8 |
| 5A4 (SEQ ID NO: 74) |  |  |  | ■ |  |  |  |  |  |  |  |  | ■ |  |  |  | ■ |  |  |  |  |  | 3 |
| 5A7 (SEQ ID NO: 68) |  |  |  | ■ |  |  |  |  |  |  |  |  | ■ |  |  |  |  |  |  |  |  |  | 2 |
| 5B9 (SEQ ID NO: 69) |  |  |  |  |  |  |  |  |  |  |  |  |  | ■ |  |  |  |  |  |  |  |  | 1 |
| 5B12 (SEQ ID NO: 70) |  | ■ |  |  |  |  |  |  |  |  |  |  |  |  |  |  |  |  |  |  |  |  | 1 |
| 5D6 (SEQ ID NO: 71) |  |  |  |  |  |  |  |  |  |  | ■ |  |  | ■ |  |  |  |  |  |  |  |  | 2 |
| 5E3 (SEQ ID NO: 72) |  |  |  |  |  |  |  |  |  |  | ■ |  |  | ■ |  |  |  |  |  |  |  |  | 2 |
| 5E7 (SEQ ID NO: 75) |  |  |  |  |  |  |  |  |  |  | ■ |  |  | ■ |  |  |  |  |  |  |  |  | 2 |
| 5H8 (SEQ ID NO: 73) |  |  |  | ■ |  |  |  |  |  |  |  |  |  | ■ |  |  |  |  |  |  |  |  | 2 |

FIGURE 14B

TABLE 5B: Late Stage Sera, Stage (II-IV)

FIGURE 15A – TABLE 7A

| | Mec 1 | Mec 2 | Mec 16 | Mec 35 Δ | TB01-108Δ | 400162 | 40015 | OVC 015 | OVC 035 | OVC 007 | OVC 005 | NW 4679 | NW 4283 | OVC 019 | OVC 087 | OVC 045 | TP |
|---|---|---|---|---|---|---|---|---|---|---|---|---|---|---|---|---|---|
| 2G2 | | X | X | | | X | X | X | | | X | | | X | X | | 8 |
| 2G4 | X | X | | | | X | X | | X | | X | | | X | X | | 8 |
| 2H9 | | | X | | | X | X | X | X | | X | | | | X | | 7 |
| 2B4 | | X | | | | X | X | | | | X | | | | X | | 6 |
| 4A3 | | | | | X | X | | X | X | X | | | | | | | 5 |
| 5A3 | | X | | | X | X | | | X | | X | | | | | | 5 |
| 3B12 | X | X | | | | | | | | | | | | | X | | 4 |
| 2H5 | | X | | | | | | | X | | X | | | | X | | 4 |
| 2E12 | | X | X | | | X | | | | | X | | | | | | 4 |
| 2E10 | | X | | | | X | | | | | | | | X | | | 3 |
| 2C7 | | | X | | | | | | | | | | X | | X | | 3 |
| 2F12 | | X | | | | X | | | | | | | | | X | | 3 |
| 2E11 | | X | | | | | | X | | | X | | | | | | 3 |
| 4H3 | | | | X | | | | | | | | | | X | X | | 3 |
| 4A11 | | | | | | | | | | | X | | | | X | | 3 |
| 2A3 | | | | | | X | X | | | | | | | | | | 2 |
| 3C11 | | | | | | | | | | | | | | X | X | | 2 |
| 5G9 | | | | | | X | X | | | | | | | | | | 2 |
| 4A4 | | | | | | | | | | X | X | | | | | | 2 |
| 4B2 | | | | | X | | X | | | | | | | | | | 2 |
| 5C12 | | | | | | X | | | | | X | | | | | | 2 |
| 2C1 | | | X | | | | | | | | | | | | | | 1 |
| 5F9 | | | | | | X | | | | | | | | | | | 1 |
| 2F10 | | | | | | X | | | | | | | | | | | 1 |
| 3A9 | | | | | | | | | | | | | | | X | | 1 |
| 3C8 | | | | | | | | | | | | | | | | X | 1 |

Δ : Serum Dilution 1:3000; all others were analyzed at a serum dilution of 1:10000.

FIGURE 15B – TABLE 7B

| | Mec20 | Mec23 | Mec37 Δ | TB01-060 | 42501 | 40036 | 42780 | B755 ▲ | OVC075 | OVC063 | NW4387 | NW4555 | OVC078 | OVC070 | OVC049 | OVC079 | TP |
|---|---|---|---|---|---|---|---|---|---|---|---|---|---|---|---|---|---|
| 2G2 | X | | | X | | X | X | | | | | | | X | | | 5 |
| 2G4 | | | | | | | X | X | | | | | | X | X | | 4 |
| 2H9 | X | | | X | | | X | X | X | | | | | X | | | 6 |
| 2B4 | | | X | X | X | X | X | X | | | | | | | | | 6 |
| 4A3 | | | | | | | | X | X | | | | X | X | | | 4 |
| 5A3 | | X | | X | X | | | | | | | | | | | | 3 |
| 3B12 | | X | | X | | | | X | X | | | | | X | | | 5 |
| 2H5 | X | | | X | | | X | | | | | | | X | | | 4 |
| 2E12 | X | | | | X | X | | | | | | | | | | | 3 |
| 2E10 | X | | | X | X | | | | | X | | | | X | X | | 5 |
| 2C7 | X | | | | X | | X | | | | | | | X | | | 4 |
| 2F12 | X | | X | X | X | | | | | | | | | | | | 4 |
| 2E11 | X | | | X | X | | | | | | | | | | | | 3 |
| 4H3 | X | | | | | | | | | X | | | | X | | | 3 |
| 4A11 | | | | | | | | | | | | | | X | X | | 2 |
| 2A3 | | X | X | X | X | | | | | | | | | X | X | | 6 |
| 3C11 | | | | | | | | | | | | | | X | X | X | 3 |
| 5G9 | | | | | X | | | | X | | | | | | X | | 3 |
| 4A4 | | | | | | | | | | | | | | X | X | | 2 |
| 4B2 | | | | | | | | | | | X | | | X | | | 2 |
| 5C12 | | | | X | | | | | | | | | | | | X | 2 |
| 2C1 | | X | | | | X | | | X | | | | X | | | | 4 |
| 5F9 | | | | | X | | | | | | | | | | X | X | 3 |
| 2F10 | | | | | | | | | | | | | X | X | | | 2 |
| 3A9 | | | | | | | | | | | | | | X | X | | 2 |
| 3C8 | | | | | | | | | | | | | | X | X | | 2 |

Δ : Serum Dilution 1:3000 ; ▲ : Serum Dilution 1:30000; all others were analyzed at a serum dilution of 1:10000.

NEOEPITOPE DETECTION OF DISEASE USING PROTEIN ARRAYS

TECHNICAL FIELD

The present invention relates to an assay and method for diagnosing disease. More specifically, the present invention relates to an immunoassay for use in diagnosing cancer.

BACKGROUND OF THE INVENTION

It is commonly known in the art that genetic mutations can be used for detecting cancer. For example, the tumorigenic process leading to colorectal carcinoma formation involves multiple genetic alterations (Fearon et al (1990) Cell 61, 759-767). Tumor suppressor genes such as p53, DCC and APC are frequently inactivated in colorectal carcinomas, typically by a combination of genetic deletion of one allele and point mutation of the second allele (Baker et al (1989) Science 244, 217-221; Fearon et al (1990) Science 247, 49-56; Nishisho et al (1991) Science 253, 665-669; and Groden et al (1991) Cell 66, 589-600). Mutation of two mismatch repair genes that regulate genetic stability was associated with a form of familial colon cancer (Fishel et al (1993) Cell 75, 1027-1038; Leach et al (1993) Cell 75, 1215-1225; Papadopoulos et al (1994) Science 263, 1625-1629; and Bronner et al (1994) Nature 368, 258-261). Proto-oncogenes such as myc and ras are altered in colorectal carcinomas, with c-myc RNA being overexpressed in as many as 65% of carcinomas (Erisman et al (1985) Mol. Cell. Biol. 5, 1969-1976), and ras activation by point mutation occurring in as many as 50% of carcinomas (Bos et al (1987) Nature 327, 293-297; and Forrester et al (1987) Nature 327, 298-303). Other proto-oncogenes, such as myb and neu are activated with a much lower frequency (Alitalo et al (1984) Proc. Natl. Acad. Sci. USA 81, 4534-4538; and D'Emilia et al (1989) Oncogene 4, 1233-1239). No common series of genetic alterations is found in all colorectal tumors, suggesting that a variety of such combinations can be able to generate these tumors.

Increased tyrosine phosphorylation is a common element in signaling pathways that control cell proliferation. The deregulation of protein tyrosine kinases (PTKS) through overexpression or mutation has been recognized as an important step in cell transformation and tumorigenesis, and many oncogenes encode PTKs (Hunter (1989) in oncogenes and the Molecular Origins of Cancer, ed. Weinberg (Cold Spring Harbor Laboratory Press, Cold Spring Harbor, N.Y.), pp. 147-173). Numerous studies have addressed the involvement of PTKs in human tumorigenesis. Activated PTKs associated with colorectal carcinoma include c-neu (amplification), trk (rearrangement), and c-src and c-yes (mechanism unknown) (D'Emilia et al (1989), ibid; Martin-Zanca et al (1986) Nature 3, 743-748; Bolen et al (1987) Proc. Natl. Acad. Sci. USA 84, 2251-2255; Cartwright et al (1989) J. Clin. Invest. 83, 2025-2033; Cartwright et al (1990) Proc. Natl. Acad. Sci. USA 87, 558-562; Talamonti et al (1993) J. Clin. Invest. 91, 53-60; and Park et al (1993) Oncogene 8, 2627-2635).

Mutations, such as those disclosed above can be useful in detecting cancer. However, there have been few advancements, which can repeatedly be used in diagnosing cancer prior to the existence of a tumor. For example, breast cancer, which is by far the most common form of cancer in women, is the second leading cause of cancer death in humans. Despite many recent advances in diagnosing and treating breast cancer, the prevalence of this disease has been steadily rising at a rate of about 1% per year since 1940. Today, the likelihood that a women living in North America can develop breast cancer during her lifetime is one in eight.

The current widespread use of mammography has resulted in improved detection of breast cancer. Nonetheless, the death rate due to breast cancer has remained unchanged at about 27 deaths per 100,000 women. All too often, breast cancer is discovered at a stage that is too far advanced, when therapeutic options and survival rates are severely limited. Accordingly, more sensitive and reliable methods are needed to detect small (less than 2 cm diameter), early stage, in situ carcinomas of the breast. Such methods should significantly improve breast cancer survival, as suggested by the successful employment of Papinicolou smears for early detection and treatment of cervical cancer.

In addition to the problem of early detection, there remain serious problems in distinguishing between malignant and benign breast disease, in staging known breast cancers, and in differentiating between different types of breast cancers (e.g. estrogen dependent versus non-estrogen dependent tumors). Recent efforts to develop improved methods for breast cancer detection, staging and classification have focused on a promising array of so-called cancer "markers." Cancer markers are typically proteins that are uniquely expressed (e.g. as a cell surface or secreted protein) by cancerous cells, or are expressed at measurably increased or decreased levels by cancerous cells compared to normal cells. Other cancer markers can include specific DNA or RNA sequences marking deleterious genetic changes or alterations in the patterns or levels of gene expression associated with particular forms of cancer.

The utility of specific breast cancer markers for screening and diagnosis, staging and classification, monitoring and/or therapy purposes depends on the nature and activity of the marker in question. For general reviews of breast cancer markers, see Porter-Jordan et al., Hematol. Oncol. Clin. North Amer. 8: 73-100, 1994; and Greiner, Pharmaceutical Tech., May, 1993, pp. 28-44. As reflected in these reviews, a primary focus for developing breast cancer markers has centered on the overlapping areas of tumorigenesis, tumor growth and cancer invasion. Tumorigenesis and tumor growth can be assessed using a variety of cell proliferation markers (for example Ki67, cyclin D1 and proliferating cell nuclear antigen (PCNA)), some of which can be important oncogenes as well. Tumor growth can also be evaluated using a variety of growth factor and hormone markers (for example estrogen, epidermal growth factor (EGF), erbB-2, transforming growth factor (TGF)a), which can be overexpressed, underexpressed or exhibit altered activity in cancer cells. By the same token, receptors of autocrine or exocrine growth factors and hormones (for example insulin growth factor (IGF) receptors, and EGF receptor) can also exhibit changes in expression or activity associated with tumor growth. Lastly, tumor growth is supported by angiogenesis involving the elaboration and growth of new blood vessels and the concomitant expression of angiogenic factors that can serve as markers for tumorigenesis and tumor growth.

In addition to tumorigenic, proliferation and growth markers, a number of markers have been identified that can serve as indicators of invasiveness and/or metastatic potential in a population of cancer cells. These markers generally reflect altered interactions between cancer cells and their surrounding microenvironment. For example, when cancer cells invade or metastasize, detectable changes can occur in the expression or activity of cell adhesion or motility factors, examples of which include the cancer markers Cathepsin D, plasminogen activators, collagenases and other factors. In addition, decreased expression or overexpression of several putative tumor "suppressor" genes (for example nm23, p53 and rb) has been directly associated with increased metastatic potential or deregulation of growth predictive of poor disease outcome.

Additionally, ovarian cancer has the highest mortality rate of all gynecological cancers and yet there is still no reliable and easy to administer screening test. Using the multimodality approach to treatment, including aggressive cytoreductive surgery in combination with chemotherapy, five-year survival rates diminish with increasing stage: Stage I (93%), Stage II (70%), Stage III (37%), and Stage IV (25%). Despite advances in molecular biology, surgical oncology, and chemotherapy, the overall prognosis for ovarian cancer patients diagnosed at Stages II-IV remains poor. The excellent survival rates for Stage I disease provide the rationale for efforts to detect early-stage ovarian cancer as a screening test. The first priority of any screening procedure for ovarian cancer is high specificity in order to minimize the number of false positive results and thereby ensuring an acceptable positive predictive value (PPV). There have been no effective and reliable tests developed to date.

Screening for ovarian cancer has been based on strategies using serum tumor markers or ultrasound imaging of the ovaries. The most extensively investigated biomarker is CA-125, whose serum levels are elevated in 50% of Stage I and 90% of Stage II ovarian cancer patients. However, elevated CA-125 levels have also been observed in healthy women during menstruation, in patients with other gynecological diseases, and other malignancies, which suggests that the false-positive rate of CA-125 can be high.

In contrast to detection of serum antigens, the detection of serum antibody responses to tumor antigens may provide a more reliable serum marker for cancer diagnosis because serum antibodies are more stable than serum antigens. Furthermore, antibodies may be more abundant than antigens, especially at low tumor burdens characteristic of early stages. Thirty percent of patients with ductal carcinoma in situ (DCIS) in which the proto-oncogene HER2/neu was overexpressed had serum antibodies specific to this protein. In addition, antibodies to p53 have been reported in patients with early-stage ovarian, and colorectal cancers. Antibodies against heat shock protein 90 (HSP90) were also found to be associated with patients' survival and tumor metastasis. Antibodies against ribosomal proteins may constitute a novel serological marker. The presence of antibodies to ubiquitin C-terminal hydrolase L3 in colon cancer has also been reported. Changes in the level of gene expression in cancer and aberrant expression of tissue-restricted gene products in cancer are factors in the development of a humoral immune response in cancer patients. In this respect, serological analysis of recombinant cDNA expression libraries (SEREX) of human tumors with autologous serum has identified some relevant tumor antigens. Among the gene products shown to be immunogenic are MAGE, SSX2, and NY-ESO-1, which are expressed in various tumor types, but not in normal tissues except testis.

Studies on new technology based on proteomic patterns in serum to screen for early stage ovarian cancer have been reported by Petricoin et al. (2002). The procedure involved generating proteomic spectra of serum proteins using Matrix-assisted laser desorption and ionization time-of-flight (MALDI-TOF) and surface-enhanced laser desorption and ionization time-of-flight (SELDI-TOF) mass spectroscopy. In independent validation to detect early stage invasive epithelial ovarian cancer from healthy controls, the sensitivity of a multivariate model combining the three biomarkers and CA125 [74% (95% CI, 52-90%)] was higher than that of CA125 alone [65% (95% CI, 43-84%)] at a matched specificity of 97% (95% CI, 89-100%). When compared at a fixed sensitivity of 83% (95% CI, 61-95%), the specificity of the model [94% (95% CI, 85-98%)] was significantly better than that of CA125 alone [52% (95% CI, 39-65%)]. Due to the low prevalence of ovarian cancer in the general population, this level of specificity is unacceptable for a realistic ovarian cancer diagnostic test. Assuming that in a clinical setting with low-risk patients, ovarian cancer is present in approximately one per 2500 patients, the (MALDI/SELDI) approach would produce 125 false positives for every true cancer patient. Furthermore, some issues have arisen regarding the mass spectroscopy technology of protein profiling. It has been reported that the data obtained by this technology are difficult to reproduce and that they may be biased by artifacts in sample preparation, storage and processing, and patient selection.

In summary, the evaluation of proliferation markers, oncogenes, growth factors and growth factor receptors, angiogenic factors, proteases, adhesion factors and tumor suppressor genes, among other cancer markers, can provide important information concerning the risk, presence, status or future behavior of cancer in a patient. Determining the presence or level of expression or activity of one or more of these cancer markers can aid in the differential diagnosis of patients with uncertain clinical abnormalities, for example by distinguishing malignant from benign abnormalities. Furthermore, in patients presenting with established malignancy, cancer markers can be useful to predict the risk of future relapse, or the likelihood of response in a particular patient to a selected therapeutic course. Even more specific information can be obtained by analyzing highly specific cancer markers, or combinations of markers, which can predict responsiveness of a patient to specific drugs or treatment options.

Methods for detecting and measuring cancer markers have been recently revolutionized by the development of immunological assays, particularly by assays that utilize monoclonal antibody technology. Previously, many cancer markers could only be detected or measured using conventional biochemical assay methods, which generally require large test samples and are therefore unsuitable in most clinical applications. In contrast, modern immunoassay techniques can detect and measure cancer markers in relatively much smaller samples, particularly when monoclonal antibodies that specifically recognize a targeted marker protein are used. Accordingly, it is now routine to assay for the presence or absence, level, or activity of selected cancer markers by immunohistochemically staining tissue specimens obtained via conventional biopsy methods. Because of the highly sensitive nature of immunohistochemical staining, these methods have also been successfully employed to detect and measure cancer markers in smaller, needle biopsy specimens which require less invasive sample gathering procedures compared to conventional biopsy specimens. In addition, other immunological methods have been developed and are now well known in the art that allow for detection and measurement of cancer markers in non-cellular samples such as serum and other biological fluids from patients. The use of these alternative sample sources substantially reduces the morbidity and costs of assays compared to procedures employing conventional biopsy samples, which allows for application of cancer marker assays in early screening and low risk monitoring programs where invasive biopsy procedures are not indicated.

For the purpose of cancer evaluation, the use of conventional or needle biopsy samples for cancer marker assays is often undesirable, because a primary goal of such assays is to detect the cancer before it progresses to a palpable or detectable tumor stage. Prior to this stage, biopsies are generally contraindicated, making early screening and low risk monitoring procedures employing such samples untenable. Therefore, there is general need in the art to obtain samples for cancer marker assays by less invasive means than biopsy, for example by serum withdrawal.

Efforts to utilize serum samples for cancer marker assays have met with limited success, largely because the targeted markers are either not detectable in serum, or because telltale changes in the levels or activity of the markers cannot be monitored in serum. In addition, the presence of cancer markers in serum probably occurs at the time of micro-metastasis, making serum assays less useful for detecting pre-metastatic disease.

Previous attempts to develop non-invasive breast cancer marker assays utilizing mammary fluid samples have included studies of mammary fluid obtained from patients presenting with spontaneous nipple discharge. In one of these studies, conducted by Inaji et al., Cancer 60: 3008-3013, 1987, levels of the breast cancer marker carcinoembryonic antigen (CEA) were measured using conventional, enzyme linked immunoassay (ELISA) and sandwich-type, monoclonal immunoassay methods. These methods successfully and reproducibly demonstrated that CEA levels in spontaneously discharged mammary fluid provide a sensitive indicator of nonpalpable breast cancer. In a subsequent study, also by Inaji et al., Jpn. J. Clin. Oncol. 19: 373-379, 1989, these results were expanded using a more sensitive, dry chemistry, dot-immunobinding assay for CEA determination. This latter study reported that elevated CEA levels occurred in 43% of patients tested with palpable breast tumors, and in 73% of patients tested with nonpalpable breast tumors. CEA levels in the discharged mammary fluid were highly correlated with intratumoral CEA levels, indicating that the level of CEA expression by breast cancer cells is closely reflected in the mammary fluid CEA content. Based on these results, the authors concluded that immunoassays for CEA in spontaneously discharged mammary fluid are useful for screening nonpalpable breast cancer.

Although the evaluation of mammary fluid has been shown to be a useful method for screening nonpalpable breast cancer in women who experience spontaneous nipple discharge, the rarity of this condition renders the methods of Inaji et al, inapplicable to the majority of women who are candidates for early breast cancer screening. In addition, the first Inaji report cited above determined that certain patients suffering spontaneous nipple discharge secrete less than 10 μl of mammary fluid, which is a critically low level for the ELISA and sandwich immunoassays employed in that study. It is likely that other antibodies used to assay other cancer markers can exhibit even lower sensitivity than the anti-CEA antibodies used by Inaji and coworkers, and can therefore not be adaptable or sensitive enough to be employed even in dry chemical immunoassays of small samples of spontaneously discharged mammary fluid.

In view of the above, an important need exists in the art for more widely applicable, non-invasive methods and materials to obtain biological samples for use in evaluating, diagnosing and managing breast and other diseases including cancer, particularly for screening early stage, nonpalpable tumors. A related need exists for methods and materials that utilize such readily obtained biological samples to evaluate, diagnose and manage disease, particularly by detecting or measuring selected cancer markers, or panels of cancer markers, to provide highly specific, cancer prognostic and/or treatment-related information, and to diagnose and manage pre-cancerous conditions, cancer susceptibility, bacterial and other infections, and other diseases.

With specific regard to such assays, specific antibodies can only be measured by detecting binding to their antigen or a mimic thereof. Although certain classes of immunoglobulins containing the antibodies of interest can, in some cases, be separated from the sample prior to the assay (Decker, et al., EP 0,168,689 A2), in all assays, at least some portion of the sample immunoglobulins are contacted with antigen. For example, in assays for specific IgM, a portion of the total IgM can be adsorbed to a surface and the sample removed prior to detection of the specific IgM by contacting with antigen. Binding is then measured by detection of the bound antibody, detection of the bound antigen or detection of the free antigen.

For detection of bound antibody, a labeled anti-human immunoglobulin or labeled antigen is normally allowed to bind antibodies that have been specifically adsorbed from the sample onto a surface coated with the antigen, Bolz, et al., U.S. Pat. No. 4,020,151. Excess reagent is washed away and the label that remains bound to the surface is detected. This is the procedure in the most frequently used assays, or for example, for hepatitis and human immunodeficiency virus and for numerous immunohistochemical tests, Nakamura, et al., Arch Pathol Lab Med 112:869-877 (1988). Although this method is relatively sensitive, it is subject to interference from non-specific binding to the surface by non-specific immunoglobulins that cannot be differentiated from the specific immunoglobulins.

Another method of detecting bound antibodies involves combining the sample and a competing labeled antibody, with a support-bound antigen, Schuurs, et al., U.S. Pat. No. 3,654,090. This method has its limitations because antibodies in sera bind numerous epitopes, making competition inefficient.

For detection of bound antigen, the antigen can be used in excess of the maximum amount of antibody that is present in the sample or in an amount that is less than the amount of antibody. For example, radioimmunoprecipitation ("RIP") assays for GAD autoantibodies have been developed and are currently in use, Atkinson, et al., Lancet 335:1357-1360 (1990). However, attempts to convert this assay to an enzyme linked immunosorbent assay ("ELISA") format have not been successful. The RIP assay is based on precipitation of immunoglobulins in human sera, and led to the development of a radioimmunoassay ("RIA") for GAD autoantibodies. In both the RIP and the RIA, the antigen is added in excess and the bound antigen:antibody complex is precipitated with protein A-Sepharose®. The complex is then washed or further separated by electrophoresis and the antigen in the complex is detected.

Other precipitating agents can be used such as rheumatoid factor or C1q, Masson, et al., U.S. Pat. No. 4,062,935; polyethylene glycol, Soeldner, et al., U.S. Pat. No. 4,855,242; and protein A, Ito, et al., EP 0,410,893 A2. The precipitated antigen can be measured to indicate the amount of antibody in the sample; the amount of antigen remaining in solution can be measured; or both the precipitated antigen and the soluble antigen can be measured to correct for any labeled antigen that is non-specifically precipitated. These methods, while quite sensitive, are all difficult to carry out because of the need for rigorous separation of the free antigen from the bound complex, which requires at a minimum filtration or centrifugation and multiple washing of the precipitate.

Alternatively, detection of the bound antigen can be employed when the amount of antigen is less than the maximum amount of antibody. Normally, that is carried out using particles such as latex particles or erythrocytes that are coated with the antigen, Cambiaso, et al., U.S. Pat. No. 4,184,849 and Uchida, et al., EP 0,070,527 A1. Antibodies can specifically agglutinate these particles and can then be detected by light scattering or other methods. It is necessary in these assays to use a precise amount of antigen as too little antigen provides an assay response that is biphasic and high antibody titers can be read as negative, while too much antigen adversely affects the sensitivity. It is therefore necessary to carry out sequential dilutions of the sample to assure that positive samples are not missed. Further, these assays tend to detect only antibodies with relatively high affinities and the sensitivity of the method is compromised by the tendency for all of the binding sites of each antibody to bind to the antigen on the particle to which it first binds, leaving no sites for binding to the other particle.

For assays in which the free antigen is detected, the antigen can also be added in excess or in a limited amount although only the former has been reported. Assays of this type have been described where an excess of antigen is added to the sample, the immunoglobulins are precipitated, and the antigen remaining in the solution is measured, Masson, et al., supra and Soeldner, et al., supra. These assays are relatively insensitive because only a small percentage change in the amount of free antigen occurs with low amounts of antibody, and this small percentage is difficult to measure accurately.

Practical assays in which the free antigen is detected and the antigen is not present in excess of the maximum amount of antibody expected in a sample have not been described. However, in van Erp, et al., Journal of Immunoassay 12(3): 425-443 (1991), a fixed concentration of monoclonal antibody was incubated with a concentration dilution series of antigen, and free antigen was then measured using a gold sol particle agglutination immunoassay to determine antibody affinity constants.

There has been much research in the area of evaluating useful markers for determining the risk factor for patients developing IDDM. These include insulin autoantibodies, Soeldner, et al., supra and circulating autoantibodies to glutamic acid decarboxylase ("GAD"), Atkinson, et al., PCT/US89/05570 and Tobin, et al., PCT/US91/06872. In addition, Rabin, et al., U.S. Pat. No. 5,200,318 describes numerous assay formats for the detection of GAD and pancreatic islet cell antigen autoantibodies. GAD autoantibodies are of particular diagnostic importance because they occur in preclinical stages of the disease, which can make therapeutic intervention possible. However, the use of GAD autoantibodies as a diagnostic marker has been impeded by the lack of a convenient, nonisotopic assay.

One assay method involves incubating a support-bound antigen with the sample, then adding a labeled anti-human immunoglobulin. This is the basis for numerous commercially available assay kits for antibodies such as the SynELISA kit which assays for autoantibodies to GAD65, and is described in product literature entitled "SynELISA GAD II-Antibodies" (Elias USA, Inc.). Substantial dilution of the sample is required because the method is subject to high background signals from adsorption of non-specific human immunoglobulins to the support.

Many of the assays described above involve detection of antibody that becomes bound to an immobilized antigen. This can have an adverse affect on the sensitivity of the assay due to difficulty in distinguishing between specific immunoglobulins and other immunoglobulins in the sample, which bind non-specifically to the immobilized antigen. There is not only a need to develop an assay that avoids non-specific detection of immunoglobulins, but there is also the need for an improved method of detecting antibodies that combines the sensitivity advantage of immunoprecipitation assays with a simplified protocol. Finally, assays that can help evaluate the risk of developing diseases are medically and economically very important. The present invention addresses these needs.

SUMMARY OF THE INVENTION

According to the present invention, there is provided a biosensor for use in detecting the presence of diseases, the biosensor comprising a detector for detecting a presence of at least one marker indicative of a specific disease. Also provided is a method of determining efficacy of a pharmaceutical for treating a disease or staging disease by administering a pharmaceutical to a sample containing markers for a disease, detecting the amount of at least one marker of the disease in the sample, and analyzing the amount of the marker in the sample, whereby the amount of marker correlates to pharmaceutical efficacy or disease stage. Markers for gynecological disease selected from the list in Table 8 are provided. An immuno-imaging agent comprising labeled antibodies, whereby the labeled antibodies are isolated and reactive to proteins overexpressed in vivo are provided. Informatics software for analyzing the arrays discussed above is provided, wherein the software includes analyzing means for analyzing the arrays.

DESCRIPTION OF THE DRAWINGS

The patent or application file contains at least one drawing executed in color. Copies of this patent or patent application publication with color drawing(s) will be provided by the Office upon request and payment of the necessary fee.

Other advantages of the present invention are readily appreciated as the same becomes better understood by reference to the following detailed description when considered in connection with the accompanying drawings wherein:

FIG. 1A is a photograph showing the identification of a phage displaying peptide sequence of Sirt2 by plaque lift after a first round of biopanning;

FIG. 1B is a photograph showing the identification of a phage displaying peptide sequence of Sirt2 by plaque lift after a second round of biopanning;

FIG. 1C is a photograph showing the identification of a phage displaying peptide sequence of Sirt2 by plaque lift after a third round of biopanning;

FIG. 1D is a photograph showing the identification of a phage displaying peptide sequence of Sirt2 by plaque lift after a fourth round of biopanning;

FIG. 2 is a photograph showing the analysis of the PCR product of the plaques by Southern Blot hybridization;

FIG. 10 shows the matrix of reactivity between sets of clones coming from patients 1-12 (in rows) and sera from same patients (in columns), at this point (step 2 of Procedure 2), the matrix contains the results of the self-reactions: patients 1-10 have a specific self-reaction whereas patients 11 and 12 do not, Patients 11 and 12 are eliminated from the clone selection procedure;

FIG. 11 shows a matrix of reactivity between sources of clones and different sera ordered by reactivity; the clones from patient 2 react with sera from self (column 2) and patients 4 and 8; the clones from patient 3 react with sera from self (column 3) and patients 6 and 10, etc, note that the union of the set of clones coming from patients 2, 3, 5, 7 and 1 ensures that the chip made with these clones reacts with all patients;

FIG. 14A is a chart of binding of 44 clones with late stage and stage I ovarian cancer patient sera, and FIG. 14B is a chart of binding of 21 clones with late stage ovarian cancer patient sera; and FIG. 15A is a chart of the most significant clones from Group 1 dataset, and FIG. 15B is a chart of the binding of 26 clones with 16 patients on Group 2 dataset.

DETAILED DESCRIPTION OF THE INVENTION

Figure 3:
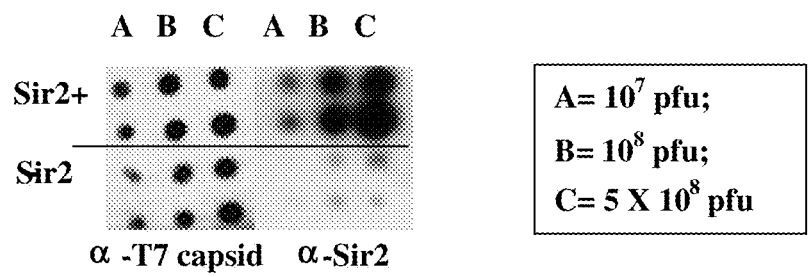
FIG. 3 is a photograph showing the Dot Blot analysis of Sirt2 positive plaques.

Generally, the present invention provides a method and markers for use in detecting disease and stages of disease. In other words, the markers can be used to determine the presence of disease without requiring the presence of symptoms.

The method and markers of the present invention can be used to diagnose the presence of a disease or a disease stage in a patient. The method of the present invention utilizes a detector device for detecting the presence of at least one marker in the serum of the patient. The benefit of such an analytical device is that the marker that is detected is one of a panel of markers. The panel of markers can include markers that are known to those of skill in the art and markers determined utilizing the methodology disclosed herein. The markers of the present invention can be used to detect diseases. Examples of diseases include, but are not limited to, gynecological sickness, such as endometriosis, ovarian cancer, breast cancer, cervical cancer, and primary peritoneal carcinoma. The method can also be used to identify overexpressed or mutated proteins in tumor cells. That such proteins are mutated or overexpressed presumably is the basis for the immune reaction to these proteins.

Therefore markers identified using these methods could provide markers for molecular pathology as diagnostic or prognostic markers.

The method can also be used for immunotherapy targeted to a person's immunoprofile based on the arrays. For personalized immunotherapy, the reactivity to particular epitope clones can be correlated using sera from patients having cancer. Using a comprehensive panel of epitope markers that can accurately detect early stage ovarian cancer one can utilize these antigen as immunotherapeutic agents personalized to the immunoprofile of each patient. When T-cells from the patient recognize antigen biomarkers, they get stimulated, activated and therefore produce an immune-response. Such reactivity demonstrates the potential of each antigen as a component of a vaccine to induce a T cell-mediated immune response essential for generation of cancer vaccines. Individuals scoring positive in the presymptomatic testing for OVCA can then be offered an anti-tumor vaccine tailored to their immunoprofile against a panel of tumor antigens.

The detector includes, but is not limited to an assay, a slide, a filter, a microarray, macroarray, computer software implementing the data analysis methods, and any combinations thereof. The detector can also include a two-color detection system or other detector system known to those of skill in the art.

By "bodily fluid" as used herein it is meant any bodily fluid known to those of skill in the art to contain antibodies therein. Examples include, but are not limited to, blood, saliva, tears, spinal fluid, serum, and other fluids known to those of skill in the art to contain antibodies.

By "biopanning", it is meant a selection process for use in screening a library (Parmley and Smith, Gene, 73:308 (1988); Noren, C. J., NEB Transcript, 8(1):1 (1996)). Biopanning is carried out by incubating phages encoding the peptides with a plate coated with the proteins, washing away the unbound phage, eluting, and amplifying the specifically bound phage. Those skilled in the art readily recognize other immobilization schemes that can provide equivalent technology, such as but not limited to binding the proteins or other targets to beads.

By staging the disease, as for example in cancer, it is intended to include determining the extent of a cancer, especially whether the disease has spread from the original site to other parts of the body. The stages can range from 0 to 5 with 0 being the presence of cancerous cells and 5 being the spread of the cancer cells to other parts of the body including the lymph nodes. Further, the staging can indicate the stage of a borderline histology. A borderline histology is a less malignant form of disease. Additionally, staging can indicate a relapse of disease, in other words the reoccurrence of disease.

The term "marker" as used herein is intended to include, but is not limited to, a gene or a piece of a gene which codes for a protein, a protein such as a fusion protein, open reading frames such as ESTs, epitopes, mimotopes, antigens, and any other indicator of immune response. The marker can also be used as a predictor of disease or the recurrence of disease.

The present invention further includes a random peptide epitope (mimotope) that mimics a natural antigenic epitope during epitope presentation. Such mimotopes are useful in the applications and methods discussed above. Also included in the present invention is a method of identifying a random peptide epitope. In the method, a library of random peptide epitopes is generated or selected. The library is contacted with an anti-antibody. Mimotopes are identified that are specifically immunoreactive with the antibody. Sera (containing anti antibodies) or antibodies generated by the methods of the present invention can be used. Random peptide libraries can, for example, be displayed on phage (phagotopes) or generated as combinatorial libraries.

"Antibody" refers to a polypeptide comprising a framework region from an immunoglobulin gene or fragments thereof that specifically binds and recognizes an antigen. The recognized immunoglobulin genes include the kappa, lambda, alpha, gamma, delta, epsilon, and mu constant region genes, as well as the various immunoglobulin diversity/joining/variable region genes. Light chains are classified as either kappa or lambda. Heavy chains are classified as gamma, mu, alpha, delta, or epsilon, which in turn define the immunoglobulin classes, IgG, IgM, IgA, IgD and IgE, respectively.

An exemplary immunoglobulin (antibody) structural unit comprises a tetramer. Each tetramer is composed of two identical pairs of polypeptide chains, each pair having one "light" (about 25 kDa) and one "heavy" chain (about 50-70 kDa). The N-terminus of each chain defines a variable region of about 100 to 110 or more amino acids primarily responsible for antigen recognition. The terms variable light chain (VL) and variable heavy chain (VH) refer to these light and heavy chains respectively.

Antibodies exist, e.g., as intact immunoglobulins or as a number of well-characterized fragments produced by digestion with various peptidases. Thus, for example, pepsin digests an antibody below the disulfide linkages in the hinge region to produce F(ab)'2, a dimer of Fab which itself is a light chain joined to VH-CH 1 by a disulfide bond. The F(ab)'2 can be reduced under mild conditions to break the disulfide linkage in the hinge region, thereby converting the F(ab)'2 dimer into an Fab' monomer. The Fab' monomer is essentially Fab with part of the hinge region (see Fundamental Immunology (Paul ed., 3d ed. 1993). While various antibody fragments are defined in terms of the digestion of an intact antibody, one of skill can appreciate that such fragments can be synthesized de novo either chemically or by using recombinant DNA methodology. Thus, the term antibody, as used herein, also includes antibody fragments either produced by the modification of whole antibodies, or those synthesized de novo using recombinant DNA methodologies (e.g., single chain Fv) or those identified using phage display libraries (see, e.g., McCafferty et al., Nature 348:552-554 (1990)).

For preparation of monoclonal or polyclonal antibodies, any technique known in the art can be used (see, e.g., Kohler & Milstein, Nature 256:495-497 (1975); Kozbor et al., Immunology Today 4: 72 (1983); Cole et al., pp. 77-96 in Monoclonal Antibodies and Cancer Therapy (1985)). Techniques for the production of single chain antibodies (U.S. Pat. No. 4,946,778) can be adapted to produce antibodies to polypeptides of this invention. Also, transgenic mice, or other organisms such as other mammals, can be used to express humanized antibodies. Alternatively, phage display technology can be used to identify antibodies and heteromeric Fab fragments that specifically bind to selected antigens (see, e.g., McCafferty et al., Nature 348:552-554 (1990); Marks et al., Biotechnology 10:779-783 (1992)).

A "chimeric antibody" is an antibody molecule in which (a) the constant region, or a portion thereof, is altered, replaced or exchanged so that the antigen binding site (variable region) is linked to a constant region of a different or altered class, effector function and/or species, or an entirely different molecule which confers new properties to the chimeric antibody, e.g., an enzyme, toxin, hormone, growth factor, drug, etc.; or (b) the variable region, or a portion thereof, is altered, replaced or exchanged with a variable region having a different or altered antigen specificity.

The term "immunoassay" is an assay wherein an antibody specifically binds to an antigen. The immunoassay is characterized by the use of specific binding properties of a particular antibody to isolate, target, and/or quantify the antigen. In addition, an antigen can be used to capture or specifically bind an antibody.

The phrase "specifically (or selectively) binds" to an antibody or "specifically (or selectively) immunoreactive with," when referring to a protein or peptide, refers to a binding reaction that is determinative of the presence of the protein in a heterogeneous population of proteins and other biologics. Thus, under designated immunoassay conditions, the specified antibodies bind to a particular protein at least two times the background and do not substantially bind in a significant amount to other proteins present in the sample. Specific binding to an antibody under such conditions can require an antibody that is selected for its specificity for a particular protein. For example, polyclonal antibodies raised to modified β-tubulin from specific species such as rat, mouse, or human can be selected to obtain only those polyclonal antibodies that are specifically immunoreactive, e.g., with β-tubulin modified at cysteine 239 and not with other proteins. This selection can be achieved by subtracting out antibodies that cross-react with other molecules. Monoclonal antibodies raised against modified β-tubulin can also be used. A variety of immunoassay formats can be used to select antibodies specifically immunoreactive with a particular protein. For example, solid-phase ELISA immunoassays are routinely used to select antibodies specifically immunoreactive with a protein (see, e.g., Harlow & Lane, Antibodies, A Laboratory Manual (1988), for a description of immunoassay formats and conditions that can be used to determine specific immunoreactivity). Typically a specific or selective reaction can be at least twice background signal or noise and more typically more than 10 to 100 times background.

A "label" or a "detectable moiety" is a composition detectable by spectroscopic, photochemical, biochemical, immunochemical, or chemical means. For example, useful labels include 32P, fluorescent dyes, iodine, electron-dense reagents, enzymes (e.g., as commonly used in an ELISA), biotin, digoxigenin, or haptens and proteins for which antisera or monoclonal antibodies are available, e.g., by incorporating a radiolabel into the peptide, or any other label known to those of skill in the art.

A "labeled antibody or probe" is one that is bound, either covalently, through a linker or a chemical bond, or noncovalently, through ionic, van der Waals, electrostatic, or hydrogen bonds to a label such that the presence of the antibody or probe can be detected by detecting the presence of the label bound to the antibody or probe.

The terms "isolated" "purified" or "biologically pure" refer to material that is substantially or essentially free from components that normally accompany it as found in its native state. Purity and homogeneity are typically determined using analytical chemistry techniques such as polyacrylamide gel electrophoresis or high performance liquid chromatography. A protein that is the predominant species present in a preparation is substantially purified. The term "purified" denotes that a nucleic acid or protein gives rise to essentially one band in an electrophoretic gel. Particularly, it means that the nucleic acid or protein is at least 85% pure, optionally at least 95% pure, and optionally at least 99% pure.

The term "recombinant" when used with reference, e.g., to a cell, or nucleic acid, protein, or vector, indicates that the cell, nucleic acid, protein or vector, has been modified by the introduction of a heterologous nucleic acid or protein or the alteration of a native nucleic acid or protein, or that the cell is derived from a cell so modified. Thus, for example, recombinant cells express genes that are not found within the native (non-recombinant) form of the cell or express native genes that are otherwise abnormally expressed, under expressed or not expressed at all.

An "expression vector" is a nucleic acid construct, generated recombinantly or synthetically, with a series of specified nucleic acid elements that permit transcription of a particular nucleic acid in a host cell. The expression vector can be part of a plasmid, virus, or nucleic acid fragment. Typically, the expression vector includes a nucleic acid to be transcribed operably linked to a promoter.

By "support or surface" as used herein, the term is intended to include, but is not limited to a solid phase which is typically a support or surface, which is a porous or non-porous water insoluble material that can have any one of a number of shapes, such as strip, rod, particle, including beads and the like. Suitable materials are well known in the art and are described in, for example, Ullman, et al. U.S. Pat. No. 5,185,243, columns 10-11, Kurn, et al., U.S. Pat. No. 4,868,104, column 6, lines 21-42 and Milburn, et al., U.S. Pat. No. 4,959,303, column 6, lines 14-31, which are incorporated herein by reference. Binding of ligands and receptors to the support or surface can be accomplished by well-known techniques, readily available in the literature. See, for example, "Immobilized Enzymes," Ichiro Chibata, Halsted Press, New York (1978) and Cuatrecasas, J. Biol. Chem. 245:3059 (1970). Whatever type of solid support is used, it must be treated so as to have bound to its surface either a receptor or ligand that directly or indirectly binds the antigen. Typical receptors include antibodies, intrinsic factor, specifically reactive chemical agents such as sulfhydryl groups that can react with a group on the antigen, and the like. For example, avidin or streptavidin can be covalently bound to spherical glass beads of 0.5-1.5 mm and used to capture a biotinylated antigen.

Signal producing system ("sps") includes one or more components, at least one component being a label, which generate a detectable signal that relates to the amount of bound and/or unbound label, i.e. the amount of label bound or not bound to the compound being detected. The label is any molecule that produces or can be induced to produce a signal, such as a fluorescer, enzyme, chemiluminescer, or photosensitizer. Thus, the signal is detected and/or measured by detecting enzyme activity, luminescence, or light absorbance.

Suitable labels include, by way of illustration and not limitation, enzymes such as alkaline phosphatase, glucose-6-phosphate dehydrogenase ("G6PDH") and horseradish peroxidase; ribozyme; a substrate for a replicase such as Q-beta replicase; promoters; dyes; fluorescers such as fluorescein, isothiocyanate, rhodamine compounds, phycoerythrin, phycocyanin, allophycocyanin, o-phthaldehyde, and fluorescamine; chemiluminescers such as isoluminol; sensitizers; coenzymes; enzyme substrates; photosensitizers; particles such as latex or carbon particles; suspendable particles; metal sol; crystallite; liposomes; cells, etc., which can be further labeled with a dye, catalyst, or other detectable group. Suitable enzymes and coenzymes are disclosed in Litman, et al., U.S. Pat. No. 4,275,149, columns 19-28, and Boguslaski, et al., U.S. Pat. No. 4,318,980, columns 10-14; suitable fluorescers and chemiluminescers are disclosed in Litman, et al., U.S. Pat. No. 4,275,149, at columns 30 and 31; which are incorporated herein by reference. Preferably, at least one sps member is selected from the group consisting of fluorescers, enzymes, chemiluminescers, photosensitizers, and suspendable particles.

The label can directly produce a signal, and therefore, additional components are not required to produce a signal. Numerous organic molecules, for example fluorescers, are able to absorb ultraviolet and visible light, where the light absorption transfers energy to these molecules and elevates them to an excited energy state. This absorbed energy is then dissipated by emission of light at a second wavelength. Other labels that directly produce a signal include radioactive isotopes and dyes.

Alternately, the label may need other components to produce a signal, and the sps can then include all the components required to produce a measurable signal, which can include substrates, coenzymes, enhancers, additional enzymes, substances that react with enzymatic products, catalysts, activators, cofactors, inhibitors, scavengers, metal ions, specific binding substance required for binding of signal generating substances, and the like. A detailed discussion of suitable signal producing systems can be found in Ullman, et al. U.S. Pat. No. 5,185,243, columns 11-13, which is incorporated herein by reference.

The label is bound to a specific binding pair (hereinafter "sbp") member which is the antigen, or is capable of directly or indirectly binding the antigen, or is a receptor for the antigen, and includes, without limitation, the antigen; a ligand for a receptor bound to the antigen; a receptor for a ligand bound to the antigen; an antibody that binds the antigen; a receptor for an antibody that binds the antigen; a receptor for a molecule conjugated to an antibody to the antigen; an antigen surrogate capable of binding a receptor for the antigen; a ligand that binds the antigen, etc. Binding of the label to the sbp member can be accomplished by means of non-covalent bonding as for example by formation of a complex of the label with an antibody to the label or by means of covalent bonding as for example by chemical reactions which result in replacing a hydrogen atom of the label with a bond to the sbp member or can include a linking group between the label and the sbp member. Such methods of conjugation are well known in the art. See for example, Rubenstein, et al., U.S. Pat. No. 3,817,837, which is incorporated herein by reference. Other sps members can also be bound covalently to sbp members. For example, in Ullman, et al., U.S. Pat. No. 3,996,345, two sps members such as a fluorescer and quencher can be bound respectively to two sbp members that both bind the analyte, thus forming a fluorescer-sbp1:analyte:sbp2-quencher complex. Formation of the complex brings the fluorescer and quencher in close proximity, thus permitting the quencher to interact with the fluorescer to produce a signal. This is a fluorescent excitation transfer immunoassay. Another concept is described in Ullman, et al., EP 0,515,194 A2, which uses a chemiluminescent compound and a photosensitizer as the sps members. This is referred to as a luminescent Oxygen channeling immunoassay. Both the aforementioned references are incorporated herein by reference.

The analysis of mRNA expression in tumors does not necessarily reveal the status of protein levels in the cancer cells. Other factors such as protein half-life and mutation can be altered without an effect on mRNA levels thus masking significant molecular changes at the protein level. Serum antibody reactivity to cellular proteins occurs in cancer patients due to presentation of mutated forms of proteins from the tumor cells or overexpression of proteins in the tumor cells. The host immune system can direct individuals to molecular events critical to the genesis of the disease. Using a candidate gene approach, experience has shown that the frequency of serum positivity to any single protein is low. Therefore, to increase the identification of such autoantigens, a more global approach is employed to exploit immunoreactivity to identify large numbers of cDNAs coding for proteins that are mutated or upregulated in cancer cells.

In order to develop an effective screening test for early detection of ovarian cancer, cDNA phage display libraries are used to isolate cDNAs coding for epitopes reacting with antibodies present specifically in the sera of patients with ovarian cancer. The methods of the present invention detect various antibodies that are produced by patients in reaction to proteins overexpressed in their ovarian tumors. This is achievable by differential biopanning technology using human sera collected both from normal individuals and patients having ovarian cancer and phage display libraries expressing cDNAs of genes expressed in ovarian epithelial tumors and cell lines. Serum reactivity toward a cellular protein can occur because of the presentation to the immune system of a mutated form of the protein from the tumor cells or overexpression of the protein in the tumor cells. The strategy provides for the identification of epitope-bearing phage clones (phagotopes) displaying reactivity with antibodies present in sera of patients having ovarian cancer but not in control sera from unaffected women. This strategy leads to the identification of novel disease-related epitopes for diseases including, but not limited to ovarian cancer, that have prognostic/diagnostic value with additional potential for therapeutic vaccines and medical imaging reagents. This also creates a database that can be used to determine both the presence of disease and the stage of the disease.

The series of experiments disclosed herein provide direct evidence that biopanning a T7 coat protein fusion library can isolate epitopes for antibodies present in polyclonal sera. This also showed that the technology can be applied to direct microarray screening of large numbers of selected phage against numerous patient and control sera. This approach provides a large number of biomarkers for early detection of disease.

More specifically, the methods of the present invention provide four to five cycles of affinity selection and biopanning which are carried out with biological amplification of the phage after each biopanning, meaning growth of the biological vector of the cDNA expression clone in a biological host. Examples of biological amplification include but are not limited to growth of a lytic or lysogenic bacteriophage in host bacteria or transformation of bacterial host with selected DNA of the cDNA expression vector. The number of biopanning cycles generally determines the extent of the enrichment for phage that binds to the sera of patient with ovarian cancer. This strategy allows for one cycle of biopanning to be performed in a single day. Someone skilled in the art can establish different schedules of biopanning that provide the same essential features of the procedure described above.

Two biopanning experiments are performed with each library differentially selecting clones between control and disease patient sera. The first selection is to isolate phagotope clones that do not bind to control sera pooled from control women but do bind to a pool of disease patient serum. This set of phagotope clones represent epitopes that are indicative of the presence of disease as recognized by the host immune system. The second type of screening is performed to isolate phagotope clones that did not bind to a pool of control sera but do bind to an individual patient's serum. Those sets of phagotope clones represent epitopes that are indicative of the presence of disease.

Subsequent to the biopanning, the clones so isolated can be used to contact antibodies in sera by spotting the clones or peptide sequences of amino acids containing those encoded by the clones. After spotting on a solid support, the arrays are rinsed briefly in a 1% BSA/PBS to remove unbound phage, then transferred immediately to a 1% BSA/PBS blocking solution and allowed to sit for 1 hour at room temperature. The excess BSA is rinsed off from the slides using PBS. This step insures that the elution step of antibodies is more effective. The use of PBS elutes all of the antibodies without harming the binding of the antibody. Antibody detection of reaction with the clones or peptides on the array is carried out by labeling of the serum antibodies or through the use of a labeled secondary antibody that reacts with the patient's antibodies. A second control reaction to every spot allows for greater accuracy of the quantitation of reactivity and increases sensitivity of detection.

The slides are subsequently processed to quantify the reaction of each phagotopes. Such processing is specific to the label used. For instance, if fluorophore Cy3-Cy5 labels are used, this processing is done in a laser scanner that captures an image of the slide for each fluorophore used. Subsequent image processing familiar to those skilled in the art can provide intensity values for each phagotope.

The data analysis can be divided into the following steps:
1. Pre-processing and normalization.
2. Identifying the most informative markers
3. Building a predictor for molecular diagnosis of ovarian cancer and validating the results.

The purpose of the first step is to cleanse the data from artifacts and prepare it for the subsequent steps. Such artifacts are usually introduced in the laboratory and include: slide contamination, differential dye incorporation, scanning and image processing problems (e.g. different average intensities from one slide to another), imperfect spots due to imperfect arraying, washing, drying, etc. The purpose of the second step is to select the most informative phages that can be used for diagnostic purposes. The purpose of the third step is to develop a software classifier able to diagnose cancer based on the antibody reactivity values of the selected phages. The last step also includes the validation of this classifier and the assessment of its performance using various measures such as specificity, sensitivity, positive predictive value and negative predictive value. The computation of such measures can be done on cases not used during the design of the chip in order to assess the real-world performance of the diagnosis tool obtained.

The pre-processing and normalization step is used for arrays using two channels such as Cy5 for the human IgG and Cy3 for the T7 control, the spots are segmented and the mean intensity is calculated for each spot. A mean intensity value is calculated for the background, as well. A background corrected value is calculated by subtracting the background from the signal. If necessary, non-linear dye effects can be eliminated by performing an exponential normalization (Houts, 2000) and/or LOESS normalization of the data and/or a piecewise linear normalization (see FIGS. 7A and 7B). The values coming from each channel are subsequently divided by their mean of the intensities over the whole array. Subsequently, the ratio between the IgG and the T7 channels was calculated. The values coming from replicate spots (spots printed in quadruplicates) are combined by calculating mean and standard deviation. Outliers (outside+/−two standard deviations) are flagged for manual inspection). Single channel arrays are pre-processed in a similar way but without taking the ratios. This preprocessing sequence was shown to provide good results for all preliminary data analyzed.

The step of selecting the most informative markers is used to identify the most informative phages out of the large set of phages started with. The better the selection, the better is the expected accuracy of the diagnosis tool.

A first test is necessary to determine whether a specific epitope is suitable for inclusion in the final set to be spotted. The selection methods to be applied follow the principles of the methods successfully applied in (Golub et al., 1999; Alizadeh et al., 2000) and can be briefly described in the following.

Procedure 1

Figure 7A:
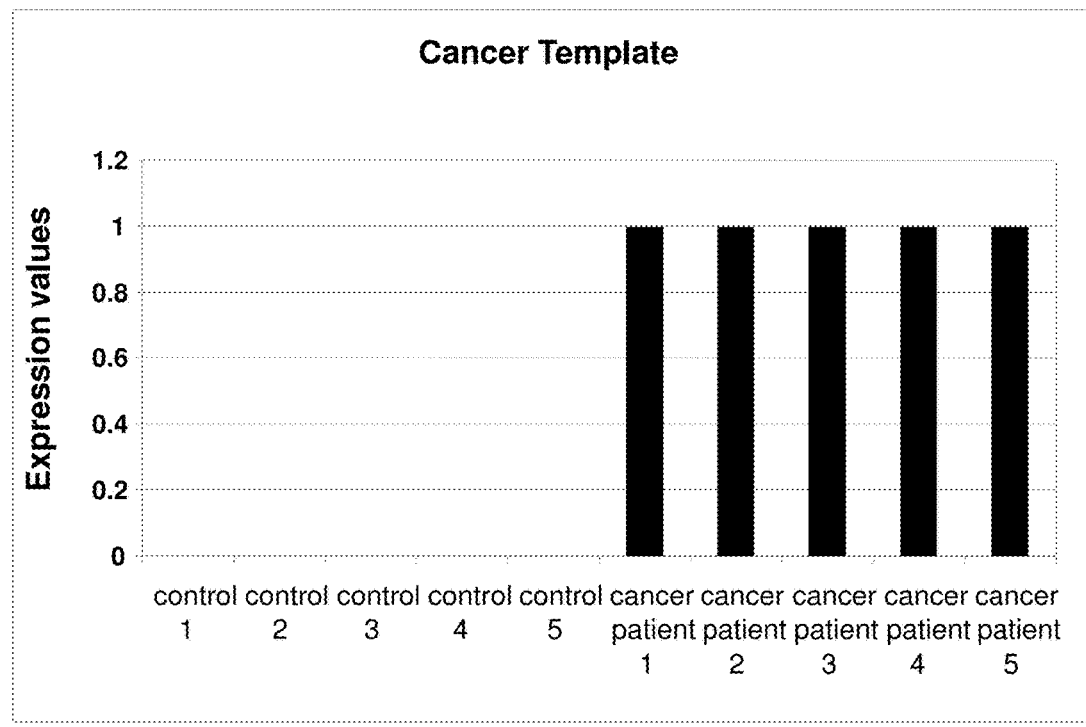
FIG. 7A shows a template of antibody reactivity that indicates an informative phage epitope, with multiple cancer patients expressing serum antibodies reactive with the phage epitope, and multiple controls not expressing the antibody.
Figure 7B:
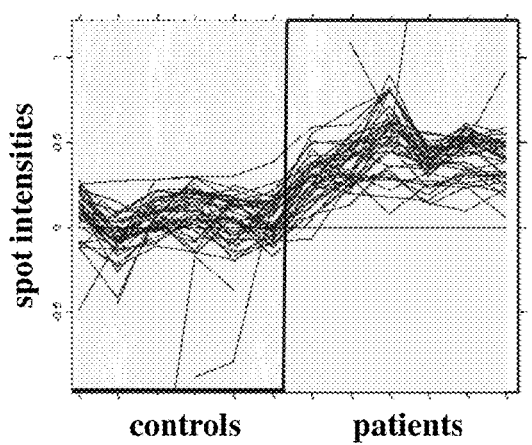
FIG. 7B shows the method of finding informative epitopes: The spot intensities are plotted on the vertical axis for 12 subjects (controls to the left and patients to the right) the template defined on the left (shown in blue) was used with a correlation distance, a correlation threshold of 0.8 selected the 46 epitopes shown here in red (out of the total of 4×96=384 shown here in yellow)

The procedure is initiated defining a template for the cancer case (FIGS. 7A and 7B). Unlike gene expression experiments where the expression level of a gene can be either up or down in cancer vs. healthy subjects, here one is testing for the presence of antibodies specific to cancer were tested for. Therefore, epitopes with high reactivity in controls and low reactivity in patients are not expected and the profile to the left in FIG. 7A is sufficient. Each epitope can have a profile across the given set of patients (FIGS. 9 A and B). The profile of each epitope is compared with the templates using a correlation-based distance. Those skilled in the art can recognize that the other distances may be used without essentially changing the procedure.

The epitopes are then ordered based on the similarity between the reference profile (FIG. 7A) and their actual profile. FIG. 7B shows 46 epitopes found informative for a correlation threshold of 0.8. The final cutoff threshold is calculated by doing 1000 random permutations once the whole data set become available. Each such permutation moves randomly the subjects between the 'patient' and 'control' categories. Calculating the score of each epitope profile for such permutations allows us to establish a suitable threshold for the similarity (Golub et. al. 1999).

Figure 8A:
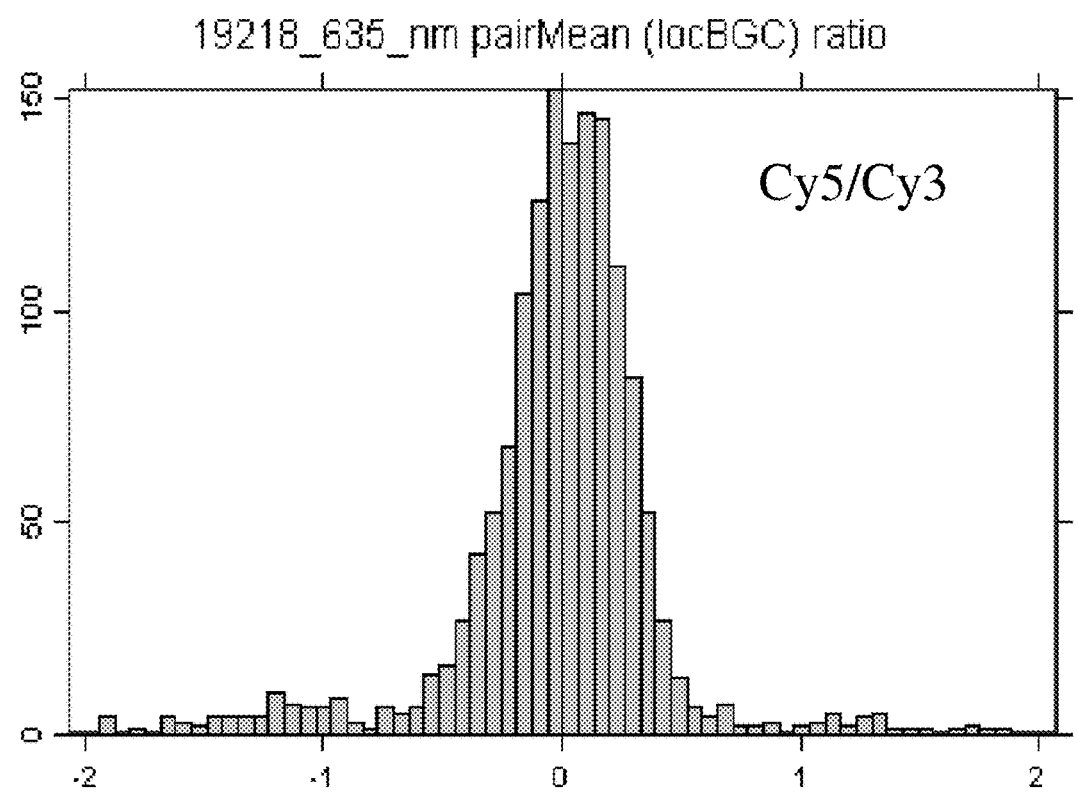
FIG. 8A shows an example histogram of a control subject (19218) with a high but non-specific reaction to the left; the histogram is calculated on the ratio of the background corrected mean intensity of the human IgG labeled with Cy5 vs. the background corrected mean intensity of the T7 labeled with Cy3.
Figure 8B:
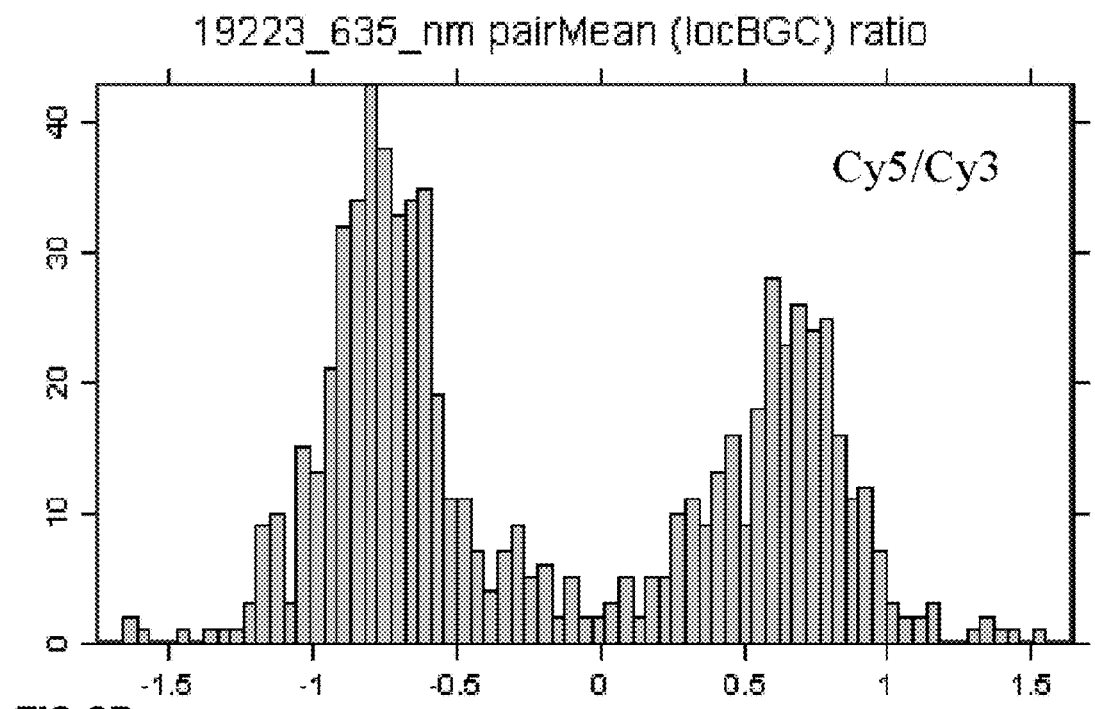
FIG. 8B shows, for comparison to FIG. 8A, the histogram of a patient (19223), with the histograms calculated as described for FIG. 8A.
Figure 9A:
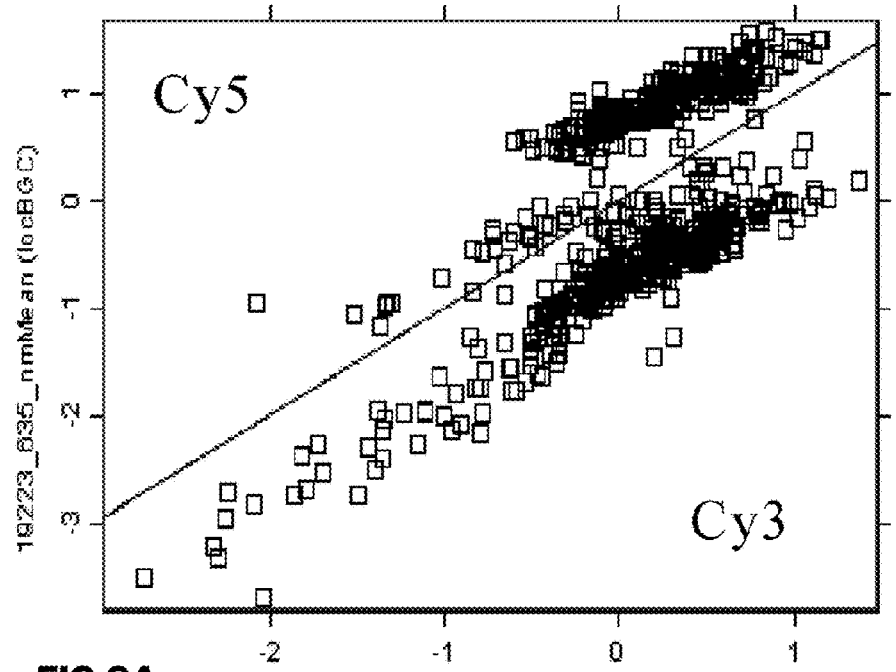
FIG. 9A shows the scatterplot of a patient MEC1 (19223); the scattergram plots the background corrected mean intensity of the human IgG labeled with Cy5 vs. the background corrected mean intensity of the T7 labeled with Cy3.
Figure 9B:
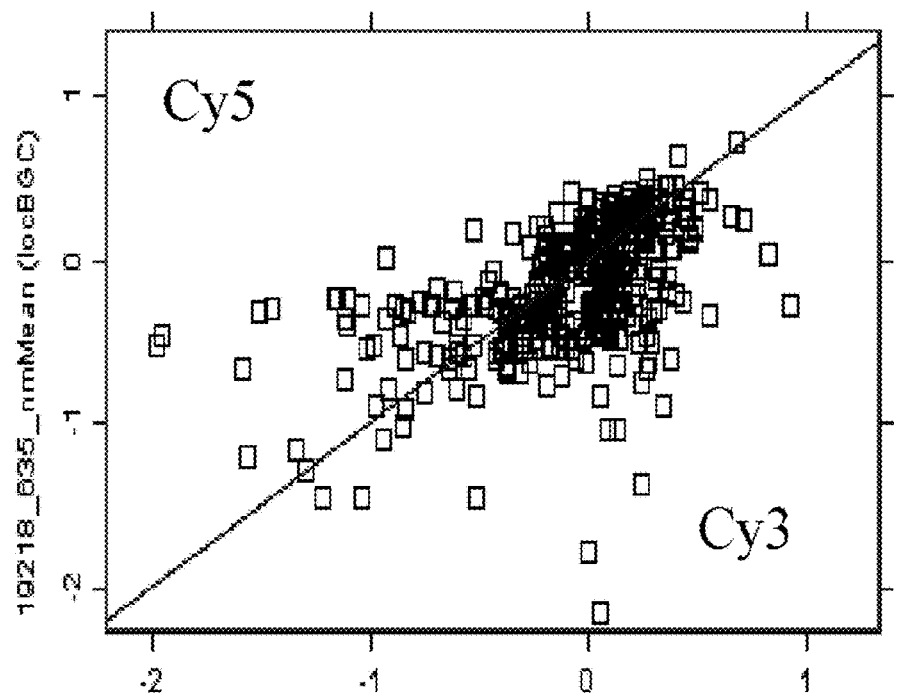
FIG. 9B shows the scatterplot of a control subject (19218) with a strong but non-specific reaction, for comparison with FIG. 9A; the scatterplot was plotted as described for FIG. 9A.

The technique follows closely the one used in (Golub, 1999). However, the technique can be further improved as follows. Firstly, this technique was shown to provide good results if most controls are consistent by providing the same type of reactivity. However, preliminary data showed that there are control subjects that show a non-specific reactivity with all clones (see FIG. 1B). While still clearly different from patients. FIG. 8 shows a comparison between the histogram profile of a control subject showing a non-specific reaction (19218) (FIG. 8A) and the profile of a patient (19223) (FIG. 8B). FIGS. 9A and 9B show the scatterplots of the same subjects. While still clearly different from patients, such control subjects with a high non-specific reaction introduces spikes in the clone profile in the area corresponding to the control subjects (left hand side of the template in FIG. 7). Such spikes decrease the score of the relevant clones making them more difficult to distinguish from the irrelevant ones. In order to reduce this effect, all control subjects with a non-specific response (i.e. a unimodal distribution such as in FIG. 8A) were eliminated from the analysis leading to the epitope selection.

A second essential modification is related to the set of epitopes selected. There are rare patients who might react only to a small number of very specific epitopes. If the selection of the epitopes is done on statistical grounds alone, such very specific epitopes can be missed if the set of patients available contains only few such rare patients. In order to maximize the sensitivity of the penultimate test resulted from this work, every effort was made to include epitopes which might be the only ones reacting to rare patients. In order to do this, the information content of the set of epitopes is maximized while trying to minimize the number of epitopes used using the following procedure.

Procedure 2

Assume there are m patients and k controls. Select n random patients from the m available. For each of the n patients used for epitope selection, amplify (n×4 biopannings) and do self-reactions. Eliminate those patients/epitopes that do not react to self.

Make a chip with all available, self-reacting epitopes printed in quadruplicates. React this chip with all patients and controls (n+k antibody reactions). Eliminate controls with a non-specific reactivity. For the set of epitopes coming from a single patient, apply Procedure 1 to order the epitopes in the order of their informational content and select the ones that can be used to differentiate patients from controls.

Order the epitopes by their reactivity in decreasing order of the number of patients they react to. Scan this list from the top down, moving epitopes from this list to the final set. Every time a set of epitopes coming from a patient x is added to the final set, the patient x and all other patients that these epitopes react to are represented in the current set of epitopes. Repeat until all patients are represented in the current set of epitopes.

This procedure tries to minimize the number of epitopes used while maximizing the number of patients that react to the chip containing the selected epitopes.

The following example shows how this procedure works using a simple example. The matrix in FIG. 10 contains a row i for the clones coming from patient i and a column j for the serum coming from patient j. A serum is said to react specifically with a set of clones if the histogram of the ratios is bimodal (see subject 19223 in FIGS. 8B and 9A). A serum is said to react non-specifically if the histogram of the ratio is unimodal (see subject 19218 in FIGS. 8A and 9B). Furthermore, a serum might not react at all with a set of clones. If the serum from patient j reacts specifically with the clones from patient i, the matrix can contain a value of 1 at the position (i, j). The element at position (i, j) is left blank if the there is no reaction or the reaction is non-specific.

Each set of epitopes corresponding to a row of the matrix is pruned by sub-selecting epitopes according to Procedure 1. The rows are now sorted in decreasing reactivity (number of patients other than self that the clones react to). For instance, in FIG. 11, the clones from patient 2 react with sera from self (column 2) and patients 4 and 8. The clones from patient 3 react with sera from self (column 3) and patients 6 and 10, etc. The final set of clones was obtained from patients 2, 3, 5, 7 and 1 (reading top-down in column 1). Clones coming from patients 8, 9 and 10 are not included since these patients already react to clones coming from other patients. This set ensures that the chip made with these clones reacts with all patients in this example.

Procedure 3

Arrays using two channels such as Cy5 for the human IgG and Cy3 for the T7 control are processed as follows. The spots are segmented and the mean intensity is calculated for each spot. A mean intensity value is calculated for the background, as well. A background corrected value is calculated by subtracting the background from the signal. The values coming from each channel are normalized by dividing by their mean. Subsequently, the ratio between the IgG and the T7 channels are calculated and a logarithmic function is applied. The values coming from replicate spots (spots printed in quadruplicates) are combined by calculating mean and standard deviation. Outliers (outside+/−two standard deviations) are flagged for manual inspection. Someone skilled in the art can recognize that various combinations and permutations of the steps above or similar could replace the normalization procedure above without substantially changing rest of the data analysis process. Such similar steps include without limitation taking the median instead of the mean, using logarithmic functions in various bases, etc.

The histogram of the average log ratio is calculated. If the histogram is unimodal (e.g. subject 19223 in FIG. 7), there is no specific response. If the histogram is clearly bimodal (e.g. subject 19218 in FIG. 7), there is a specific response. All 25 subjects analyzed so far fell in one of these two categories or had no response at all. A mixed probability model is used in less clear cases to fit two normal distributions as in (Lee, 2000). If the two distributions found under the maximum likelihood assumption are separated by a distance d of more than 2 standard deviations (corresponding to a p-value of approximately 0.05), there is a specific response. If the distance is less than 2 standard deviations, the response can be considered as not specific. The preliminary data analyzed so far showed a very good separation of the distributions for the patients.

Once the chosen clones are spotted on the final version of the array, a number of sera coming from both patients and controls can be tested. These sera come from subjects not used in any of the phases that lead to the fabrication of the array (i.e. not involved in clone selection, not used as controls, etc.). Each test was evaluated using Procedure 3 above. The performance on this validation data can be reported in terms of PPV, NPV, specificity and sensitivity. Since these performance indicators are calculated on data not previously used, they provide a good indication of the performance of the test for screening purposes for the various categories of patients envisage in the general population.

The present invention also provides a kit including all of the technology for performing the above analysis. This is included in a container of a size sufficient to hold all of the required pieces for analyzing sera, as well as a digital medium such as a floppy disk or CDROM containing the software necessary to interpret the results of the analysis. These components include the array of clones or peptides spotted onto a solid support, prewashing buffers, a detection reagent for identifying reactivity of the patients' serum antibodies to the spotted clones or peptides, post-reaction washing buffers, primary and secondary antibodies to quantify reactivity of the patients serum antibodies with the spotted array and methods to analyze the reactivity so as to establish an interpretation of the serum reactivity.

A biochip for detecting the presence of the disease state in a patient's sera is provided by the present invention. The biochip has a detector contained within the biochip for detecting antibodies in a patient's sera. This allows a patient's sera to be tested for the presence of a multitude of diseases or reaction to disease markers using a single sample and the analysis can be conducted and analyzed on a single chip. By utilizing such a chip this lowers the time required for the detection of disease while also enabling a doctor to determine the level of disease spread or infection. The chip, or other informatics system can be altered to weigh the results. In other words, the informatics can be altered to adjust the levels of sensitivity and/or specificity of the chip.

The present invention is well suited for providing useful information regarding the efficacy of pharmaceuticals at treating disease. Specifically, the present invention is well suited in measuring the effects of drugs and other medications based on the above-identified markers. The present invention determines the minimum level of a pharmaceutical needed to achieve therapeutic benefits. Thus, the present invention is useful in determining effective treatment of various diseases and illnesses. The results of the analysis can be utilized to determine if the treatment is effective or if such treatment needs to be altered.

Further, the treatment can be altered based upon the markers detected. For example, the treatment can be specifically designed based upon the markers identified. In other words, the therapy can be altered to most suitably treat the identified markers, such that the treatment is designed to most efficiently treat the identified marker. The ability to adjust the therapy enables the treatment to be tailored to the treated person's needs. The treatments that can be used range from vaccines to chemotherapy.

The markers of the present invention can also be used for immuno-imaging. Immuno-imaging is a process in which antibodies to a specific antigen are labeled such that the label can be detected externally. Examples of externals detectors include, but are not limited to, x-rays, MRI, CT scan, and PET scans. The imaging functions because an imaging reagent containing the labeled antibody is administered to a patient.

The above discussion provides a factual basis for the use of the combination of markers and method of making the combination. The methods used with a utility of the present invention can be shown by the following non-limiting examples and accompanying figures.

EXAMPLES

Example 1

The purpose of this study is to clone epitopes that are recognized by sera from women with ovarian cancer but not recognized by normal sera from unaffected women. As these epitopes are cloned, protein array assays are developed capable of detecting ovarian cancer at an early stage by analyzing antigens recognized in the sera of at risk women. Toward this end, individual sera were screened using these protein biochips to determine the antibody reactivity to each protein epitope. Antibody reactivity is detected that does not appear in control sera. The patients and control sera obtained for this study were used to calibrate the protein biochips and identify the most informative epitope-clones. The women were monitored for the appearance or reappearance of antibody reactivity and its correlation with tumor burden. By following the serum reactivity to tumor reactive new epitopes on the arrays of the phage display cDNA clones, the analysis of sera from women after their initial diagnosis and semiannually thereafter allows the determination of the markers in predicting tumor recurrence.

Some of the markers can be predictive of recurrence, and thus can be used to correlate specific ovarian tumor types (using the World Health Organization Histological Classification of Ovarian Tumors), also the tumor grade (where appropriate, since not all tumors all graded), and the surgical stage. This can be done by review of the pathological material (glass slides, patient records, and surgical pathology reports). Certain currently accepted biomarkers of research interest such as Her-2 neu and other can also be included in the new protein biochips in order to compare the sensitivity and specificity of the new and existing immunohistochemical technologies. Testing for Her-2 neu and other biological markers is done by the immunoperoxidase method using formalin fixed, paraffin embedded tumor tissues.

For the purpose of comparison to the ovarian cancer patients, one can analyze serum markers in women in good health who do not have ovarian or any other type of cancer. These control subjects should not have a family history of ovarian cancer or breast cancer. Because some serum markers such as CA125 levels are increased in endometriosis, uterine leiomyoma, pelvic inflammatory disease, early pregnancy, and benign cysts, control subjects should be free of these conditions as well.

The series of experiments provides direct evidence that biopanning a T7 coat protein fusion library can isolate epitopes for antibodies present in polyclonal sera. This also showed that the technology can be applied to direct microarray screening of large numbers of the selected phage against numerous patient and control sera. This approach provides a large number of biomarkers for early detection of ovarian cancer. The likelihood of success of this approach is increased by the fact that the mRNA for human Sirt2 is present in cells at very low abundance in human brain RNA thus indicating that clones can be isolated for rare RNA transcripts by this approach.

To further demonstrate the feasibility of these methods for differential detection of epitopes between test and control sera, four cycles of biopanning of a commercial Novagen breast tumor cDNA library were performed using a serum sample from a breast cancer patient and a control serum sample from a woman without cancer. 100 plaques were picked from each biopanning. Analysis of 100 plaques from the initial library and each successive biopanning were amplified in microtitre plates and the lysates cleared by centrifugation. One half microliter of each sample was spotted onto nitrocellulose filters and immunodetection performed using the breast cancer patient serum at 1:20,000 dilution (FIG. 5). Clear enrichment during biopanning is seen as was observed above with the anti-Sirt2 rabbit serum. As seen in FIG. 6 (using randomly picked plaques from BP 4) the filters contacted with the control serum on the left panels demonstrate weaker spot intensity as compared to a duplicate filter of the same clones on the right that was contacted with the patient serum. Approximately 65% of the phage selected for reactivity to the patient's serum were more than 3-fold more reactive with the patient's serum than with the control serum as determined by scanning densitometry.

Figure 6A:
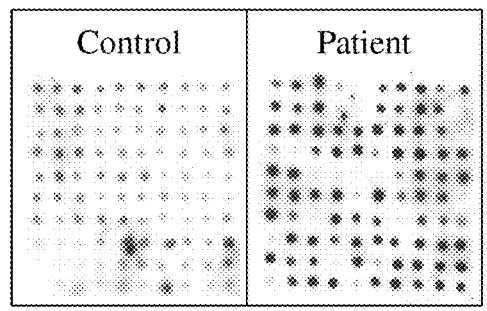
FIG. 6A is a photograph showing the comparison of serum reaction of control (left panel) and breast cancer patient (right panel) with phagotopes from BP4.
Figure 6B:
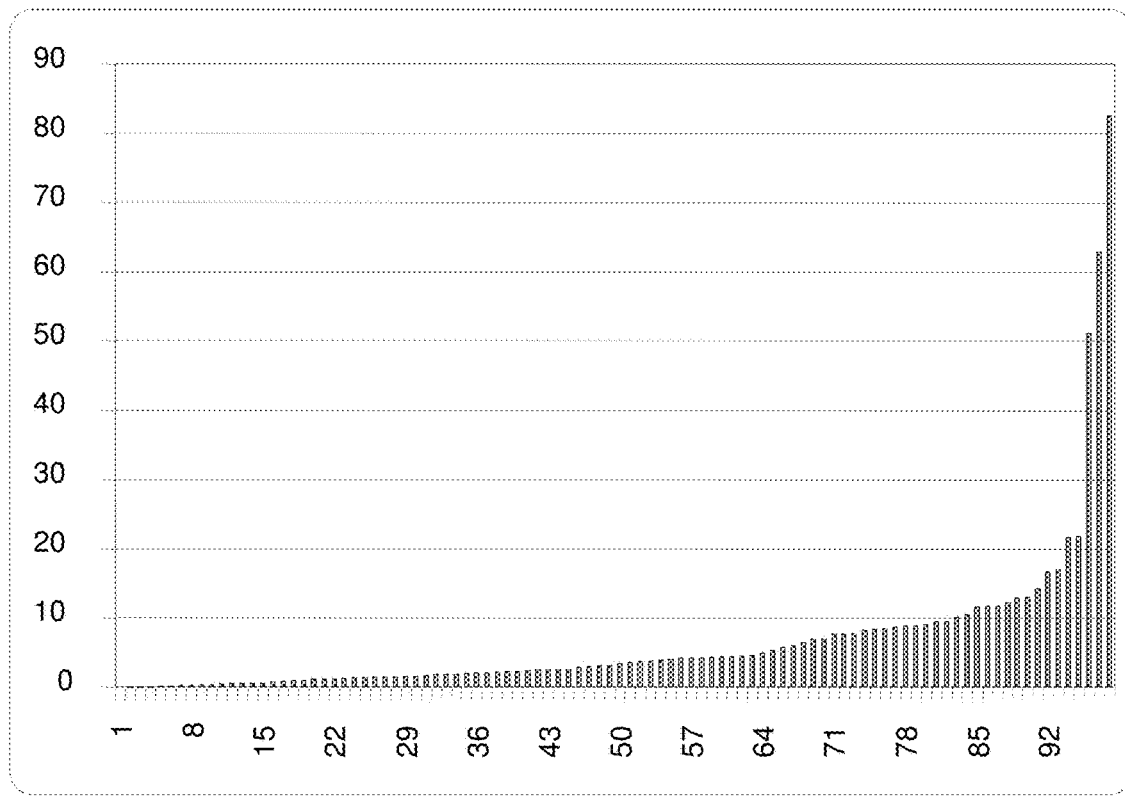
FIG. 6B is a graph of the BP4 filters which were scanned thereby showing the ratio of the pixel densities plotted in rank order.

FIG. 6A shows a comparison of serum reaction of control and breast cancer patient with phagotopes from BP4. FIG. 6B shows the BP4 filters that were scanned and the ratio of the pixel densities plotted in rank order.

This experiment demonstrates that one can differentially detect the epitopes for which the process is selecting, i.e. those bound to protein G-agarose beads in association with antibodies in the patient's serum and not the control serum. Someone skilled in the art can recognize that other solid supports for biopanning could replace the protein-G beads without substantively changing the biopanning process. These data also indicate that the selection is imperfect. Not all of the selected phagotopes are more reactive with the patient's serum that the control serum. Therefore, the identification of the most informative phagotopes requires analysis of the reactivity with multiple, individual patients' sera tested at various serum dilutions.

The immune reactivity to human tumors recognizes changes in the expression levels and mutation status of proteins in the tumor cells. These types of immunological reactivity are not observed in sera from control subjects. The antibody titer to tumor specific epitopes can be proportional to the tumor burden. The immune reactivity to human tumors can be used diagnostically and prognostically to predict the presence and behavior of human tumors such as tumor recurrence. Serum reactivity to single proteins tends to incompletely identify tumor bearing patients and therefore more robust methods are necessary to accurately identify tumor occurrence and recurrence. Whole genome-based proteomics such as the technology and data analysis methods embodied in the application can more comprehensively identify those proteins recognized by the host immune system.

Those of skill in the art are familiar with the construction of cDNA libraries and there are numerous published numerous papers on isolation of cDNAs from human cells in culture using this technology (Chiao, et al., 1992; shin et al., 1993; Buettner et al., 1993; Kim et al., 1996; Deyo et al., 1998; Bauer et al 1998). cDNA libraries can be prepared from ovarian cancer cell lines or from ovarian tumor tissue. Tumor tissue cDNA library can be prepared from a pool of mRNA preparations from each of the different stages of cancer to increase the diversity of clones in the library.

Methods mRNA from one ovarian cancer cell line, SKOV3 and ovarian tumor tissues, was copied into cDNA and libraries prepared. Tumor tissue in excess of that needed for pathological evaluation was obtained by informed consent from ovarian cancer patients.

Sera was obtained from 1) ovarian cancer patients at the time of diagnosis and at six month intervals during the follow up physician visits; 2) unaffected women for control sera.

T7 cDNA phage display expression libraries are prepared for biopanning experiments, to select phage bearing epitopes i.e. phagotopes that are recognized by sera from women with ovarian cancer but not recognized by normal sera from unaffected women. For the biopanning process, sera from women in the control group was pooled to avoid individual variations unrelated to the presence of ovarian cancer.

The selection of the most informative epitopes was done by comparing the immune reaction profile of each individual epitope with templates defined for each disease stage. Several distances and information entropy measures were used. Several predictors were constructed based on three selected machine learning techniques using only a part of the available data. Specificity, sensitivity, positive predicted value and negative predicted value were calculated for each such classifier. The validation of the predictors and the selection of the best predictor was done by cross-validation on cases that have not been used during the predictor construction.

For example, to develop an effective screening test for early detection of ovarian cancer, cDNA phage display libraries were used to isolate cDNAs coding for epitopes reacting with antibodies present in the sera of patients with ovarian cancer. Screening of T7 phage cDNA library with serum containing polyclonal antibodies against a known protein, leads to the enrichment of one particular phage clone (which displays the peptide sequence recognized by the antibody on its coat) after several rounds of biopanning. Serum containing polyclonal antibodies were raised against a C-terminal 12 amino acid peptide from the human homologue of the yeast SIRT2 protein and screened against a T7 phage human brain cDNA library. This library was used because the Sirt2 transcript is expressed in human brain. Preimmune rabbit serum was bound to protein-G agarose beads and 6×10$^{10}$ phage were added to the beads. The unbound phage were then bound to protein-G agarose beads to which the Sirt2p antibody was previously bound. The nonspecifically bound phage were washed away with PBS and the specifically bound phage eluted with 1% SDS. T7 phage is stable in this solution. These phage are diluted to reduce the SDS concentration and used to infect bacteria for amplification and another cycle of biopanning. Table 1 shows the value of the titer of the T7 phage library after each cycle of biopanning. This table reveals that the titer of the eluate after each round of biopanning increased with each successive cycle of antibody selection.

E. coli BLT5615 infected with amplified phage library after biopanning 1-4 were plated onto LB-Agar plates and plaque lifts were performed for all the individual plates. The plaque lift filter membranes were then hybridized with a P32-labeled Sirt2 cDNA probe. The percentage of positive plaques (number of positive plaques/total number of plaques×100) as determined for each plates labeled BP1-4, FIG. 1 increased with each successive cycle of biopanning. For BP1 and BP2 the percentage of positive plaques was negligible. For BP3 and BP4, percentage of positive plaques was 1.7% and 8.6% respectively.

In order to confirm that those positive plaques contain phage clones displaying the peptide sequence of Sirt2, 50 plaques were randomly picked up and PCR amplified each insert using T7 coat protein forward primer (5'TCTTCGC-CCAGAAGCTGCAG3' (SEQ ID NO: 1)) and T7 coat protein reverse primer (5'CCTCCTTTCAGCAAAAAAC-CCC3' (SEQ ID NO: 2)). Filter hybridization was performed using the same Sirt2 cDNA probe as above. As shown in FIG. 2, 7 out of 50 plaques (14%) hybridized to the Sirt2 probe, a frequency similar to that observed in the plaque lifts. Plaques positively reacting with the Sirt2 probe were picked and also hybridized on Southern Blots of PCR product.

Sirt2 positive plaques (upper two rows) and Sirt2-negative plaques (lower two rows) were chosen and 1 µl (pfu indicated at left) of each amplified phage clone was spotted onto the nitrocellulose membranes which were then treated as if they were standard immunoblots using the rabbit polyclonal Sirt2 antibody (right panel) or a mouse monoclonal antibody to the T7 capsid protein (left panel). The rabbit polyclonal antibody provides a sample for testing as if it were a patient's serum using the Sirt2 protein as a model. The Sirt2 antibody in the rabbit polyclonal serum reacted specifically with the Sirt2 phage. The identity of the phage was confirmed by direct PCR sequence analysis of the cDNA inserts in two independent Sirt2 positive phage. Thus phage expressing the epitope to which the antiserum was directed were isolated and distinguished from other phage.

Figure 4:
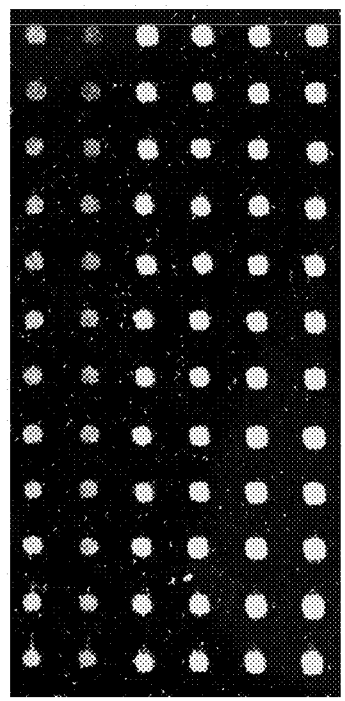
FIG. 4 is a photograph showing green and red labeled detection of serum antibodies indicative of the antibody reaction to the protein.
Figure 5A:
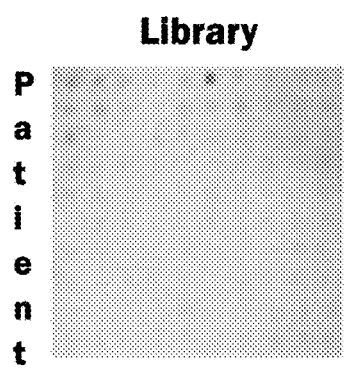
FIG. 5A is a photograph showing the ECL detection of a library of phagotopes prior to selection with a breast cancer patient's serum.
Figure 5B:
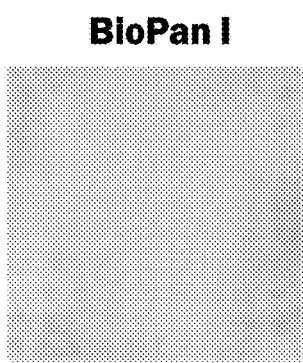
FIG. 5B is a photograph showing the ECL detection of phagotopes selected with a breast cancer patient's serum after a first round of biopanning.
Figure 5C:
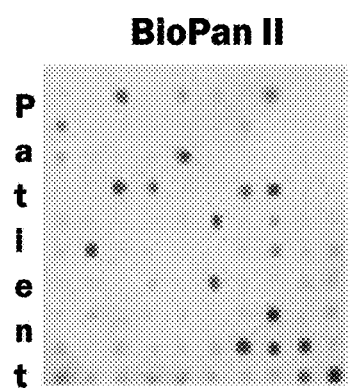
FIG. 5C is a photograph showing the ECL detection of phagotopes selected with a breast cancer patient's serum after a second round of biopanning.
Figure 5D:
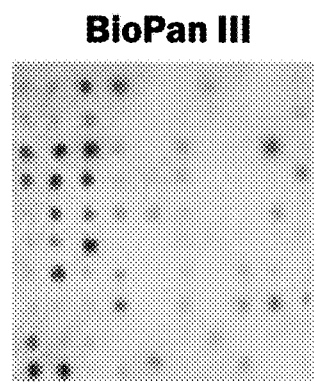
FIG. 5D is a photograph showing the ECL detection of phagotopes selected with a breast cancer patient's serum after a third round of biopanning.
Figure 5E:
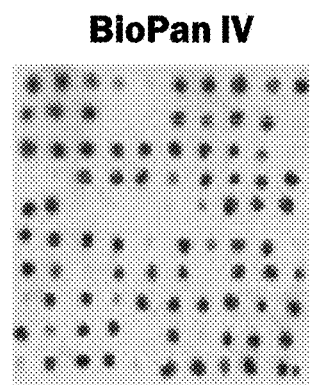
FIG. 5E is a photograph showing the ECL detection of phagotopes selected with a breast cancer patient's serum after a fourth round of biopanning.

Microarrays were spotted using Sirt2 T7 clones and other T7 clones that do not express Sirt2. These arrays were used to analyze a mixture of Cy5-labeled (red) rabbit Sirt2-immunized serum and Cy3-labeled (green) T7 coat protein antibody (Novagen) added to the pre-immune rabbit serum. The scanned two-color image clearly shows specific detection of the Sirt2-expressing T7 clones by the anti-Sirt2 antibody (FIG. 4). The Sirt2 expressing clones appear yellow because they bind both the red-labeled antibody to a rabbit immunoglobulin G protein and the green-labeled anti-T7 capsid 10B antibody. The non-Sirt2-expressing T7 clone are green as they only bind to the Cy3-labeled anti-T7 antibody. This development of detection of protein epitopes in bacteriophage bodes well for the applicability of phage arrays to the detection of low abundance species and weak binders. The spots in the image are approximately 100 microns in diameter.

The following is an example of the preparation of a tumor reactive cDNA expression library: Ovarian cancer cells were grown in monolayer culture. Cells or fresh tumors from patients were lysed by the addition of 3 ml of TRIZOL® reagent and the homogenized sample was incubated for five minutes at room temperature. Chloroform, 0.6 ml, was added and the mixture was shaken vigorously for 15 seconds and then incubated at room temperature for 2-3 minutes. The extract was centrifuged at 12,000×g for 30 minutes at 4° C. Following centrifugation, the mixture was separated a lower red, phenolchloroform phase, an interphase, and a colorless aqueous phase. Aqueous phase was transferred to a fresh tube and total RNA was precipitated by adding 1.5 ml of isopropanol. The mixture was incubated at room temperature for ten minutes and was centrifuged at 12,000 g for 30 minutes at 4° C. The supernatant was discarded and the RNA pellets were washed by adding 3 ml of 75% ethanol. The samples were centrifuged at 14,000×g for 15 minutes. The RNA pellet was air-dried and was dissolved in RNase-free water.

mRNA was isolated from total RNA following Oligotex® mRNA spin column protocol. Total RNA, 0.5 mg, was dissolved in 500 µl of RNase-free water and 500 µl of binding buffer and 30 µl of Oligotex® suspension was added. The contents were mixed thoroughly, incubated for three minutes at 70° C. in a water-bath, and then at room temperature for 10 minutes. The Oligotex®:mRNA complex was pelleted by centrifugation for 2 minutes at 14,000×g and the supernatant was discarded. The Oligotex®:mRNA pellet was resuspended in 400 µl washing buffer by vortexing and pipetted onto a spin column placed in a 1.5 ml microcentrifuge tube. The samples were centrifuged at maximum speed for one minute and the flow-through discarded. The spin column was transferred to a new RNase-free 1.5 ml microcentrifuge tube. Elution buffer at 70° C. was then added to the column. Poly (A)+ mRNA was eluted, quantitated by UV spectroscopy and the process of poly A selection repeated one more time to further reduce contamination with ribosomal RNA. Twice poly A selected mRNA was stored at −70° C. for use in library preparation.

Novagen's OrientExpress cDNA Synthesis and Cloning systems were used for the construction of ovarian cancer cDNA T7 phage libraries. For first-strand cDNA synthesis, OrientExpress Random Primer System was used to ensure representation of both N-terminal and C-terminal amino acid sequences.

Ten ml of LB/carbenicillin medium were inoculated with a single colony of BLT5615 from a freshly streaked plate. The mixture was shaken at 37° C. overnight. Ten ml of the overnight culture was added to 90 ml of LB/carbenicillin medium and was allowed to grow until OD600 reaches 0.4-0.5. IPTG (1 mM), M9 salts (1×) and glucose (0.4%) can be added and the cells were allowed to grow for 20 minutes. An appropriate volume of culture was infected with phage library at MOI of 0.001-0.01 (100-1000 cells for each pfu). The infected bacteria were incubated with shaking at 37° C. for one to two hours until lysis is observed. Glycerol (0.02%), PMSF (0.02M) was added to the cell lysate to block proteolysis of the capsid fusion proteins. The phage were centrifuged at 8000×g for 10 minutes. The supernatant was collected and was stored at 4° C. The lysate was titered by plaque assay under standard conditions. The libraries are stored after purification by polyethylene-glycol precipitation and ultracentrifugation through a stepwise CsCl gradient.

Using this approach, the first library was constructed. Using twice poly A selected mRNA from SKOV3 cells a T7 select cDNA library was prepared containing $1.8 \times 10^7$ initial plaques after packaging. This representation is comparable to the clonal representation of the commercial libraries purchased. This library has been amplified and stored in aliquots in two −70° C. freezers.

Patients' sera were obtained from multiple institutions for this project. Three outside institutions have agreed to provide ovarian cancer patient sera and the associated medical record information in anonymized form. Dr. Steven Witkin from the Weill Medical College of Cornell University provided 46 patient serum samples and 27 controls. Dr. Karen Lu from the M. D. Anderson Cancer Center can provide 60 serum samples. Dr. David Fishman from the Northwestern University Comprehensive Cancer Center provided 35 serum samples of patients who have been followed from time of diagnosis.

The ideal sera for the clone biopanning studies come from women just before or after surgery and prior to chemotherapy. Follow up sera were obtained after chemotherapy and are important to determine whether the penultimate protein array technology can detect tumor recurrence.

In addition, a supply of tumor tissue was required for the preparation of mRNA for cDNA library production and gene expression studies using samples from patients. This tissue was harvested within 20 minutes of surgical excision from the patients. This requires the coordinated effort of the gynecologic surgeons and pathologists. Patients at the time of their original surgery or prior to chemotherapy were accrued for serum collection. If tumor tissue is available in excess of that needed for routine pathologic evaluation, that tissue was used for RNA preparation for mRNA expression studies associated with this study. Sections from tissue blocks were also acquired for the purpose of expression studies of proteins in the patients' tumors. Patients at follow up visits to the OB/GYN clinics were also subjects for serum acquisition. These latter patients can be at a time of recurrence or not. This allows the observation of the reappearance of serum markers in the event of tumor recurrence. Serum was obtained from eligible patient-subjects during scheduled clinic visits. The initial serum acquisition occurs prior to surgery, if possible, or if post surgery, prior to chemotherapy. A single red top 7 cc vial of blood was obtained during normal phlebotomy and the serum isolated after clotting. Serum continues to be collected from these patients during follow up visits for up to five years or until ovarian cancer recurrence. Tumor tissue in excess of that required for pathological analyses were acquired at the time of surgery for the preparation of tumor RNA needed for antibody screening. Unaffected volunteers (controls) were be recruited through community outreach activities.

The Biopanning Process

Steps in the Biopanning Process:

Affinity selection with sera from normal individuals: Twenty-five µl of Protein G Plus-agarose beads were taken in 0.6 ml eppendorf tube and were washed two times with 1×PBS. Washed beads were blocked with 1% BSA at 4° C. for one hour. The beads were then incubated at 4° C. for one hour with 250 µl of pooled sera at a dilution 1:20 from 20 control women. After three hours of incubation, beads were washed three times with 1×PBS and then incubated with phage library (1010 phage particles). After incubation, the mixture was centrifuged at 3000 rpm for two minutes to remove phage nonspecifically bound to the beads and the supernatant (phage library) was collected for immunoscreening.

Fresh protein G Plus agarose beads were placed into a 0.6 ml eppendorf tube and were washed two times with 1×PBS. Washed beads were blocked with 1% BSA at 4° C. for one hour. The beads were then incubated at 4° C. for three hours with 250 μl of sera at a dilution 1:20 from patients with ovarian cancer. After this incubation, the beads were washed three times with 1×PBS and were incubated with phage library supernatant from above (termed as Biopanning 1 (BP1)) collected for immunoscreening at 4° C. for overnight (shorter times of incubation have not proven successful using model antibody systems). After incubation, the mixture was centrifuged at 3000 rpm for two minutes and supernatant was discarded. Beads were washed three times with 1×PBS. To elute the bound phage 1% SDS was added to the washed beads and the mixture was incubated at room temperature for ten minutes. The bound phage were removed from the beads by centrifugation at 8000 rpm for seven minutes. Eluted phage were transferred to liquid culture for amplification (100 μl elution to 20 ml culture). Four rounds of affinity selection and immunoscreening was carried out with amplified phage obtained after each biopanning. The number of biopanning cycles generally determines the extent of the enrichment for phage that binds to the sera of patient with ovarian cancer. This process allows for one cycle of biopanning to be performed in a single day.

In the past serum markers have been identified using SEREX technology that detected only a few gene products at a time. The biopanning approach developed can isolate large numbers of target epitopes. These epitopes are displayed on the surface of bacteriophage as in-frame fusion proteins with the T7 phage capsid protein and can be analyzed in large numbers by arraying the selected phage on filter paper or glass slides (protein microarrays). The method isolates large numbers of phage that react with antibodies from pooled patient sera but not with normal sera.

The titer of the T7 phage library obtained after amplification of each Biopanning (BP1-4) eluate was determined by plaque assay. E. Coli BLT 5616 were infected with the primary unamplified phage from biopanning (BP3-4) and plagued to limiting dilution onto LB/carbenicillin plates (150 mm×15 mm petri dish) so that sufficient numbers of single plaques can be isolated to obtain 12×96 well plates for arraying. The plates were incubated at 37° C. for 3-4 hours until the plaques are visible and then picked for amplification in the 12×96 well plates. After two hours, lysis of the host bacteria occurs in the wells of the 96-well plates. One well of each plate was uninfected as a control. Five 96 well plates of 200 μl phage lysates were clarified by centrifugation of the phage. The phage were cleared by whole plate centrifugation before robotic spotting in triplicate onto filters or glass slides. Excess reactivity in the surface area of the slide not spotted with phage was blocked using BSA, 1% solution in PBS for 60 minutes, followed by washing in water three times. After blocking the arrays on glass slides or filters were blocked with 1% BSA in PBS and incubated with a various dilutions of each of the individual controls and patient's sera spotted in triplicate or more for each dilution of serum. Serum antibodies binding to recombinant proteins expressed in the surface of the T7 bacteriophage were detected by incubation a Cy5-labeled anti-human IgG goat antiserum and visualized and quantified using GenePix® and ImaGene® software in a 4000B array scanner (AXON Instrument). As positive control for each spot a Cy3-labeled antibody for the T7 capsid protein was used. The ratio of the fluorescence intensity for the human antibodies were normalized to the T7 capsid antibody reactivity. Initial testing of phage solutions were performed on a spotting robot.

The optimal number of subtractive biopannings for each serum sample is determined by picking individual phage clones, and then testing the antibody reactivity for the serum used in the biopanning against those clones, (referred to as its self reaction). Plates of 96 clones were picked for each patient's biopanning at cycles 3, 4, and 5 which were then tested for the binding of the phage clones to antibodies in that serum, in a "self-reaction". Antibody binding is was detected by spotting the filters with a 96 pin head on a Biomek robot or detected on glass slides of microarrays of phagotopes. The filters were then treated like a western blot by blocking with 1% dry milk powder in PBS and adding diluted serum. After rocking for 2 hours the filter is washed and reacted with an anti-human IgG antibody link to horseradish peroxidase (HRP) and detected by ECL® (Enhanced Chemical Luminescence). From the clones isolated from one patient, (designated patient #1) a total of 480 plaques were picked from that serum at biopanning 4. Biopanning four was chosen because about 35% of the clones bound antibodies from that patient's serum. Serum reactivity of the phagotopes with the patient's serum was detected at a 1:10,000 dilution indicating a very high titer of the IgG molecules that reacted with the epitopes (self reaction with 480 clones). Reactivity to these clones is detected at similar dilutions using the clones arrayed on glass slides as an alternative solid support.

When the serum reactivity with other patients (non-self reactions) was analyzed using replicates of the robotically spotted filters, reactivity was found in some patients again at a dilution of 1:10,000 (FIG. 1B and Table 1). Other patients required a 1:3000 dilution of the serum for detection of the reactive clones. Patient #23 reacted quite strongly while patient #16 reacted more weakly (FIG. 1B and Table 1). Positivity was scored only when 3 out of 3 of the triplicates have similar intensity. In the subtractive biopanning scheme plaques binding to normal serum proteins nonspecifically were removed by loading protein-G beads with a pool of control sera. One can detect positive reaction on filters spotted with phage epitope clones on filter 13 of 21 other patients using 153 reactive clones of the original 480 clones. Filters were tested with control sera not used in the initial subtractive step, and 5 of the 8 controls showed no reaction to the 480 phage on the filter arrays while a non-specific and even pattern of reactivity to all clones (without the typical triplicate pattern) was observed using 3 of the 8 different control sera (Table 1).

TABLE 1

| Patient's sera | # of phage Patient #1 BP4 clones reacted with each patient's sera at indicated dilution | |
|---|---|---|
| | 1:10000 | 1:3000 |
| PATIENT 1 | 153 (self reaction) | |
| PATIENT 2 | None | 142 |
| PATIENT 16 | NS | |
| PATIENT 20 | 70 | |
| PATIENT 23 | 137 | |
| PATIENT 29 | NS | |
| PATIENT 30 | NS | |
| PATIENT 33 | NS | |
| PATIENT 35 | NS | 72 |
| PATIENT 37 | None | 120 |

TABLE 1-continued

| Patient's sera | # of phage Patient #1 BP4 clones reacted with each patient's sera at indicated dilution | |
|---|---|---|
| | 1:10000 | 1:3000 |
| PATIENT 01-056 | NS | |
| PATIENT 01-060 | None | 61 |
| PATIENT 00-007 | NS | |
| PATIENT 01-108 | NS | |
| PATIENT 01-045 | NS | |
| PATIENT 42501 | 40 | |
| PATIENT 400162 | 120 | |
| PATIENT 40036 | Mostly NS | |
| PATIENT 42780 | 85 | |
| PATIENT B755 | NS | |
| PATIENT 40015 | NS | |
| PATIENT 075 | 119 | |
| PATIENT 015 | 155 | |
| PATIENT 035 | NS | |
| PATIENT 007 | 114 | |
| PATIENT 005 | 133 | |
| PATIENT 083 | 150 | |
| PATIENT 054 | 92 | |
| PATIENT 064 | NS | |
| PATIENT 065 | NS | |

NS indicates Non-Specific reaction only.
None indicates No reaction detected.

The filter arrays were incubated with a patient's serum (pretreated with 150 μg of bacterial extract to block non-specific reactions with E. coli proteins for 2 hours at 4° C.) at various dilutions for 1 hour at room temperature. Bacterial extracts are used because some patients have antibodies to bacterial protein, and therefore pre-treatment with extracts of E. coli proteins blocks the nonspecific antibodies to bacterial protein present in the patient's serum. The membranes were then washed three times with TBST (0.24% Tris, 0.8% NaCl, and 1% Tween-20) for 15 minutes each. After washing was completed, the membranes were incubated with secondary antibody, goat-anti human IgG-HRP conjugated (Pierce) at 1:5000 dilution for 1 hour at room temperature. The membranes were again washed three times with TBST 15 minutes each. Finally, membranes are developed with Supersignal West Pico chemiluminescent substrate (Pierce) and the images were captured on a Kodak film.

Phagotope Microarrays on Glass Biochips

Preparation of arrays Phage lysates are prepared as above. Phage lysates (usually five 96 well plates) from BP4 are transferred to 384-well plates, each lysate spotted in quadruplicate, using 10 μl per well. A robotic microarrayer is used to spot the phage in an ordered array onto FAST™ slides (Schleicher & Schuell) at a 350 μm spacing using 4 steel Micro-Spotting Pins. The arrays are dried overnight at room temperature.

Preparation of Fluorescent Antibody Probes

T7 monoclonal antibody and goat anti-human IgG were purchased from Novagen and Pierce respectively. Monofunctional NHS-ester activated Cy3 and Cy5 dyes were purchased from Amersham (PA33001 and PA35001). The antibodies were labeled in pH 8.0 sodium carbonate buffer as per the instructions from the manufacturer. Briefly, 100 μl of the protein solution with 5 μl of coupling buffer were transferred to the vial of reactive dye and mixed thoroughly. The reaction was incubated in the dark at room temperature for 30 minutes with additional mixing approximately every 10 minutes. The reaction solutions are then loaded into the gel filtration columns to separate the labeled protein from non-conjugated dye. T7 antibody was labeled by Cy3 and anti-human IgG was labeled by Cy5, respectively. The labeled protein was eluted and stored at 4° C. for future use. Reversing the dye-labeling scheme of the antibodies does not affect the results. The advantage of this strategy is that the same reagents were used on every phagotope array and the only variable is the patient's serum and therefore variations in labeling efficiency are not a factor.

Detection of Fluorescent Antibody Probes.

The arrays were rinsed briefly in a 1% BSA/PBS to remove unbound phage, transferred immediately to 1% BSA/PBS as a blocking solution, and then incubated in this blocking solution for 1 hour at room temperature. The excess BSA was rinsed off from the slides using PBS. Without allowing the array to dry, 2 ml of PBS containing human serum at a dilution of 1:10,000 was applied to the surface in a screw-top slide hybridization tube. Multiple dilutions were tested per patient to obtain optimal detection. The arrays were incubated at room temperature for 1 hour with mixing. The arrays were rinsed in PBS to remove the serum, and then washed gently three times in PBS/0.1% Tween-20 solution 10 minutes each. All washes were performed at room temperature. After removing Tween-20 using PBS, the arrays were incubated with 2 ml of PBS containing Cy3-labeled-T7 anti-capsid antibody at a dilution of 1:50,000 and anti-human IgG labeled with Cy5 at a dilution of 1:10,000 as probes for 1 hour in the dark. The incubation solution was mixed every 20 minutes. Three washes were performed using PBS/0.1% Tween-20 solution with 10 minutes each. The array was then rinsed with filtered ddH2O twice and dried using a stream of compressed air.

Analysis Phagotope Microarrays.

The arrays were scanned in an Axon Laboratories scanner (Axon Laboratories, Palo Alto, Calif.) using 532 nm and 635 nm lasers. The ratio of anti-T7 capsid and anti-human IgG was determined by comparing the fluorescence intensities in the Cy3- and Cy5-specific channels at each spot. The location of each spot on the array was outlined using the image processing software. The background, calculated as the median of pixel intensities from the local area around each spot, was subtracted from the average pixel intensity within each spot. This normalized reactivity was entered into a database for analysis.

The information in this database can be analyzed in order to: i) select the most informative epitopes and ii) develop into a diagnostic test for tumor occurrence in high-risk women or tumor recurrence in women previously treated for ovarian cancer. The gene products thusly identified can provide insight into molecular changes recognized by the host immune system.

Figure 6C:
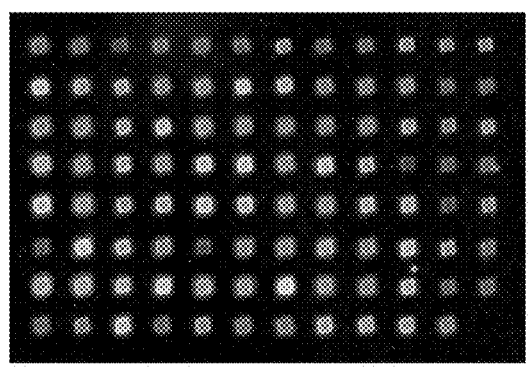
FIG. 6C is a scan of a microarray demonstrating the binding a Cy5-labeled antihuman IgG to human IgG from patient #1's serum and the control Cy3-labeled antibody to phage T7 capsid protein to phage clones microarrayed on glass.

The human antibodies reacting at each spot were detected with Cy5-labeled human serum antibodies. The normalization of the fluorescence at each spot was compared to a reaction with a Cy3-labeled antibody to the T7 phage capsid protein. Only a small fraction of the phage capsid protein is substituted with the in-frame fusion of the human cDNAs of the library. The majority of the capsid protein is produced by the host bacterium from an episomic T7-capsid gene. Therefore the majority of the each capsid protein is wild-type and can react with the anti-capsid antibody. An example of a Cy5 labeled anti-human IgG reacting with IgG in patients #1 serum bound to clones biopanned using patient #1 serum is shown in FIG. 6C.

The data analysis proceeds according to the following steps:

4. Pre-processing and normalization.
5. Identifying the most informative markers
6. Building a predictor for molecular diagnosis of ovarian cancer and validating the results.

The pre-processing and normalization step was used for arrays using two channels such as Cy5 for the human IgG and Cy3 for the T7 control. The spots were segmented and the mean intensity was calculated for each spot. A mean intensity value was calculated for the background, as well. A background corrected value was calculated by subtracting the background from the signal. If necessary, non-linear dye effects can be eliminated by performing an exponential normalization (Houts, 2000) and/or a piece-wise linear normalization of the data obtained in the first round. The exponential normalization can be done by calculating the log ratio of all spots (excluding control spots or spots flagged for bad quality) and fitting an exponential decay to the log (Cy3/Cy5) vs. log (Cy5) curve. The curve fitted is of the form:

$$y=a+b*\exp(-cx)$$

where a, b and c are the parameters to be calculated during curve fitting. Once the curve is fitted, the values are normalized by subtracting the fitted log ratio from the observed log ratio.

This normalization has been shown to obtain good results for cDNA microarrays but it relies on the hypothesis that the dye effect can be described by an exponential curve. The piece-wise linear normalization can be done by dividing the range of measured expression values into small intervals, calculating a curve of average expression values for each such interval and correcting that curve using piece-wise linear functions.

The values coming from each channel were subsequently divided by the mean of the intensities over the whole array. Subsequently, the ratio between the IgG and the T7 channels was calculated. The values coming from replicate spots (spots printed in quadruplicates) were combined by calculating mean and standard deviation. Outliers (outside+/−two standard deviations) were flagged for manual inspection). Single channel arrays were pre-processed in a similar way but without taking the ratios. This preprocessing sequence was shown to provide good results for all preliminary data analyzed.

The step of selecting the most informative markers was used to identify the most informative phages out of the large set of phages started with. The better the selection, the better is the expected accuracy of the diagnosis tool.

A first test (Procedure 1 disclosed above) is necessary to determine whether a specific epitope is suitable for inclusion in the final set to be spotted.

Procedure 2 is used to maximize the information content of the set of epitopes while trying to minimize the number of epitopes used using the following procedure.

The arrays used in this example, (using two channels such as Cy5 for the human IgG and Cy3 for the T7 control) were processed as follows. The spots were segmented and the mean intensity was calculated for each spot. A mean intensity value was calculated for the background, as well. A background corrected value was calculated by subtracting the background from the signal. The values coming from each channel were normalized by dividing by their mean. Subsequently, the ratio between the IgG and the T7 channels was calculated and a logarithmic function was applied. The values coming from replicate spots (spots printed in quadruplicates) were combined by calculating mean and standard deviation. Outliers (outside+/−two standard deviations) were flagged for manual inspection.

The histogram of the average log ratio was calculated. If the histogram is unimodal (e.g. subject 19218 in FIG. 13), there is no specific response. If the histogram is clearly bimodal (e.g. subject 19223 in FIG. 13), there is a specific response. All 25 subjects analyzed so far fell in one of these two categories or had no response at all. The preliminary data analyzed so far showed a very good separation of the distributions for the patients.

Once the chosen clones were spotted on the final version of the array, a number of sera coming from both patients and controls were tested. These sera came from subjects not used in any of the phases that lead to the fabrication of the array (i.e. not involved in clone selection, not used as controls, etc.). Each test was evaluated using Procedure 3 above.

Building the Predictor

A number of machine learning and statistical techniques have been considered for this task. The following algorithms were tested: CN2 (Clark, 1989), C4.5 (Quinlan, 1993; Breiman et al., 1984), CLEF 1998), 4.5 using classification rules (Quinlan, 1993), incremental decision tree induction (ITI) (Utgoff, 1989; quantization (LVQ) (Kohonen, 1988; Kohonen, 1995), induction of oblique trees (OC1) (Health and Salzberg, 1993; Murthy, 1993), Nevada backpropagation (NEVP); Rumelhart et al., 1987), Constraint Based Decomposition (Draghici, 2001), k-nearest neighbors with k=5 (K5), Q* and RBF's (Musavi et al., 1992; Poggio and Girosi, 1990).

The generalization abilities and the reliability of these techniques have been tested extensively on various problems and data sets from the UCI machine learning repository (Blake et al., 1998). This repository contains a large collection of mostly real world data from a large variety of domains (including biological and medical), and constitutes a benchmark on which various algorithms and techniques can be tested.

Table 2 presents the accuracies obtained by these techniques on the selected problems. Table 3 presents the standard deviation of each such algorithm on the same problems. Based on these tests applicant decided to start the tests by using constraint based decomposition (CBD), radial basis functions (RBFs) and decision trees (C4.5) as the three main candidates. The CBD was selected because it offers a high reliability across multiple trials (lowest standard deviation) and a good accuracy (second best). Furthermore, the CBD algorithm can also produce a logical expression describing the classifier produced. Such expressions allow one to understand the relative importance of various epitopes. The decision trees have been selected mainly because they can be mapped into logical expressions that can be compared to the one produced by the CBD. RBFs construct clusters by placing high dimensionality Gaussian functions on groups of given data points (one data point can be a set of expression values corresponding to a protein chip). This technique calculates automatically the number of clusters, their orientation (the eigenvectors of the correlation matrix of the expression vectors) and their widths. RBFs were expected to perform much better than k-means clustering and the other techniques already used in this context because RBFs avoid guessing (e.g. k in k-means clustering). Furthermore, extracting a model from the trained RBF architecture is straightforward. Again, this model can be compared with the models provided by the CBD and C4.5.

TABLE 2

| DATASET | C4.5 | C4.5r | ITI | LMDT | CN2 | LVQ | OC1 | NEVP | K5 | Q* | RBF | CBD |
|---|---|---|---|---|---|---|---|---|---|---|---|---|
| GLASS | 70.23 | 67.96 | 67.49 | 60.59 | 70.23 | 60.69 | 57.72 | 44.08 | 69.09 | 74.78 | 69.54 | 68.37 |
| IONOSPHERE | 91.56 | 91.82 | 93.65 | 86.89 | 90.98 | 88.58 | 88.29 | 83.8 | 85.91 | 89.7 | 87.6 | 88.17 |
| LUNG CANCER | 40.17 | 39.84 | 38.47 | 55.49 | 37.17 | 55.71 | 54.28 | 33.12 | 68.54 | 60 | 65.7 | 60 |
| WINE | 91.09 | 91.9 | 91.09 | 95.4 | 91.09 | 68.9 | 87.31 | 95.41 | 69.49 | 74.35 | 67.87 | 94.44 |
| PIMA INDIANS | 71.02 | 71.55 | 73.16 | 73.51 | 72.19 | 71.28 | 50 | 68.52 | 71.37 | 68.5 | 70.57 | 68.72 |
| BUPA | 65.14 | 65.39 | 63 | 71.54 | 64.31 | 64.13 | 65.57 | 77.72 | 66.43 | 61.43 | 59.85 | 62.32 |
| TICTACTOE | 83.52 | 99.17 | 92.89 | 89.61 | 98.18 | 65.61 | 78.56 | 96.91 | 84.32 | 65.7 | 72.19 | 75.1 |
| BALANCE | 64.61 | 75.01 | 76.76 | 93.27 | 80.89 | 89.54 | 92.5 | 91.04 | 83.96 | 69.21 | 89.06 | 90.08 |
| IRIS | 91.6 | 91.58 | 91.25 | 95.45 | 91.92 | 92.55 | 93.89 | 90.34 | 91.94 | 92.1 | 85.64 | 96 |
| ZOO | 90.27 | 90 | 90.93 | 96.61 | 91.91 | 91.42 | 66.68 | 92.86 | 67.64 | 74.94 | X | 94.29 |
| AVG | 75.92 | 78.42 | 77.87 | 81.84 | 78.89 | 74.84 | 73.48 | 77.38 | 75.87 | 73.07 | 74.22 | 79.75 |

Table 2 shows a comparison of several classification techniques. The table presents the accuracies obtained in various problems from the UCI machine learning respiratory. Each accuracy is the average of 10 trials.

TABLE 3

| DATASET | C4.5 | C4.5r | ITI | LMDT | CN2 | LVQ | OC1 | NEVP | K5 | Q* | RBF | CBD |
|---|---|---|---|---|---|---|---|---|---|---|---|---|
| GLASS | 7.23 | 6.28 | 7.96 | 11.25 | 8.34 | 10.24 | 9.1 | 6.29 | 7.81 | 6.98 | 7.35 | 2.08 |
| IONOSPHERE | 2.82 | 2.58 | 2.71 | 3.51 | 3.29 | 3.36 | 2.21 | 3.81 | 4.14 | 4.7 | 6.45 | 2.56 |
| LUNGCANCER | 14.2 | 18.92 | 13.52 | 32.2 | 13.79 | 12.48 | 17.53 | 14.83 | 11.96 | 18.6 | 16.27 | 12.6 |
| WINE | 5.84 | 5.09 | 6.24 | 5.22 | 6.11 | 4.84 | 8.45 | 2.22 | 6.86 | 6.64 | 5.16 | 1.96 |
| PIMA INDIANS | 2.1 | 3.92 | 2.16 | 4.3 | 2.36 | 4.46 | 22.4 | 3.19 | 3.67 | 8.19 | 2.39 | 3.02 |
| BUPA | 5.74 | 6.05 | 4.23 | 6.63 | 7.99 | 7.14 | 8.45 | 11.97 | 7.22 | 4.25 | 7.92 | 2.05 |
| TICTACTOE | 2.44 | 1.05 | 2.38 | 8.79 | 0.95 | 2.99 | 5.88 | 1.32 | 2.7 | 3.16 | 3.35 | 9.43 |
| BALANCE | 3.35 | 3.98 | 3 | 2.95 | 3.38 | 4.39 | 2.07 | 7.12 | 7.53 | 19.09 | 2.38 | 3.03 |
| IRIS | 5.09 | 5.09 | 4.81 | 4.71 | 5.95 | 3.73 | 4.68 | 7.45 | 4.1 | 5.28 | 27.37 | 4.35 |
| ZOO | 7.59 | 7.24 | 6.11 | 1.56 | 5.95 | 6.26 | 30.36 | 4.62 | 20.03 | 23.8 | X | 2.13 |
| AVG | 5.64 | 6.02 | 5.312 | 8.112 | 5.811 | 5.989 | 11.11 | 6.282 | 7.602 | 10.07 | 8.738 | 4.321 |

Table 3 shows a comparison of several classification techniques. The table presents the standard deviations obtained in a set of 10 trials on various problems from the UCI machine learning repository.

Furthermore, one can also implement and try the predictors used in (Golub et al., 1999) and (Alizadeh et al., 2000) which were shown to work well in cancer diagnosis problems similar to applicants. The selection of the final predictor was based on the validation results obtained in the last step of the data analysis.

Validating the Predictor

In order to validate the predictors, the classical method of cross-validation was used (Breiman et al., 1984). The idea behind cross-validation is that the predictor is tested, not based on its abilities to simply memorize the data presented during the training, but based on its abilities to generalize the knowledge acquired during the training to previously unseen cases. For this reason, the predictor must be checked on data that belongs to the same distribution but was not used during the training. This can be implemented in several ways depending on the number of examples available. If only few examples (such as stage I patients, 40 total) are available, reducing the size of the training set even further by setting patterns aside for generalization testing could jeopardize the training. In such cases, the algorithm is used with only n−1 of the n available patterns and tested on the remaining one. This is done n times, each time leaving out a different pattern. An average is calculated over the n experiments. This is known as the leave-one-out method. If more patterns are available, the pattern set can be divided into n different subsets of patterns. Then one subset can be left out of the training and used to test the generalization. Again, the value reported is an average of the n trials performed leaving out each of the n subsets. This method is known as n-fold cross validation. Finally, if the pattern set is very large (patients with stage III or IV cancer), it can simply be divided into a training set and a validation set. In this case, the generalization abilities of the technique can be characterized by its performance on the validation set.

For each predictor the specificity, sensitivity, positive predictive value and negative predicted value can be calculated using cross-validation data (i.e. values that have not been used in constructing the predictor itself). This ensures that the quality measures obtained in this study reflect the real world performance to be expected in the field.

Once informative phagotypes are found the gene encoding the phagotype was identified.

1. Identification Genes Encoding the Phagotopes.

Phage clones specifically reacting with patient sera, as determined by microarray immunoscreening, can be amplified by PCR using T7 capsid forward and reverse primers. PCR fragments were purified and 100 ng of fragment was analyzed to determine the nucleotide sequence of the cDNA insets. Sequence alignments are performed using BLAST software and GenBank databases. The sequence information can be used in several ways. Initially, the DNA sequence information provides a database of the frequency of reactivity to a particular epitope.

Diagnostic Markers Derived from the Combined Processes Including Biopanning, Assay of Patients' Sera with Epitopes on Filters and Biochips, and Identifying the Best Predictor/Marker of Disease.

DNA Sequence Analysis of Phagotope Clones

PCR amplified DNA sequences from 96 phagotopes that reacted with patient #1 and at least one other OVCA serum are shown in the table below. Some clones were isolated multiple times and one clone was represented 23 times out of the 96 clones analyzed. This was the human homologue of the oncogenic gene Bmi-1, (GenBank NM005180.1) that inhibits the expression of p14ARF and cooperates with c-myc (Lindstrom et al., 2001. The insert sizes for the Bmi-1 phage clones varied in coding capacity depending on the isolate between 67-94 amino acids in length. Eight other clones were represented twice and one was isolated three times. One of these genes isolated twice was the heat shock protein 70, which has been shown to be overexpressed and antigenic in ovarian cancer tumors and was found to have been identified in the SEREX database 5 times. The size of the open reading frame in the HSP70 clone is 109 amino acids in length. Another clone isolated two times of the 96 sequenced is a known cancer antigen called RCAS1 which is overexpressed in 58% of ovarian cancer and many others as well (Sonoda et al., 1996) RCAS1 is an estrogen regulated gene which can inhibit the immune system from killing a tumor (Nakashima et al., 1999). This information clearly indicates that this technology is capable of detecting cancer antigens that can be used for diagnostic and immunotherapy purposes. If overbiopanning occurred, only a few different clones would be found. However, as the remaining clones were isolated once each, it is therefore convincing that 4-5 biopannings is appropriate. In this first group of 480 clones there were isolated clones that reacted with approximately 60% of the OVCA patients using the macroarray filters and more efficiently using the microarray technology. Additional epitope clones provide additional sensitivity for this assay.

| Clone Name | GenBank ID |
|---|---|
| Clone found 23 times Bmi-1 (oncogene) | NM_005180.1 |
| Clones found 2-3 times | |
| HSP-70 | XM_050984.1 |
| RCAS1 (EBAG9) | BC005249.1 |
| A-kinase anchoring protein 220 | XM_038666.1 |
| G-protein gamma-12 subunit | NM_018841.1 |
| Neuronal apoptosis inhibitory protein 6 | AF242431.1 |
| hypothetical protein DC42 | XM_028240.1 |
| WD repeat domain 1 (WDR1) | XM_034454.1 |
| zinc finger protein 313 | XM_009507.1 |
| 54 other clones isolated once each. | |

Serum reactivity toward a cellular protein can occur for two possible reasons: 1) expression of a mutated form of the protein by the tumor cells and 2) overexpression of the protein in the tumor cells. Identification of proteins detected by the host immune system in this fashion therefore provides mechananistic information about protein(s) that can be mutated or overexpressed in ovarian cancer. Such information provides insight into the molecular targets and mechanisms giving rise to ovarian cancer. Lastly, the sequences identified using the epitope-biopanning/phage microarray approach can be useful for early detection of cancer occurrence and recurrence by screening patients' sera and peritoneal fluids and providing immunogens for immunotherapy vaccines.

Example 2

A strategy was developed for serological detection of large numbers of antigens indicative of the presence of cancer, thereby using the humoral immune system as a biosensor. The high-throughput selection strategy involved biopanning of an ovarian cancer phage display library using serum immunoglobulins from an ovarian cancer patient as bait. Protein macroarrays containing 480 of these selected antigen clones revealed 44 clones that interacted with immunoglobulins in sera from all (32/32) ovarian cancer patients, but not with sera from either healthy women (0/25) or patients having other benign or malignant gynecological diseases (0/14). An informative subset of 26 antigen clones was chosen based on the criterion that the serum from each of a group of 16 patients interacted with at least one of the clones. When another, independent group of 16 serum samples was used, all 16 samples interacted with one or more of the 26 clones, and none from 12 healthy women. The process of globally profiling disease relevant epitopes is known as "epitomics".

In searching for a method for the early detection of ovarian cancer (OVCA), large numbers of potential diagnostic antibodies were identified and a high-throughput strategy was developed to clone antigen biomarkers. Because antibodies to any single antigen tend to detect only a small fraction of cancer patients, the necessity to screen a large panel of potential antigen markers was recognized. Therefore a differential biopanning technique was used to screen T7 phage display cDNA libraries to isolate cDNAs coding for epitopes binding with antibodies present specifically in the sera of patients with early or late stage ovarian cancer but not with antibodies in the sera of healthy women. Using a single OVCA patient's immunoglobulins (IgG) as bait, there were identified both established and novel antigen biomarkers. Large numbers of cancer-associated antigens can be found by this phage display technique more rapidly than using standard SEREX analysis. This is due to the power of repeated cycles of selective enrichment possible with viable phage display cDNA biopanning, especially when screening is performed with serum containing a complex mixture of low titer of IgGs, compared to the single step screening possible with SEREX, which is biased toward the identification of antigens that can be detected at a relatively high titer of IgGs.

The antigens that were identified through this process have diagnostic value with additional potential for development of therapeutic vaccines or imaging reagents. Since the host immune system can unravel molecular events (overexpression or mutation) critical to the genesis of ovarian cancer, this novel proteomics technology can identify genes with significant mechanistic involvement in the etiology of the disease. Our initial goal is to develop a serum-based test that can detect ovarian epithelial cancer at an early and curable stage.

Methods

Serum Samples.

Blood samples from ovarian cancer patients (Stages I-IV) and healthy controls were obtained from the Barbara Ann Karmanos Cancer Institute. Processing of blood to extract serum was performed in the laboratory. Briefly, blood samples were centrifuged at 2500 rpm at 4° C. for 10-15 minutes and supernatant were stored at −70° C. until use.

Construction of T7 Phage Display cDNA Library from Ovarian Cancer Cell Line, SKOV3.

Isolation of mRNA from Total RNA.

Ovarian cancer cells were grown in monolayer culture. Total RNA was prepared using trizol reagent according to manufacturer's instructions (Invitrogen, Carlsbad, Calif., USA). Total RNA, 0.5 mg, was used for the purification of Poly(A)+ mRNA following the method as suggested by the manufacturer (QIAGEN Inc, Valencia, Calif.). Poly(A)+ mRNA was quantitated by UV spectroscopy and the process of poly A selection was repeated once. Twice poly (A) selected mRNA was stored at −70° C. for use in library preparation.

Construction of T7 Phage Display cDNA Library.

Novagen's OrientExpress cDNA Synthesis and Cloning systems were used in the construction of the ovarian cancer T7 phage cDNA libraries (Novagen, cDNA manual, TB247). The OrientExpress Random Primer System was used to achieve orientation-specific cloning between EcoRI and HindIII sites. First and second strand cDNA synthesis were sequentially carried out in the presence of 5-methyl dCTP. After second strand synthesis, the cDNA was treated with T4 DNA polymerase to blunt the ends. The addition of EcoRI/HindIII Directional Linker d(GCAAGMTTCAAGC) (SEQ ID NO: 3) at the d(A)n:d(T)n end created a HindIII site d(AAGCTT) (SEQ ID NO: 4) in which the two underlined bases were derived from cDNA. The two dT's were provided on the 5' end of each first strand by the HindIII random primer d(TTNNNNNN) (SEQ ID NO: 5). Excess linkers and small cDNAs (<300 bp) were removed by a gel filtration step as described in Novagen's manual TB 247. The digestion of the cDNA with both HindIII and EcoRI thus yielded cDNA molecules ready for directional insertion into EcoRI/HindIII vector T7Select 10-3 arms. After vector ligation and packaging using T7 packaging extracts, the phage were plated to determine the library titer. About 50 phage clones were randomly picked up and PCR was performed with the T7 forward primer (TCTTCGCCCAGAAGCAG) (SEQ ID NO: 6) and T7 reverse primer (CCTCCITTCAGCAAAAACCCC) (SEQ ID NO: 7), in order to determine the insert sizes. The insert size range was found to be between 300 bp-1.5 kb.

Amplification of Packaged Libraries by Liquid Culture Method.

10 ml of LB/carbenicillin medium was inoculated with a single colony of *E. coli* strain BLT5615 from a freshly streaked plate. The mixture was shaken at 37° C. overnight. Five ml of the overnight culture was added to 90 ml of LB/carbenicillin medium and was allowed to grow until the OD600 reached 0.4-0.5. After obtaining the appropriate OD, 1 mM Isopropyl-β-D-thiogalacto-pyranoside (IPTG), (1×) M-9 Minimal salts and 0.4% glucose were added and the cells were allowed to grow for 20 minutes. An appropriate volume of culture was infected with phage library at multiplicity of infection (MOI) of 0.001-0.01 (100-1000 cells for each pfu). The infected bacterial culture was incubated with shaking at 37° C. for 1-2 hours until lysis was observed. After lysis, 0.02% glycerol and 0.02M phenyl-methyl sulphonyl fluoride (PMSF) and protease inhibitor cocktail (PIC) were added to the cell lysate to block proteolysis of the capsid fusion proteins. The phage lysate was centrifuged at 8000×g for 10 minutes. The supernatant was collected and stored at 4° C. The lysate was titered by plaque assay under standard conditions. The libraries were stored at −80° C. after purification by polyethylene-glycol precipitation and ultracentrifugation through a cesium chloride step gradient.

Selection of T7 Phage Displayed cDNA Libraries with Human Sera.

Affinity Selection with Sera from Normal Individuals.

Twenty-five μl of Protein G Plus-agarose beads were placed into a 0.6 ml microcentrifuge tube and washed twice with 1× phosphate buffered saline (PBS). The washed beads were blocked with 1% bovine serum albumin (BSA) at 4° C. for 1 hour and then incubated at 4° C. for 1 hour with 250 μl of pooled sera from 20 healthy women at a 1:20 dilution. After 3 hours of incubation, beads were washed three times with 1×PBS and then incubated with phage library (~$10^{10}$ phage particles) made from an ovarian cancer cell line, SKOV3. The mixture was centrifuged at 3000 rpm for 2 minutes to remove phage nonspecifically bound to the beads and the supernatant (phage library) was collected for immunoselection.

Immunoselection of the Phage Mixture with Serum from an Ovarian Cancer Patient.

Protein G Plus agarose beads were placed into a 0.6 ml microcentrifuge tube and washed two times with 1×PBS. The washed beads were blocked with 1% BSA at 4° C. for 1 hour and then incubated at 4° C. with 250 μl of a 1:20 dilution of serum from the ovarian cancer patient, MEC1. After 3 hours, the beads were washed three times with 1×PBS and incubated for immunoselection overnight at 4° C. with the phage library supernatant. After this incubation, the mixture was centrifuged at 3000 rpm for 2 minutes and the supernatant was discarded. The beads were washed three times with 1×PBS and the phage was eluted from the washed beads as per the manufacturer's instructions. The bound phage was removed from the beads by centrifugation at 8000 rpm for 8 minutes. Eluted phage (200 μl) were transferred to liquid culture for amplification (100 μl elution to 20 ml culture). Four rounds of affinity selection were carried out on the amplified phage obtained for each series of biopannings. The number of biopanning cycles generally determines the extent of the enrichment for phage that binds to the sera of patient with ovarian cancer. Four other serum samples from ovarian cancer patients were also used for immunoselection of clones. MEC1 gave the strongest binding with its clones and therefore those clones were selected for the remainder of this study.

Macroarray Immunoscreening.

Figure 12A:
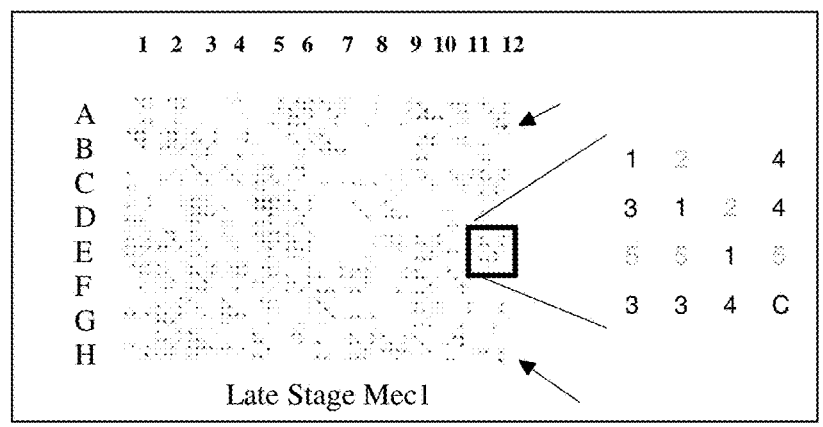
FIG. 12A shows a filter microarray showing antigen binding with IgGs in the serum of an ovarian cancer patient.
Figure 12B:
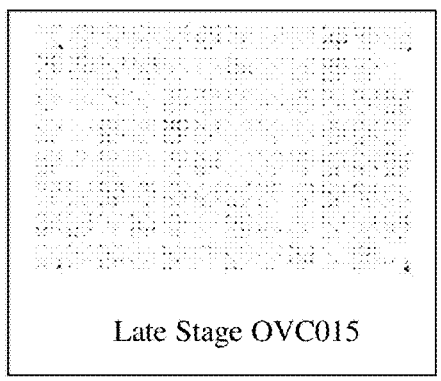
FIG. 12B shows a filter microarray showing antigen binding with IgGs in the serum of a late stage ovarian cancer patient.
Figure 12C:
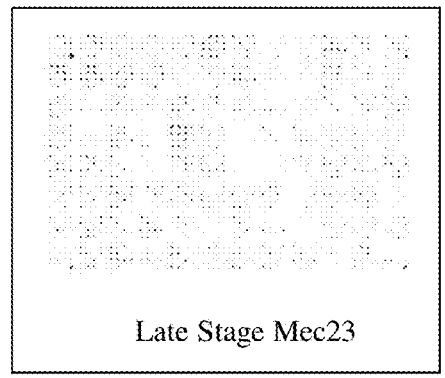
FIG. 12C shows a filter microarray showing antigen binding with IgGs in the serum of another late stage ovarian cancer patient.
Figure 12D:
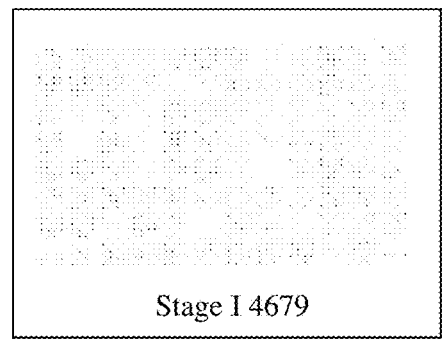
FIG. 12D shows a filter microarray showing antigen binding with IgGs in the serum of a Stage I ovarian cancer patient.
Figure 12E:
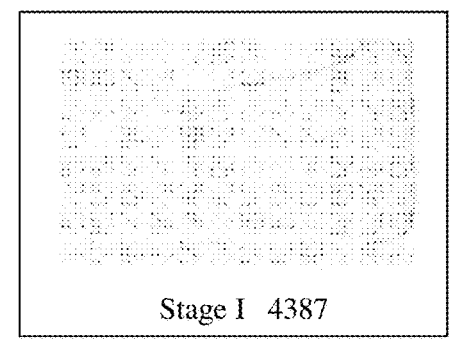
FIG. 12E shows a filter microarray showing antigen binding with IgGs in the serum of a another Stage I ovarian cancer patient.
Figure 12F:
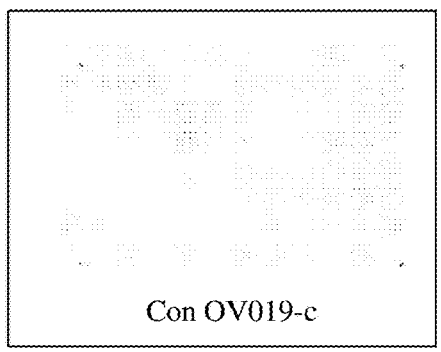
FIG. 12F shows a filter microarray showing antigen binding with IgGs in the serum of a control patient.
Figure 12G:
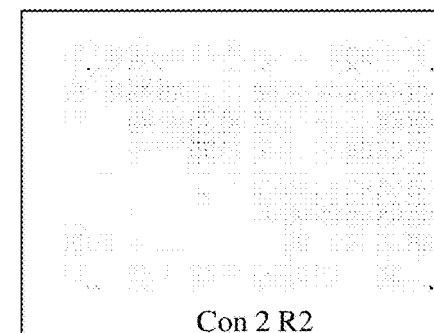
FIG. 12G shows a filter microarray showing antigen binding with IgGs in the serum of another control patient.
Figure 13A:
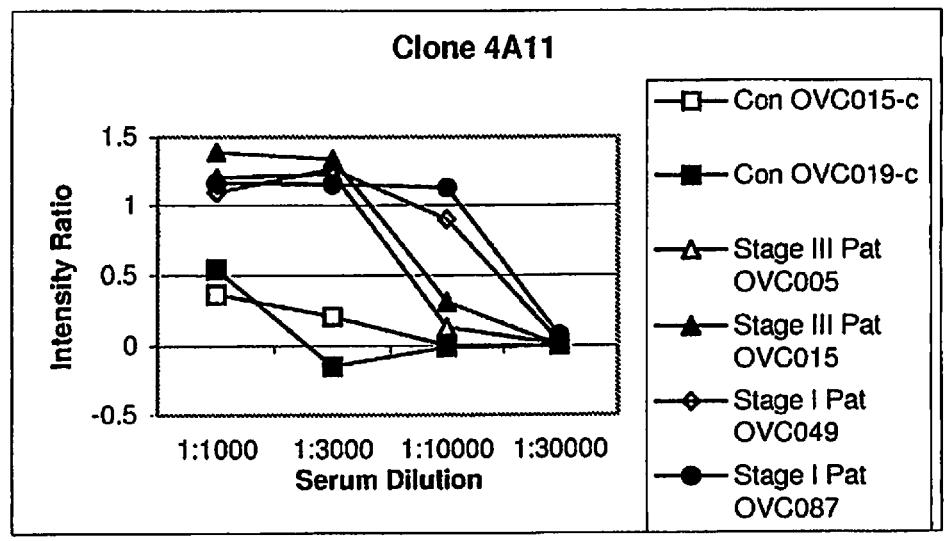
FIG. 13A is a graph showing the determination of a titerable antigen-antibody binding to phage clone 4A11 in ELISA macroarray analysis.
Figure 13B:
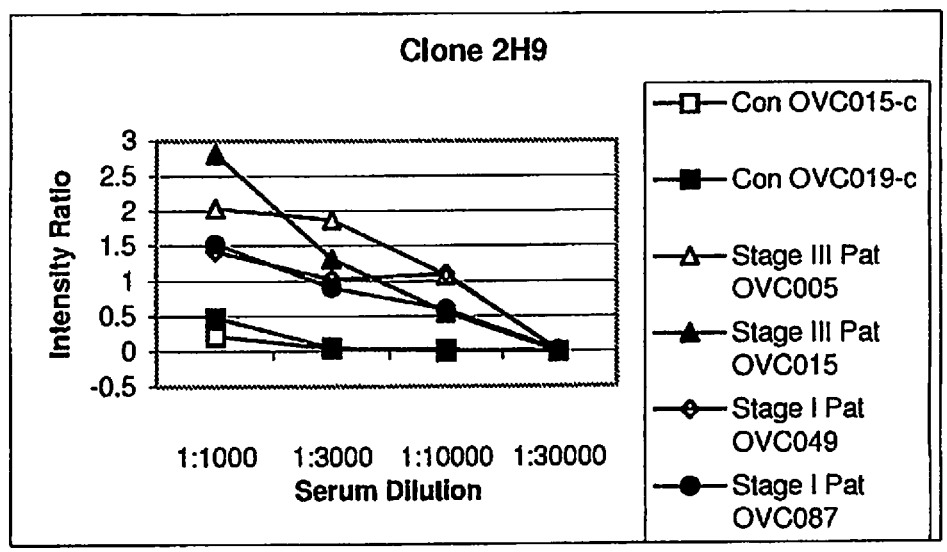
FIG. 13B is a graph showing the determination of a titerable antigen-antibody binding to phage clone 2H9 in ELISA macroarray analysis.
Figure 13C:
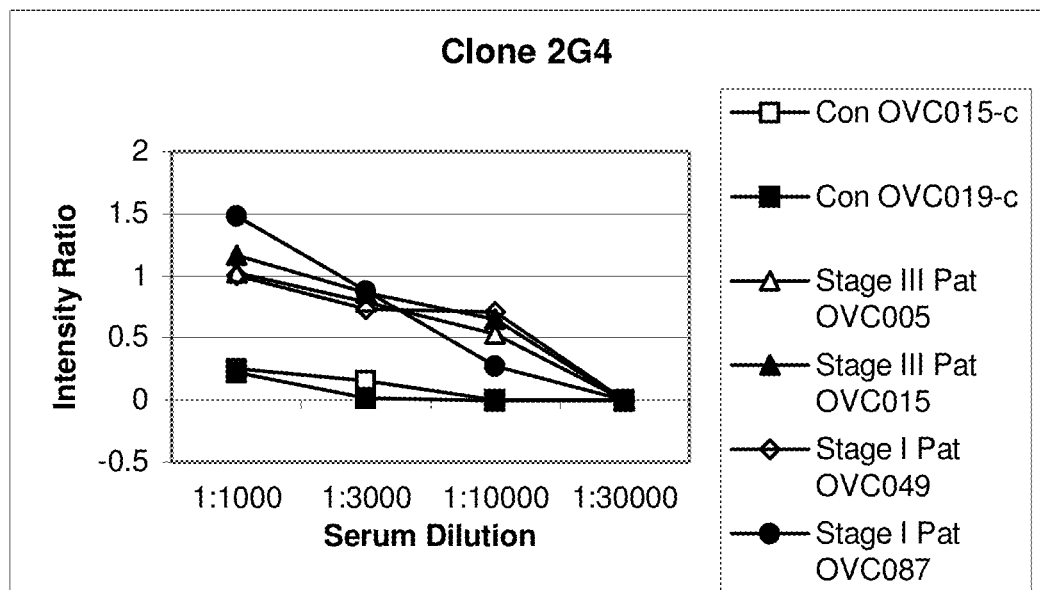
FIG. 13C is a graph showing the determination of a titerable antigen-antibody binding to phage clone 2G4 in ELISA macroarray analysis.
Figure 13D:
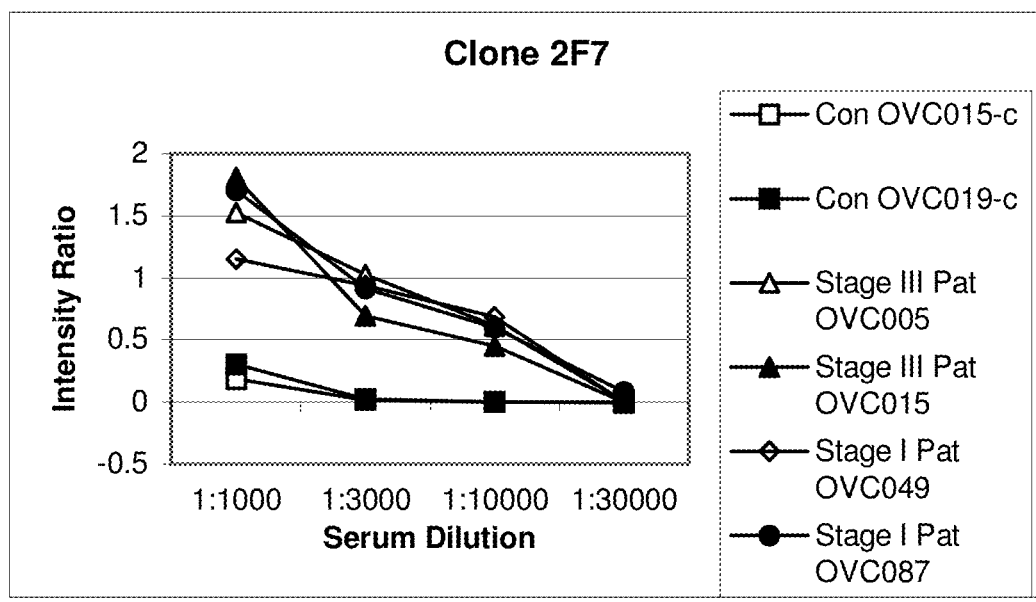
FIG. 13D is a graph showing the determination of a titerable antigen-antibody binding to phage clone 2F7 in ELISA macroarray analysis.

The titer of the T7 phage library obtained after amplification of each Biopanning (BP1-BP4) eluate was determined by plaque assay. *E. coli* BLT5615 was infected with the primary unamplified phage from biopanning (BP1-BP4) and plagued to limiting dilution onto LB/carbenicillin plates (150 mm×15 mm petri dish) so that sufficient numbers of single plaques could be isolated to obtain 12×96 well plates for arraying. The plates were incubated at 37° C. for 3-4 hours until the plaques were visible and then picked for amplification in the 96-well plates. Lysis of the host bacteria generally occurred after 2 hours. After bacterial lysis, the plates were centrifuged at 3000 rpm for 20 minutes. The samples from the 96-well plates were arrayed onto a nitrocellulose membrane (Osmonics) using the Beckman Biomek 2000 liquid handling robot. This robot, equipped with a 96-pin printing head spotted the samples contained in 96 well plates onto nitrocellulose membranes. The patterns were printed in a 4×4 configuration. Position A1 contained 16 spots, each representing a phage sample (FIG. 12A). Triplicates were printed from well A1 of each of five different 96 well plates (15 spots) and the 16th spot contained a positive control of diluted human serum used in the 4 corners of the plate only as shown by black arrows (FIG. 12A). After each round of spotting, the pins were washed in 0.1% SDS, sterile water, and then ethanol. After the spotting was completed, nitrocellulose membranes were blocked with 5% non-fat dry milk for 1 hour at room temperature. The membranes were then incubated with a patient's serum (pretreated with 150 μg of bacterial extracts for 2 hours at 4° C.) at a dilution of 1:10000 or 1:3000 for 1 hour at room temperature. Bacterial extract was used because some patients and controls had antibody binding to bacterial protein(s). The membranes were then washed three times with 0.24% Tris, 0.8% NaCl, 1% Tween-20 (TBST) for 15 minutes each and then incubated with secondary antibody, goat-anti human IgG-HRP conjugated (Pierce, Rockford, Ill., USA) at 1:5000 dilution for 1 hour at room temperature. The membranes were again washed three times with TBST for 15 minutes each, developed with Supersignal® West Pico chemiluminescent substrate (Pierce, Rockford, Ill., USA) and the images captured on X-ray film.

Stability of Serum Specimens.

One source of error in the immunodetection on macroarrays could be variability in serum sample preparations or storage. Therefore, a test was performed to determine whether some common handling conditions adversely affect the usefulness of the sera for the assays. For this test, several aliquots of the same serum sample from one ovarian cancer patient were subjected to various treatments; repeated freeze-thaw cycles (10 times), incubation of the blood sample at 37° C. for 72 hours before processing the serum, extended storage at 4° C., treatment at room temperature overnight, and heat treatment at 65° C. for 10 minutes. Freshly thawed serum, processed normally, served as a control. Robotically printed nitrocellulose membranes containing the set of 480 clones were later processed with each of those treated and untreated serum samples.

ELISA Macroarray Analysis.

Forty-four Stage I-IV clones, in triplicate, were arrayed onto a nitrocellulose membrane (Osmonics) using the Beckman Biomek 2000 liquid handling robot. Nitrocellulose membranes were blocked with 5% non-fat dry milk for 1 hour at room temperature and then incubated with patient or control serum (pretreated with 150 µg of bacterial extract for 2 hours at 4° C.) at dilutions of 1:1000, 1:3000, 1:10000 and 1:30000 for 1 hour at room temperature. Immunoreactivity was performed with serum from patients or healthy controls. For one set, the immunoreactivity was also performed with a monoclonal antibody to the N-terminus of the T7 gene 10 protein at dilution 1:10000. This was performed as described in the macroarray immunoscreening. The intensity of each spot was measured using ImaGene software from BioDiscovery Inc, with background subtraction and calculated using the following equation:

Intensity Ratio=(Mean of Clone)/(Mean of T7 for 12 replicates of that Clone)−(Mean of Blank Phage)/(Mean of T7 for 12 replicates of that Blank Phage).

The Intensity Ratio vs. Serum concentration was plotted for each antigen clone.

Sequencing of phage cDNA clones. Individual phage clones were PCR amplified using forward PCR primer 5' GTTCTATCCGCAACGTTATGG 3' (SEQ ID NO: 8) and reverse PCR primer 5' GGAGGAAAGTCGTTTTTTGGGG 3' (SEQ ID NO: 9). PCR products were purified on 1% agarose gels. The bands were excised from gels under UV light and DNA was extracted/purified using a Qiagen gel extraction kit (Qiagen Inc, Valencia, Calif., USA). Fifty ng of each purified PCR product was analyzed using forward Sequencing primer 5' TGCTAAGGACAACGTTATCG 3' (SEQ ID NO: 10) by Wayne State University DNA Sequencing Core Facility.

Results

Differential Biopanning of T7 Phage cDNA Expression Libraries Employing Sera Obtained from Women with Ovarian Cancer and Healthy Controls A method of differential biopanning to screen a T7 phage cDNA library prepared from an ovarian cancer cell line, SKOV3, was developed using a late stage ovarian cancer patient's serum (MEC1) as the bait to isolate tumor-specific antigens. First the library was pre-adsorbed with sera pooled from 20 healthy controls so as to remove the antigen clones binding with common antibodies unrelated to cancer. The resulting phage were then bound to antibodies present in the serum of a cancer patient and the unbound phage removed. This selection procedure was repeated four times, amplifying the phage between cycles of biopanning. Groups of 96 clones were picked from the patient's biopanning at cycles 1, 2, 3 and 4. Amplified phage clones were spotted on nitrocellulose membranes, and useful phage clones were identified by their binding with patient IgG antibodies at a dilution of 1:10000. There was a significant enrichment for phage-bearing epitopes that bound serum IgGs after the fourth round of biopanning. Because about 35% of the selected phage clones interacted with MEC1 serum IgGs after the fourth round of biopanning, further biopanning was not performed to avoid reducing the diversity of phage clones.

Serological Detection of Antigens using Macroarrays

The utility of such phage display antigen clone sets for the serological detection of cancer is best demonstrated by their interaction with sera from patients other than those used in the selection step. A set of 480 clones from the fourth round of biopanning was robotically spotted on nitrocellulose membranes. The binding of the cloned antigens with the IgGs in patients' sera was analyzed at a dilution of 1:10000. The strong positive interactions observed with the MEC1 serum indicated a relatively high titer of the IgG molecules that bound with the MEC1 clones (FIG. 12A). Several dilutions of the MEC1 serum were previously used for antigen detection and a dilution of 1:10000 produced the cleanest pattern of strong binding. Although 480 clones were identified from the biopanning with MEC1 serum as the bait, not all 480 clones interacted with the MEC1 serum (FIG. 12A). This can be explained by a non-specific interaction between phage clones and the Protein-G+ beads bearing the serum antibodies. When serum IgG-binding with sera from other patients (non-self reaction) was analyzed using replicates of these robotically spotted macroarrays, cross-reactivity was observed in most patients at a dilution of 1:10000 (FIG. 12B-E). Sera from other patients required either a 1:3000 or 1:30000 dilution to detect positive clones. Binding was scored positive only when 3 of the triplicates had similar intensity and when the intensity was significantly higher than the background intensity of other spots within the same patch. Sera from 71 individuals were tested; 10 were from women with early stage OVCA (Stage I and Stage I borderline), 22 from women with late stage OVCA, 14 from women with benign or other gynecological diseases, and 25 from healthy controls. Tumor histology and stage of all the patients' used for the study are listed in Table 4. Late stage patients OVC015 and MEC23 bound more intensely than the Stage I patients 4679 and 4387 (FIG. 12B-E). In the subtractive biopanning scheme, phage epitope clones binding IgGs were isolated in control sera even though these control sera were not used in the initial subtractive biopanning steps. As expected, a fraction of the 480 phage clones on the macroarrays interacted with approximately 10% of the controls. All clones that interacted with the control sera were eliminated from further consideration. One hundred and forty-nine clones interacted with sera from Stage I-IV ovarian cancer patients but with none of the 25 control sera. Forty-four out of 149 clones interacted specifically with these Stage I-IV sera. The remaining 105 clones interacted with sera from women who had benign tumors, endometrial cancers or other gynecological diseases and may represent biomarkers of gynecological sickness. These clones were excluded because these conditions are a common source of false positive results in CA-125 clinical testing. A matrix summarizing the binding of the 44 Stage I-IV selected antigen clones to sera from patients and controls is shown in Table 5A (shown in FIG. 14A). The derivation of this matrix was based on an agreement between two observers who analyzed the data independently, with 87% concordance.

In FIG. 14A (TABLE 5A), the binding of a panel of 44 clones with 22 Late Stage, 10 Stage I ovarian cancer patients was determined. These 44 antigens listed bound exclusively with serum IgGs derived from both late stage and stage I ovarian cancer patients (including borderline histology) but not with serum IgG from normal control or patients with other gynecological diseases. The grey colored boxes represent positive binding of phage clones with patient's sera. TP: Total number of patients whose serum IgGs bound to each phage clone. Only 2/44 selected clones, 2G4 and 3B12, bound with MEC1 serum IgGs despite the fact that T7 cDNA library was biopanned with MEC1 serum as the bait. A large number of clones interacting with the MEC1 serum were eliminated because they bound with either healthy control or with patients having benign or other gynecological diseases. The best markers are those interacting with the most patients; these include such clones as 2H9 (13/32), 2G2 (13/32), 2B4 (12/32), and 2G4 (12/32) that had the highest frequency of IgG binding with sera from ovarian cancer patients. Three antigens, 2F7/2B4, 5C3/2G4, 2E1/4A3 were found in multiple clones resulting in a panel of 41 markers binding with IgGs in Stage I-IV ovarian cancer sera (Table 5A).

Although 41 antigens interacted with sera from all 32 patients, the number of clones in the set needed to detect all 32 ovarian cancer patients were reduced. The serum set from 32 patients was randomly divided into two groups. The first group (Group 1) consisted of 16 patients and 25 healthy women; and the second group (Group 2) consisted of the other 16 patients and 12 different healthy women. Group 1 was used to select the minimum number of clones necessary to detect all patients. The strategy of clone selection involved ranking of clones in order of decreasing binding with sera from ovarian cancer patients (Table 7A, shown in FIG. 15A). Next, a combination of clones was selected for binding with IgGs in sera from all of the ovarian cancer patients in the set. Twenty-six clones of Group 1 detected all of the ovarian cancer patients (16/16) (Table 7A); all but one patient's serum bound with more than one of the selected clones. In FIG. 15A, 26 Clones are ordered according to binding with the 16 patients in Group 1. None of the 25 healthy women's sera (belonging to Group 1) contained IgGs that any of these clones. Clones are shown in rows. Patients' numbers are shown in the columns. The last column, TP, Total number of patients whose serum IgGs bound to each phage clone. These 26 clones were then tested on sera from Group 2 (16 patients and 12 healthy controls), for antibody binding (Table 7B, shown in FIG. 15B). Sera from all of the patients in Group 2, (16/16), bound with at least one of these clones and none of the sera from the healthy women (0/12) bound to these clones. In FIG. 15B, the rows represent the 26 clones and the columns represent the 16 patients. As shown in this table, sera from 16 out of the 16 patients in Group 2 contained IgGs that bound at least one clone. None of IgGs in sera 12 healthy women interacted with any of these 26 clones.

A second group of 21 clones was found to interact with (18/22) late Stage patients' sera but not with sera from early stage patients, with sera from 25 healthy women or with sera from 14 patients with either benign tumors, endometrial cancers or other gynecological diseases (Table 5B, shown in FIG. 14B). Although 4 late stage patients were not detected by these 21 clones (Table 5B), they were detected by 44 Stage I-IV clones (Table 5A). Among these 21 clones, antigen 2B3 interacted with the greatest number of patients sera (10/22), clone 5A2 with 8/22, clones 2D7 and 2E7 with 5/22 sera. Although these clones did not detect women with early stage ovarian cancer, further analysis may show them to be useful as markers of recurrence. In FIG. 14B, the binding of a panel of 21 clones with 22 Late Stage was determined on macroarrays. These 21 antigens listed bound exclusively with serum IgGs derived from late stage ovarian cancer patients but not with serum IgG from normal control of patients with other gynecological diseases.

Stability of Serum Specimen.

An important feature of a test for widespread clinical use is the stability of the analyte in the test sample. To identify any inaccuracy in detecting IgG molecules in this multianalyte assay due to serum sample preparation problems or serum storage, a test of the durability of the serum samples was carried out. Repeated freeze-thaw cycles (10 times), heated to 65° C. for 10 minutes, or left the unprocessed blood at 37° C. for 72 hours were performed. Only heat treatments of the serum affected the positive signals on the macroarrays, because heat treatment is sufficient to denature immunoglobulins (IgG). Therefore, the complex set of IgG molecules in serum samples are very stable and provide a reliable analyte for clinical studies of diagnostic arrays of cloned antigens.

ELISA Macroarray Analysis.

The set of 44 (Stage I-IV) phage display cDNA clones listed in Table 5A, were printed robotically on nitrocellulose membrane and an enzyme-linked immunosorbent assay (ELISA)-like experiment was performed. For clones 4A11, 2H9, 2G4 and 2F7, the binding of antigens decreased with increasing dilution of serum (FIG. 13A-D). Although clones bound nonspecifically with control sera at high serum concentrations, their binding decreased to zero as the sera were diluted, whereas the interaction of the same clones with IgGs in patients' sera persisted at even 1:10000 serum dilution. This demonstrated that the interaction of antigen clones with patients' sera was indicative of a typical, titerable antigen-antibody interaction.

Phage-Coded Antigen Sequence Analysis

To identify the selected gene products, phage DNAs were amplified by PCR and the cDNA products sequenced. The DNA sequences were checked for homology to the GenBank databases using BLAST. The predicted amino acids in-frame with the T7 gene 10 capsid protein were determined. Eleven sequences were homologous to known gene products while other clones had no homology to any annotated sequences in the public databases (Table 6A). Among the gene products, 11 represented known gene products in the correct orientation and in the correct reading frame with the T7 gene 10 capsid protein indicating that the serum IgG binding region was localized to a portion of the natural open reading frame of the protein. Of the remaining 33 clones, 13 clones contained an open reading frame with the T7 10B gene with a frameshift within the natural reading frame of the gene; 7 clones contained portions of either 5' or 3' untranslated regions of known genes; 13 clones contained segments of genomic sequences. This in turn resulted in the formation of recombinant fusion proteins in which the predicted amino acid of the in-frame fusion with the T7 10B protein was not similar to the original protein coded by the gene. The size of the additional peptide sequences ranged from 5-48 amino acids. This result indicated that the recombinant gene products of these clones must be coding for proteins that mimic some other natural antigens, and hence can be termed mimotopes (Table 6A). BLASTp search of the SWISSPROT database for homology to each in-frame mimotope confirmed this observation. For example, clone 2H5 contained a nucleotide sequence homologous to the ATP synthase, H+ transporter. Using BLASTp, there was observed a sequence homology of (8/10) amino acids with the leukocyte common antigen precursor. Each mimotope had significant homology to a natural open reading frame (Table 6A).

Discussion

The early detection of cancer is a significant challenge in clinical oncology. Once accurate methods become available, early detection can result in a significant reduction in morbidity and mortality of these diseases. The detection of ovarian cancer at Stage I could result in a cure rate of 90%. To this end there has been devised an approach of high-throughput selection of antigen biomarkers using phage display libraries and marker selection using a highly parallel analysis on macroarrays. The process began with a representative sample of 480 cloned markers from biopanning an ovarian cancer T7 phage display cDNA library with one patient's serum. There was first demonstrated that these clones bound to IgG molecules found in the sera of patients other than the one used for antigen selection. One hundred and forty nine markers that bound to IgGs in sera from OVCA patients showed no interaction with sera from cancer-free women. Forty-one of these antigen biomarkers had positive interactions with early (including cancers with borderline histology) and late stage ovarian cancer patients and there were no false positive interactions with IgGs in sera from either women having benign gynecological syndromes such as ovarian cysts and endometrial fibroids or sera from women with endometrial cancer. Because Stage I and Stage I borderline tumors can elicit a detectable immune response in this assay, this technology is sensitive to very small tumor burdens as (Table 5A). Sera from women with other cancers can be used to distinguish markers that are specific to ovarian cancer from those that bind to antibodies in sera from individuals with other cancers. Based on this representative sample of 480 clones from a single selection experiment, discovery of these markers to larger numbers of epitope clones were scaled up, cloning from additional libraries using sera from these and other women with ovarian cancer. Although the epitope markers were cloned using serum from a patient having the most common histologic type of ovarian cancer, serous adenocarcinoma, there has been shown that these markers are capable of detecting other histologic types of ovarian cancer, including endometrioid and clear cell tumors as well (Table 5A, Table 4). When the top ranking 26 (Table 7A) were applied, to the dataset comprised of 16 patients and 12 healthy women, these clones bound to IgGs in the sera from 16 out of 16 patients (Table 7B). As none of these 26 clones showed binding to IgGs in sera from 25 healthy women in Group 1 or 12 healthy women in Group 2, it is likely they represent a promising discriminator between the healthy and cancer sera. Larger studies with additional antigen biomarkers in other populations can be used to verify that the rate of diagnostic misclassification with this approach is small enough to justify its use in a clinical setting as screening test for ovarian cancer.

Knowledge regarding the immunogenicity and expression pattern of serologically-defined tumor antigens is critical in assessing the therapeutic and diagnostic potential of those antigens. The present study demonstrates that the use of T7 phage display selected clones is an effective technique for molecular profiling of the humoral immune response in ovarian cancer. Within this initial panel of 41 biomarkers, 8/9 contained large portions of open reading frames of the parental proteins; 1F6 is the receptor-binding cancer antigen expressed on SiSo cells (Human uterine adenocarcinoma cell line) (RCAS1); 3A9 is the signal recognition protein (SRP-19); 5C11 is the AHNAK-related sequence; 2B4, nuclear autoantogenic sperm protein (NASP); 3C11 is the Ribosomal protein L4 (RPL4); 4H3 is the Nijmegen breakage syndrome 1 (nibrin) (NBS1); 2G4 is the eukaryotic initiation factor 5A (eIF-5A); and 5F8 is the *Homo sapiens* KIAA0419 gene product. With the exception of clone 4A11 that is the *Homo sapiens* chromodomain helicase DNA binding protein 1, CHD1, all of the aforementioned gene products have a known or suspected etiological association with cancer. One of these markers, RCAS1, is overexpressed in many cancers such as uterine, breast and pancreatic cancer. As indicated by the broad overexpression of RCAS1 in human cancers, some of the antigens identified may not be specific to ovarian cancer. However, this does demonstrate that the epitomics profiling of the humoral immune response in cancer patients can identify serum antibody markers that are relevant to the etiology of their cancer (e.g. overexpressed or mutated) with diagnostic and therapeutic value. Interestingly, these 9 antigens with parental open reading frames are predicted to be intracellular products. This finding is in agreement with reports using the SEREX procedure, whereby the majority of those antigens are also intracellular, and their probable release by necrosis or cell lysis at the tumor site is an initiating factor in eliciting an immune response.

The remaining 32 clones are mimotopes, defined as peptides capable of binding to the paratope of an antibody, but are unrelated in sequence to the natural protein that the antibody actually recognizes. Such peptides are usually identified by testing combinatorial peptide libraries obtained by chemical synthesis or phage display for their ability to bind monoclonal antibodies specific for discontinuous epitopes. This is analogous to the previous studies that have selected randomized peptide libraries on serum from Hepatitis B patients. Peptide mimotopes can potentially be used as a novel form of immunotherapy to induce a beneficial antitumor response. A mimotope derived from a phage display library can induce specific inhibition of the binding between tumor-inhibitory antibody and the Erb-2 receptor. Such mimotopes may represent a superior form of immunotherapy that may not elicit side effects due to autoimmunity to a natural protein.

In conclusion, using a combination of high throughput selection and array-based serological profiling that are called Epitomics®, there was isolated a panel of 41 antigens, including 8 antigens previously associated with cancer. Further work with larger panels of antigens analyzed on macroarrays or microarrays provide a comprehensive set of markers that can be evaluated using sera from other cancers for the specificity of an ovarian cancer test. This epitomics approach to antigenic profiling has applications to cancer, autoimmune diseases, and infectious diseases for diagnostic, therapeutic, and epidemiologic studies.

Throughout this application, various publications, including United States patents, are referenced by author and year and patents by number. Full citations for the publications are listed below. The disclosures of these publications and patents in their entireties are hereby incorporated by reference into this application in order to more fully describe the state of the art to which this invention pertains.

The invention has been described in an illustrative manner, and it is to be understood that the terminology that has been used is intended to be in the nature of words of description rather than of limitation.

Obviously, many modifications and variations of the present invention are possible in light of the above teachings. It is, therefore, to be understood that within the scope of the appended claims, the invention can be practiced otherwise than as specifically described.

TABLE 4

Tumor Histology and Stage of Patients' sera used for screening of ovarian cancer

| Blood Specimen ID # | Histology | Stage |
|---|---|---|
| MEC1* | serous adenocarcinoma | Unknown |
| MEC2 | serous adenocarcinoma | IIA |
| MEC16 | serous adenocarcinoma | IV |
| MEC20 | serous adenocarcinoma | Unknown |
| MEC23 | serous adenocarcinoma | IIIC |
| MEC35 | serous adenocarcinoma | IIIC |
| MEC37 | serous adenocarcinoma | IIIC |
| TB01-060 | serous adenocarcinoma | IIIC |
| TB01-108 | serous adenocarcinoma | IIIC |
| 42501 | adenocarcinoma NOS | late |
| 400162 | adenocarcinoma NOS | late |
| 40036 | adenocarcinoma NOS | late |
| 42780 | adenocarcinoma NOS | late |
| B755 | adenocarcinoma NOS | late |
| 40015 | adenocarcinoma NOS | late |
| OVC075 | serous adenocarcinoma | IIC |
| OVC015 | serous adenocarcinoma | IIIC |
| OVC035 | serous adenocarcinoma | IIIC |
| OVC007 | mixed epithelial | IIIC |
| OVC005 | Malignant Mized Mesodermal Tumor | IIIC |
| OVC063 | serous adenocarcinoma | III |
| OVC045 | serous adenocarcinoma | IIIC |
| NW0629 (4387) | endometrioid adenocarcinoma | IC |
| NW0453 (4679) | adenocarcinoma NOS | IC |
| NW0046 (4555) | borderline serous cystadenofibroma | IA |
| NW1181 (4283) | endometrioid adenocarcinoma | IA |
| OVC019 | mixed epithelial | IC |
| OVC087 | clear cell | IA |
| OVC078 | endometriod | IC |
| OVC070 | borderline serous | IC |
| OVC049 | mixed epithelial | IA |
| OVC079 | borderline serous | I |
| 33-38 | benign ovarian cyst | N/A |
| 92-96 | uterine myoma | N/A |
| 80-82 | endometrial adenocarcinoma | IIIA |
| 79-62 | endometrial adenocarcinoma | IIIA |
| 35-27 | benign ovarian cyst | N/A |
| 30-141 | benign ovarian cyst | N/A |
| 70-153 | endometrial adenocarcinoma | IB |
| 81-80 | endometrial adenocarcinoma | IA |
| 31-55 | benign ovarian cyst | N/A |
| 39-55 | benign ovarian cyst | N/A |
| 36-11 | endometrial polyp | N/A |
| 32-43 | Benign, thickening of endometrium | N/A |
| OVC068-1B | papillary serous adenoma (benign) & endometriosis | N/A |
| OVC054 | benign serous cystadenoma | N/A |

*Serum used for biopanning

Obviously, many modifications and variations of the present invention are possible in light of the above teachings. It is, therefore, to be understood that within the scope of the appended claims, the invention can be practiced otherwise than as specifically described.

The mimotope sequences and the epitopes that are the real antigens that the antibodies were produced against based on the amino acid sequence homology similarity (see below Region of similarity of AA).

TABLE 6A

Description of Stage I-IV clones.
Size range of the Mimotopes ≥5 amino acids

| Stage (I-IV) clones | Description of the genes that are in-frame with T7 10B gene | Peptide sequences of Epitopes, in-frame with T7 10 B gene | Size of the peptide | Unigene # | Region of similarity of AA | Antigen expression in any type of cancer |
|---|---|---|---|---|---|---|
| 1F6 | gi\|18490914\|gb\|BC022506.1\|, Homo sapiens, estrogen receptor binding site associated, antigen, 9 RCAS | AAWQAEEVLRQQKLADRE KRAAEQQ (SEQ ID NO: 11) | 25 AA | Hs.9222 | 165-213 | Overexpressed in ovarian, nonsmall cell lung carcinoma, pancreatic ductal carcinoma |
| 2B4 | gi\|22042983\|ref\|XM_032391.3\|, Homo sapiens similar to nuclear autoantigenic sperm protein (histone-binding) (NASP) | EKGGQEKQGHVIVSIEEK PKEVXEEQPVVTLEKQGT AVEVBAESLDPTVKPVDV GGDEPEEKVVTSENEAGK AVLEQLVGQEVPPAEESP EVTTEAAEASAVEAGSEV SEKPGQEAPVLPKDGAVN GPSVVGDQTPIEPQTSIE RLTETKDGSGLEEKVRAK LVPSQEETKLSVEESEAA GDGVDTKVAQGATEKSPE DKVQIAANETQER (SEQ ID NO: 12) | 212 AA | Hs.446206 | 258-469 | Expression levels are higher in myelogenous leukemia and lymphoblastic leukemia cells. |
| 2F7 | gi\|22042983\|ref\|XM_032391.3\|, Homo sapiens similar to Nuclear autoantigenic sperm protein (NASP) | EKGGQEKQGHVIVSI (SEQ ID NO: 13) | 15 AA | Hs.446206 | 256-270 | Expression levels are higher in myelogenous leukemia and lymphoblastic leukemia cells. |
| 2G4 | gi\|20987351\|gb\|BC030160.1\|, Homo sapiens, eukaryotic translation initiation factor 5A | MADDLDFETGDAGASATF PMQCSALRKNGFVVLKGR PCKIVEMSTSKTGKHGHA KVHLVGIDIFTGKKYEDI CPSTHNMDVPNIKRNDFQ LIGIQDGYLSLLQDSGEV REDLRLPEGDLGKEIEHK FDCGEQILITVLSAMTEE ALVA (SEQ ID NO: 14) | 148 AA | Hs.310621 | 1-148 | eIF-5A2 sharing 82% identity of amino acid sequence with eIF-5A, is a candidate oncogene related to development of ovarian cancer. |
| 3A9 | gi\|4507212\|ref\|NM_003135.1\|, Homo sapiens signal recognition particle 19 kDa (SRP19) | QKTGADQSLQQGEGSKK GKGKKKK (SEQ ID NO: 15) | 25 AA | Hs.2943 | 119-143 | Transcript generated by alternative splicing between exon 14 of the Adenomatous polyposis coli gene and SRP19 is observed and it's expression is higher in Colorectal cancer |

TABLE 6A-continued

Description of Stage I-IV clones.
Size range of the Mimotopes ≥5 amino acids

| Stage (I-IV) clones | Description of the genes that are in-frame with T7 10B gene | Peptide sequences of Epitopes, in-frame with T7 10 B gene | Size of the peptide | Unigene # | Region of similarity of AA | Antigen expression in any type of cancer |
|---|---|---|---|---|---|---|
| 3C11 | gi\|16579884\|ref\|NM_000968.2\|, Homo sapiens ribosomal protein L4 (RPL4) | ALQAKSDEKAAVAGK KPVVGKKGKKAAVGV KKQKKPLVGKKAAAT KKPSPEKKPAENKPT TEDNKPAA (SEQ ID NO: 16) | 68 AA | Hs.186350 | 360-427 | overexpression of L7a and L37 mRNA is confirmed in prostate-cancer tissue samples. |
| 4A11 | gi\|4557446\|ref\|NM_001270.1\|, Homo sapiens chromodomain helicase DNA binding protein 1 (CHD1) | QQQQQQHQASSNSG SEEDSSSSEDSDDSS SEVKRKKHKDEDWQM SGSGSPSQSGSDSES EEEREKSSCDETESD YEPKNKVKSRK (SEQ ID NO: 17) | 86 AA | Hs.311553 | 107-192 | Not associated with cancer |
| 4H3 | gi\|20543465\|ref\|XM_045343.5\|, Homo sapiens Nijmegen breakage syndrome 1 (nibrin) (NBS1) | PTKLPSINKSKDRAS QQQQTNSIRNYFQPS TKKRERDEENQEMSS CKSARIETSCSLLEQ TQPATPSLMKNKEQH LSENXPVDTYXXSXNL FTGYXFRXGXE (SEQ ID NO: 18) | 101 AA | Hs.25812 | 433-524 | Three different mutations in NBS1 gene, generating truncated or aberrant NBS1 transcripts were observed in different cancer cell lines. |
| 5C3 | gi\|20987351\|gb\|BC030160.1\|, Homo sapiens, eukaryotic translation initiation factor 5A | MADDLDFETGDAGAS ATFPMQCSALRKNGF VVLKGRPCKIVEMST SKTGKHGHAKVHLVG IDIFTGKKYEDICPS THNMDVPNIKRNDFQ LIGIQDGYLSLLQDS GEVREDLPLPEGD (SEQ ID NO: 19) | 118 AA | Hs.310621 | 1-118 | eIF-5A2 sharing 82% identity of amino acid sequence with eIF-5A, is a candidate oncogene related to development of ovarian cancer. |
| 5C11 | gi\|535176\|emb\|X74818.1\|HSAHNAKRS, H. sapiens mRNA of AHNAK-related sequence | PKFKMPDVHFKSPQI SMSDIDLNLKGPKIK GDMDISVPKLEGDLK GPKVDVKGPKVGIDT PDIDIHGPEGKLKGP KFKMPDLHLKAPKIS MPEVDLNLKGPKVKG DMDISLPKVEGDLKG P (SEQ ID NO: 20) | 121 AA | Hs.378738 | 393-512 | Expression level of AHNAK is higher in melanoma, promyelocytic leukemia HL-60, osteosarcoma. |

TABLE 6A-continued

Description of Stage I-IV clones.
Size range of the Mimotopes ≥5 amino acids

| Stage (I-IV) | Description of the genes that are in-frame with T7 10B gene | Peptide sequences of Epitopes, in-frame with T7 10 B gene | Size of the peptide | Unigene # | Region of similarity of AA | Antigen expression in any type of cancer |
|---|---|---|---|---|---|---|
| 5F8 | gi|7662105|ref|NM_014711.1|, Homo sapiens KIAA0419 gene product | GVCSSKVYVGKNTSE VKEDVVLGKSNQVCQ SSGNHLENKVTHGLV TVEGQLTSDERGAHI MNSTCAAMPKLHEPY ASSQCIASPNFGTVS GLKPASMLEKNCSLQ TELNKSYDVKNPSPL LMQNQNXRQQMDTPM VSCGNEQFLDNSFEK (SEQ ID NO: 21) | 150 AA | Hs.279912 | 434-583 | mRNA expression level of another antigen KIAA1416 is upregulated in colon cancer. |

The above table shows two antigens and not mimotopes, the clones below are the mimotopes.

| Stage (I-IV) clones | Description of the genes that are in Mimotope clones | Peptide sequences of Mimotopes, in-frame with T7 10 B gene | Size of the peptide | Description of the sequences that Mimotopes mimic | Unigene # | Region of similarity of AA | Antigen expression in any type of AA cancer |
|---|---|---|---|---|---|---|---|
| 2H9 | gi\|21619682\|gb\|BC032762.1\|, Homo sapiens optineurin, mRNA | ELLRT (SEQ ID NO: 22) | 5 AA | gi\|20139301\|sp\|Q9Y446\| PKP3_HUMAN, Plakophilin 3 | Hs.148074 | 407-411 Score = 18.9 bits (37), Expect = 827 Identities = 5/5 (100%), Positives = 5/5 (100%) Query[b]: 1 ELLRT 5 ELLRT Sbjct[c]: 407 ELLRT 411 | Immunohistochemical localization of plakophilins (PKP1, PKP2, PKP3, and p0071) in primary oropharyngeal tumors |
| 3B12 | gi\|21735624\|ref\|NM_145690.1\|, Homo sapiens tyrosine 3-monooxygenase/tryptophan 5-monooxygenase activation protein, zeta polypeptide (YWHAZ), transcript variant 2, mRNA. | GQTSM (SEQ ID NO: 23) | 5 AA | gi\|729143\|sp\|P38936\|CDN1_HUMAN, Cyclin-dependent kinase inhibitor 1 (p21) (CDK-interacting protein1) (Melanoma differentiation associated protein 6) (MDA-6) | Hs.370771 | 144-147 Score = 16.8 bits (32), Expect = 3595 Identities = 4/4 (100%), Positives = 4/4 (100%) Query: 2 QTSM 5 QTSM Sbjct: 144 QTSM 147 | mda-6 (p21) may function as a negative regulator of melanoma growth, progression and metastasis |
| 5D8 | gi\|22024583\|gb\|AC087376.5\|, Homo sapiens chromosome 11, clone RP11-230019, complete sequence | KKGPI (SEQ ID NO: 24) | 5 AA | gi\|20177863\|sp\|Q9BXJ2\| CQT7_HUMAN, Complement-c1q and tumor necrosis factor-related protein 7 precursor | Hs.153714 | 102-106 Score = 18.5 bits (36), Expect = 1109 Identities = 5/5 (100%), Positives = 5/5 (100%) Query: 1 KKGPI 5 KKGPI Sbjct: 102 KKGPI 106 | TNF-alpha regulates expression of downstream components of complement system and plays a role in energy homeostatic where it is implicated in cachexia, obesity and insulin resistance. |
| 4A4 | gi\|17028354\|gb\|BC017483.1\| BC017483, Homo sapiens, clone IMAGE: 3506553, mRNA. | AKVIMR (SEQ ID NO: 25) | 6 AA | gi\|5921908\|sp\|O43174\| CP26_HUMAN, Cytochrome P450 26 (Retinoic acid-metabolizing cytochrome) (P450RAI) (hP450RAI) (Retinoic acid 4-hydroxylase) | Hs.150595 | 138-142 Score = 20.6 bits (41), Expect = 255 Identities = 5/5 (100%), Positives = 5/5 (100%) Query: 2 KVIMR 6 KVIMR Sbjct: 138 KVIMR 142 | all-trans-Retinoic acid-induced expression and regulation of retinoic acid 4-hydroxylase (CYP26) in human promyelocytic leukemia |

-continued

| Stage (I-IV) clones | Description of the genes that are in Mimotope clones | Peptide sequences of Mimotopes, in-frame with T7 10 B gene | Size of the peptide Mimotope | Description of the sequences that Mimotopes mimic | Unigene # | Region of similarity of AA | Antigen expression in any type of AA cancer |
|---|---|---|---|---|---|---|---|
| 5A3 | gi\|15011541\|gb\|AF397158.1\| AF397158, Homo sapiens clone 11 pur alpha-associated ribosomal RNA gene, partial sequence | YACLKD (SEQ ID NO: 26) | 6 AA | gi\|1170473\|sp\|P42575\|ICE2_HUMAN, Caspase-2 precursor (CASP-2) (ICH-1 protease) | Hs.433103 | 351-355 Score = 20.2 bits (40), Expect = 342 Identities = 5/5 (100%), Positives = 5/5 (100%) Query: 1 YACLK 5 YACLK Sbjct: 351 YACLK 355 | CASP-3, CASP-4, CASP-2 heterogeneously coexpress in leukemic cell lines |
| 2A3 | gi\|23271193\|gb\|BC036014.1\|, Homo sapiens poly(A) polymerase alpha, mRNA). | QILFMDP (SEQ ID NO: 27) | 7 AA | gi\|729597\|sp\|P39086\|GLK1_HUMAN, Glutamate receptor, ionotropic kainate 1 precursor | Hs.222405 | 242-246 Score = 21.4 bits (43), Expect = 142 Identities = 5/5 (100%), Positives = 5/5 (100%) Query: 1 QILFM 5 QILFM Sbjct: 242 QILFM 246 | Ionotropic and metabotropic glutamate receptor protein expression in glioneuronal tumors from patients with intractable epilepsy |
| 4C10 | gi\|24756892\|gb\|AC008507.10\|, Homo sapiens chromosome 19 clone CTC-448F2, complete sequence | LNTVNTLI (SEQ ID NO: 28) | 8 AA | gi\|13633936\|sp\|Q9NPR2\| SM4B_HUMAN, Semaphorin 4B | Hs.416077 | 440-445 Score = 21.8 bits (44), Expect = 106 Identities = 6/6 (100%), Positives = 6/6 (100%) Query: 1 NTVNTL 6 NTVNTL Sbjct: 440 NTVNTL 445 | Not associated with cancer |
| 4D9 | gi\|21629397\|gb\|AC099571.2\|, Homo sapiens chromosome 1 clone RP11-438H8, complete sequence | GNSILLIA (SEQ ID NO: 29) | 8 AA | gi\|2842764\|sp\|Q99735\| GST2_HUMAN, Microsomal glutathione S-transferase 2 (Microsomal GST-2) | Hs.81874 | 3-10 Score = 21.4 bits (43), Expect = 140 Identities = 7/8 (87%), Positives = 7/8 (87%) Query: 1 GNSILLIA 8 GNSILL A Sbjct: 3 GNSILLAA 10 | GST-pi has significance in the diagnosis of cancers as it is expressed abundantly in tumor cells. |
| 2E11 | gi\|22004067\|dbj\|AP005356.2\|, Homo sapiens genomic DNA, chromosome 8q23, clone: KB1198A4, complete sequence. | WDLKSEYS (SEQ ID NO: 30) | 8 AA | gi\|1710146\|sp\|P49798\| RGS4_HUMAN, Regulator of G-protein signaling 4 (RGS4) (RGP4) | Hs.386726 | 80-85 Score = 21.8 bits (44), Expect = 106 Identities = 6/6 (100%), Positives = 6/6 (100%) Query: 3 LKSEYS 8 LKSEYS Sbjct: 80 LKSEYS 85 | RGS4 is highly expressed in brain regions implicated in pathophysiology of schizophrenia |

-continued

| Stage (I-IV) clones | Description of the genes that are in Mimotope clones | Peptide sequences of Mimotopes, in-frame with T7 10 B gene | Size of the peptide Mimotopes mimic | Description of the sequences that Mimotopes mimic | Unigene # | Region of similarity of AA | Antigen expression in any type of AA cancer |
|---|---|---|---|---|---|---|---|
| 5G9 | gi\|20072204\|gb\|BC026241.1\|, Homo sapiens ubiquitin-protein isopeptide ligase (E3), mRNA | PGCSTTLS (SEQ ID NO: 31) | 8 AA | gi\|14423962\|sp\|O94966\| UBPJ_HUMAN, Ubiquitin carboxyl-terminal hydrolase 19 | Hs.255596 | 940-947 Score = 18.9 bits (37), Expect = 827 Identities = 6/8 (75%), Positives = 7/8 (87%), Query: 1 PGCSTTLS 8 PGC+T LS Sbjct: 940 PGCTTLLS 947 | Ubiquitin carboxyl-terminal-hydrolase L1 genes cause autosomal dominant familial Parkinson disease. |
| 4H4 | gi\|20072204\|gb\|BC026241.1\|, Homo sapiens ubiquitin-protein isopeptide ligase (E3), mRNA | PRCSTTLS (SEQ ID NO: 32) | 8 AA | gi\|6225843\|sp\|O60760\| PGD2_HUMAN, Glutathione-requiring prostaglandin D synthase mRNA | Hs.128433 | 156-160 Score = 18.9 bits (37), Expect = 827 Identities = 5/5 (100%), Positives = 5/5 (100%), Query: 3 CSTTL 7 CSTTL Sbjct: 156 CSTTL 160 | Lipocalin-type prostaglandin D synthase (L-PGDS) has recently been shown to be expressed in human brain tumors, breast tumors and in ovarian cancer |
| 2C7 | gi\|3152628\|gb\|AC004744.1\| AC004744, Homo sapiens BAC clone GS1-465N13 from 7, complete sequence | GDRSQL WRK (SEQ ID NO: 33) | 9 AA | gi\|24211441\|sp\|Q13443\| AD09_HUMAN, ADAM 9 precursor (A disintegrin and metalloproteinase domain 9) | Hs.2442 | 720-725 Score = 20.2 bits (40), Expect = 342 Identities = 5/6 (83%), Positives = 5/6 (83%), Query: 3 RSQLWR 8 R QLWR Sbjct: 720 RDQLWR 725 | Expression of ADAM-9 mRNA and protein in human breast cancer |
| 2E1 | gi\|16160856\|ref\|XM_007763.5\|, Homo sapiens myosin VA (heavy polypeptide 12, myoxin) (MYO5A), mRNA | KKQSSW YQI (SEQ ID NO: 34) | 9 AA | gi\|2498310\|sp\|Q12882\| DPYD_HUMAN Dihydropyrimidine dehydrogenase [NADP+] precursor (DPD) (DHPDHase) (Dihydrouracil dehydrogenase) (Dihydrothymine dehydrogenase) (SEQ ID NO: 109) | Hs.1602 | 497-502 Score = 21.8 bits (44), Expect = 106 Identities = 5/6 (83%), Positives = 6/6 (100%), Query: 2 KQSSWY 7 KQ+SWY Sbjct: 497 KQASWY 502 | Higher DPD activity in gastric cancer is observed than in colorectal cancer |

-continued

| Stage (I-IV) clones | Description of the genes that are in Mimotope clones | Peptide sequences of Mimotopes, in-frame with T7 10 B gene | Size of the peptide Mimotope | Description of the sequences that Mimotopes mimic | Unigene # | Region of similarity of AA | Antigen expression in any type of AA cancer |
|---|---|---|---|---|---|---|---|
| 4A3 | gi\|16160856\|ref\|XM_007763.5\|, Homo sapiens myosin VA (heavy polypeptide 12, myoxin) (MYO5A), mRNA | KKQSSW YQI (SEQ ID NO: 35) | 9 AA | gi\|2498310\|sp\|Q12882\| DPYD_HUMAN Dihydropyrimidine dehydrogenase [NADP+] precursor (DPD) (DHPDHase) (Dihydrouracil dehydrogenase) (Dihydrothymine dehydrogenase) | Hs.1602 | 497-502 Score = 21.8 bits (44), Expect = 106 Identities = 5/6 (83%), Positives = 6/6 (100%) Query: 2 KQSSWY 7 KQ+SWY Sbjct: 497 KQASWY 502 | Higher DPD activity in gastric cancer is observed than in colorectal cancer |
| 4G8 | gi\|15778776\|gb\|AC012363.6\|, Homo sapiens BAC clone RP11-438O12 from 2, complete sequence | PEGGTDA SR (SEQ ID NO: 36) | 9 AA | gi\|13634077\|sp\|Q9Y493\| ZAN_HUMAN, Zonadhesin | Hs.307004 | 1912-1919 Score = 18.9 bits (37), Expect = 827 Identities = 6/8 (75%), Positives = 7/8 (87%) Query: 2 EGGTDASR 9 EGGT+A R Sbjct: 1912 EGGTEAFR 1919 | zonadhesin functions during fertilization to anchor the acrosomal shroud to the zona pellucida |
| 2E10 | gi\|20521965\|dbj\|AB051476.2\|, Homo sapiens mRNA for KIAA1689 protein, partial cds | ASFTLKL QS (SEQ ID NO: 37) | 9 AA | gi\|6226869\|sp\|P34932\| HS74_HUMAN, HEAT SHOCK 70 KDA PROTEIN 4 (HEAT SHOCK 70-RELATED PROTEIN APG-2) | Hs.90093 | 647-653 Score = 21.8 bits (44), Expect = 106 Identities = 6/7 (85%), Positives = 7/7 (100%) Query: 2 SFTLKLQ 8 SFTLKL+ Sbjct: 647 SFTLKLE 653 | Expression of HSP70 is observed in human hepatocellular carcinoma |
| 2D1 | gi\|4504522\|ref\|NM_002157.1\|, Homo sapiens heat shock 10 kDa protein 1 (chaperonin 10) (HSPE1), mRNA | GGGSNG RTSV (SEQ ID NO: 38) | 10 AA | gi\|20137621\|sp\|O95071\| EDD_HUMAN, Ubiquitin-protein ligase EDD (Hyperplastic discs protein homolog) (hHYD) (Progestin induced protein) | Hs.94262 | 140-148 Score = 21.8 bits (44), Expect = 105 Identities = 7/9 (77%), Positives = 9/9 (100%) Query: 1 GGGSNGRTS 9 GGGS+GR +S Sbjct: 140 GGGSSGRSS 148 | EDD, the human orthologue of the hyperplastic discs tumor suppressor gene, is amplified and overexpressed in cancer |

-continued

| Stage (I-IV) clones | Description of the genes that are in Mimotope clones | Peptide sequences of Mimotopes, in-frame with T7 10 B gene | Size of the peptide | Description of the sequences that Mimotopes mimic | Unigene # | Region of similarity of AA | Antigen expression in any type of AA cancer |
|---|---|---|---|---|---|---|---|
| 5H6 | gi|40849829|gb| AAR95625| NADH dehydrogenase subunit 4 | NSFLMTS SKPR (SEQ ID NO: 39) | 11 AA | gi|12643618|sp|O60242| BAI3_HUMAN, Brain-specific angiogenesis inhibitor 3 precursor | Hs.334087 | 694-699 Score = 20.6 bits (41), Expect = 254 Identities = 5/6 (83%), Positives = 6/6 (100%) Query: 1 NSFLMT 6 NS+LMT Sbjct: 694 NSYLMT 699 | BAI1 expression inhibit stromal vascularization in pulmonary adenocarcinoma |
| 2C1 | gi|23958536|gb|BC036216.1|, Homo sapiens cullin 4B, mRNA | ACSSTVS FIWI (SEQ ID NO: 40) | 11 AA | gi|33112422|sp|Q16827| PTPO_HUMAN Receptor-type protein-tyrosine phosphatase O precursor (Glomerular epithelial protein 1) (Protein tyrosine phosphatase U2) (PTPase U2) (PTP-U2) | Hs.160871 | 623-629 Score = 21.8 bits (44), Expect = 128 Identities = 6/7 (85%), Positives = 7/7 (100%) Query: 3 SSTVSFI 9 SST+SFI Sbjct: 623 SSTISFI 629 | Functional involvement of PTP-U2L in apoptosis subsequent to terminal differentiation of monoblastoid leukemia cells |
| 2G2 | gi|25989997|gb|AF541939.1|, His-3 integration vector pJHAM007, complete sequence | KKKKKK RVGGPLQ (SEQ ID NO: 41) | 14 AA | gi|20532388|sp|Q9NVP1| DD18_HUMAN, ATP-dependent RNA helicase DDX18 (DEAD-box protein 18) (Myc-regulated DEAD-box protein) (MrDb) | Hs.363492 | 108-115 Score = 27.4 bits (57), Expect = 2.8 Identities = 8/8 (100%), Positives = 8/8 (100%) Query: 1 KKKKKKKR 8 KKKKKKKR Sbjct: 108 KKKKKKKR 115 | The expression of MrDb is induced upon proliferative stimulation of primary human fibroblasts as well as B cells and down-regulated during terminal differentiation of HL60 leukemia cells |
| 4G9 | gi|17136149|ref|NM_014708.2|, Homo sapiens kinetochore associated 1 (KNTC1), mRNA | GPVFICS SNCFKIT (SEQ ID NO: 42) | 14 AA | gi|115892|sp|P16870|CBPH_HUMAN, Carboxypeptidase H precursor (CPH) (Carboxypeptidase E) (CPE) (Enkephalin convertase) (Prohormone processing carboxypeptidase) | Hs.75360 | 333-340 Score = 24.4 bits (50), Expect = 18 Identities = 7/8 (87%), Positives = 8/8 (100%) Query: 7 SSNCFKIT 14 SSNCF+IT Sbjct: 333 SSNCFEIT 340 | Expression of the protein product of the PCPH proto-oncogene in human tumor cell lines |

-continued

| Stage (I-IV) clones | Description of the genes that are in Mimotope clones | Peptide sequences of Mimotopes, in-frame with T7 10 B gene | Size of the peptide | Description of the sequences that Mimotopes mimic | Unigene # | Region of similarity of AA | Antigen expression in any type of AA cancer |
|---|---|---|---|---|---|---|---|
| 2E12 | gi\|22062543\|ref\|XM_170670.1\|, Homo sapiens putative transmembrane protein; homolog of yeast Golgi membrane protein Yif1p (Yip1-interacting factor) (54TM), mRNA. | APFTCWP TVATNTW E (SEQ ID NO: 43) | 15 AA | gi\|128062\|sp\|P08473\|NEP_HUMAN, Neprilysin (Neutral endopeptidase) (NEP) (Enkephalinase) (Common acute lymphocytic leukemia antigen) (CALLA) (Neutral endopeptidase 24.11) (CD10) | Hs.307734 | 167-175 Score = 23.5 bits (48), Expect = 32 Identities = 7/10 (70%), Positives = 7/10 (70%) Gaps = 1/10 (10%) Query: 6 WPTVATNTWE 15 WP VAT WE Sbjct: 167 WP-VATENWE 175 | Loss or decrease in expression of NEP has been reported in brain cancer, renal cancer and invasive bladder cancer. |
| 1B5 | gi\|12654862\|gb\|BC001275.1\| BC001275, Homo sapiens annexin A1, mRNA | TDQSSIS PGNRKAP G (SEQ ID NO: 44) | 15 AA | gi\|6707734\|sp\|Q13077\| TRA1_HUMAN, TNF receptor associated factor 1 (TRAF1) | Hs.531251 | 64-70 Score = 21.0 bits (42), Expect = 187 Identities = 6/7 (85%), Positives = 7/7 (100%) Query: 5 SISPGNR 11 SISPG+R Sbjct: 64 SISPGSR 70 | Tumor necrosis factor receptor-associated factor 1 gene overexpression in B-cell chronic lymphocytic leukemia |
| 4B2 | gi\|23272851\|gb\|BC035645.1\|, Homo sapiens, Similar to RIKEN cDNA 3830613022 gene, clone | RIMGGGI QRETWIS S (SEQ ID NO: 45) | 15 AA | gi\|20139133\|sp\|Q9BZF3\| ORP6_HUMAN, Oxysterol binding protein-related protein 6 | Hs.318775 | 906-912 Score = 21.8 bits (44), Expect = 104 Identities = 5/7 (71%), Positives = 6/7 (85%) Query: 8 QRETW IS 14 QRE W+S Sbjct: 906 QREAWVS 912 | Oxysterols are potent signaling lipids that directly bind liver X receptors (LXRs). Oxysterol-regulated function of LXRs is to control the expression of genes involved in reverse cholesterol transport, catabolism of cholesterol, and lipogenesis |
| 5C6 | gi\|22797897\|emb\|AL160171.27\|, Human DNA sequence from clone RP11-256E16 on chromosome 1, complete sequence | ICGSWGK YNLWQS SSSK (SEQ ID NO: 46) | 17 AA | gi\|12644310\|sp\|P53618\| COPB_HUMAN, Coatomer beta subunit (Beta-coat protein) (Beta-COP) | Hs.3059 | 250-257 Score = 22.3 bits (45), Expect = 93 Identities = 7/8 (87%), Positives = 7/8 (87%) Query: 8 YNLWQSSS 15 YNL QSSS Sbjct: 250 YNL LQSSS 257 | A major component of the coat of non-clathrin-coated vesicles, beta-COP, mediate membrane traffic through the Golgi complex |

-continued

| Stage (I-IV) clones | Description of the genes that are in Mimotope clones | Peptide sequences of Mimotopes, in-frame with T7 10 B gene | Size of the peptide Mimotopes mimic | Description of the sequences that peptide Mimotopes mimic | Unigene # | Region of similarity of AA | Antigen expression in any type of AA cancer |
|---|---|---|---|---|---|---|---|
| 3C8 | gi|24234687|ref|NM_004134.3|, Homo sapiens heat shock 70 kDa protein 9B (mortalin-2) (HSPA9B), nuclear gene encoding mitochondrial protein, mRNA. | EILKPEG QHMKLR SEETS (SEQ ID NO: 47) | 18 AA | gi|2493676|sp|Q12889| OGP_HUMAN, Oviduct-specific glycoprotein precursor (Oviductal glycoprotein) | Hs.1154 | 585-599 Score = 24.4 bits (50), Expect = 21 Identities = 10/15 (66%), Positives = 10/15 (66%), Gaps = 1/15 (6%) Query: 5 PEGQHMKLRSEE-TS 18 PEGQ M LR E TS Sbjct: 585 PEGQTM PLRGENLTS 599 | Oviduct specific glycoproteins are involved in variety of roles during fertilization and early embryonic development |
| 1H1 | gi|22024587|gb|AC103702.3|, Homo sapiens chromosome 17, clone RP11-357H14, complete sequence | AKARALA RRSEPCS TGKLQLR (SEQ ID NO: 48) | 21 AA | gi|12230848|sp|O95049| ZO3_HUMAN, Tight junction protein ZO-3 (Zonula occludens 3 protein) | Hs.25527 | 853-862 Score = 23.5 bits (48), Expect = 38 Identities = 8/10 (80%), Positives = 8/10 (80%) Query: 3 ARALARRSEP 12 A ALAR SEP Sbjct: 853 APALARS SEP 862 | Occludin expression in microvessels of neoplastic and non-neoplastic human brain |
| 2F10 | gi|21166212|gb|AC109584.2|, Homo sapiens chromosome 3 clone RP11-674P14, complete sequence | VQRGIGTI PSETIPV NRKRVNP P (SEQ ID NO: 49) | 23 AA | gi|118206|sp|P14416|D2DR_HUMAN, D(2) dopamine receptor | Hs.73893 | 264-270 Score = 22.7 bits (46), Expect = 56 Identities = 6/7 (85%), Positives = 7/7 (100%) Query: 14 PVNRKRV 20 PVNR+ RV Sbjct: 264 PVNRRRV 270 | Expression of dopamine receptors and transporter in neuroendocrine gastrointestinal tumor cells |
| 5C12 | gi|24430032|emb|AL939123.1| SCO939123, Streptomyces coelicolor A3(2) complete genome; segment 20/29 | VSWFPS WARSCG RQTPLGA TYKDTLL PV (SEQ ID NO: 50) | 28 AA | gi|3915660|sp|Q16850| CP51_HUMAN, Cytochrome P450 51A1 (CYPLI) (P450LI) (Sterol 14-alpha demethylase) (Lanosterol 14-alpha demethylase) (LDM) (P450-14DM) | Hs.512872 | 283-292 Score = 24.4 bits (50), Expect = 17 Identities = 8/10 (80%), Positives = 8/10 (80%) Query: 14 QTPLGATYKD 23 QT L ATYKD Sbjct: 283 QT LLDATYKD 292 | CYP2E1 protein is expressed in both tumor and normal breast tissue with an increased expression in breast tumors. |
| 2H5 | gi|18606292|gb|BC022865.1| Homo sapiens ATP synthase, H+ | DLQPPGR RWLPQQ CPGSPG | 35 AA | gi|116006|sp|P08575|CD45_HUMAN, Leukocyte common antigen precursor (L- | Hs.444324 | 40-49 Score = 23.5 bits (48), Expect = 41 | Expression of leucocyte-common antigen and large |

-continued

| Stage (I-IV) Mimotope clones | Description of the genes that are in Mimotope clones | Peptide sequences of Mimotopes, in-frame with T7 10 B gene | Size of the peptide | Description of the sequences that Mimotopes mimic | Unigene # | Region of similarity of AA | Antigen expression in any type of AA cancer |
|---|---|---|---|---|---|---|---|
| | transporting, mitochondrial F1 complex, O subunit (oligomycin sensitivity conferring protein), mRNA | RCDASVP LWSDHLP SL (SEQ ID NO: 51) | | CA) | | Identities = 8/10 (80%), Positives = 8/10 (80%) Query: 24 SVPLWSDHLP 33 SVPL SD LP Sbjct: 40 SVPLS SDPLP 49 | sialoglycoprotein on leukemic cells in B-cell chronic lymphocytic leukemia and non-Hodgkin's |
| 2F12 | gi\|10443350\|emb\|AL133264.10\| AL133264, Human DNA sequence from clone RP3-369A17 on chromosome 6p22.1-22.3 Contains ESTs, STSs, GSSs and CpG islands | RGLGPLA AACGRS GGGGGG GAGGTG SSNVNKK TPPN (SEQ ID NO: 52) | 36 AA | gi\|8928460\|sp\|O75962\| TRIO_HUMAN, Triple functional domain protein (PTPRF interacting protein) | Hs.519209 | 2232-2244 Score = 31.2 bits (66), Expect = 0.22 Identities = 11/13 (84%), Positives = 13/13 (100%) Query: 13 SGGGGGGAGGTG 25 SGGGGGG+GG+G Sbjct: 2232 SGGGGGGSGGSG 2244 | Not associated with cancer |
| 5C9 | gi\|15072584\|emb\|AL442003.8\|, Human DNA sequence from clone RP11-324H6 on chromosome 10, complete sequence | PMRCSC TMGEIQM QIHCGAR RRKAVPS SKDNVQS SAH (SEQ ID NO: 53) | 37 AA | gi\|34395516\|sp\|O15085\| ARHB_HUMAN, Rho guanine nucleotide exchange factor 11 (PDZ-RhoGEF) | Hs.371602 | 409-417 Score = 23.1 bits (47), Expect = 72 Identities = 7/9 (77%), Positives = 7/9 (77%) Query: 8 MGEIQMQIH 16 M EIQ QIH Sbjct: 409 MPEIQEQIH 417 | A novel gene at 11q23 named LARG for leukemia-associated Rho guanine nucleotide exchange factor (GEF) has strong sequence homology to several members of the Rho family of GEFs. Further, LARG was found to be fused with MLL |

-continued

| Stage (I-IV) | Description of the genes that are in Mimotope clones | Peptide sequences of Mimotopes, in-frame with T7 10 B gene | Size of the peptide | Description of the sequences that Mimotopes mimic | Unigene # | Region of similarity of AA | Antigen expression in any type of AA cancer |
|---|---|---|---|---|---|---|---|
| | | | | | | | in a patient with primary Rho GEF, Bcr, has been implicated in leukemia through a recurrent chromosomal translocation. |
| 5F9 | gi\|18693518\|gb\|AC015911.8\|, Homo sapiens chromosome 17, clone RP11-1094M14, complete sequence | WRTTYISI LNLAQFY YSLITVLK TFNWPG TVVHACN PSTLGGQ GRRIT (SEQ ID NO: 54) | 48 AA | gi\|20139105\|sp\|Q99959\| PKP2_HUMAN, Plakophilin 2 | Hs.25051 | 471-492 Score = 47.4 bits (111), Expect = 5e-06 Identities = 19/22 (86%), Positives = 19/22 (86%) Query: 27 WPGTVVHACNPSTLGGQG RRIT 48 WPG V HACNPSTLGGQG RIT Sbjct: 471 WPGAVAHACNPSTLGGQG GRIT 492 | Immunohistochemical localization of plakophilins (PKP1, PKP2, PKP3, and p0071) in primary oropharyngeal tumors |

TABLE 6B

Description of Stage II-IV clones.
Size range of the Mimotopes ≥5 amino acids

| Stage (II-IV) clones | Description of the genes that are in-frame with T7 10B gene | Peptide sequences of Epitopes in-frame with T7 10 B gene | Size of the peptide | Unigene # | Serex Y/N mRNA | Region of similarity of AA | Antigen expression in any type of cancer |
|---|---|---|---|---|---|---|---|
| 3H1 | gi\|12654010\|gb\|BC000805.1\| *Homo sapiens* nuclear ubiquitous casein kinase and cyclin-dependent kinase substrate, mRNA | DDDSDYGSSKKKN XKMVKKSKPERKE KKMPKPRLKATVT PSPVKGKGKVGRP TASKASKEKTPSP KEEDEEPESPPEK KTSISPPPEKSGD EGSEDEAPSGED (SEQ ID NO: 55) | 103 AA | Hs.510265 | N | 140-243 | The expressions of casein kinase II (CK2) is higher in neoplastic ovarian surface epithelium. Casein kinase II (CK II) is expressed at a higher level in lung tumors. |
| 2B3 | gi\|7023439\|dbj\|AK001891.1\|, *Homo sapiens* cDNA FLJ11029 fis, clone PLACE1004156 | LSTSSFDEQN (SEQ ID NO: 56) | 10 AA | Hs.528654 | N | 350-360 | Not associated with cancer |

The table above are two antigens and not mimotopes, the clones below are the mimotopes.

| Stage (II-IV) clones | Description of the genes that are in Mimotope clones | Peptide sequences of the Mimotopes that are in-frame with T7 of the 10 B gene | Size peptide | Description of the sequences that Mimotopes mimic | Unigene # | Region of similarity of AA | Antigen expression in any type of AA cancer |
|---|---|---|---|---|---|---|---|
| 2B9 | gi\|28837315\|gb\|BC047588.1\| Homo sapiens KIAA1363 protein, mRNA | VIVVLIAVISF PQNYTWL (SEQ ID NO: 57) | 18 AA | gi\|20141211\|sp\|P18825\| A2AC_HUMAN, Alpha-2C-adrenergic receptor (Alpha-2C adrenoceptor) (Subtype C4) | Hs.123022 | 172-185 Score = 24.8 bits (51), Expect = 16 Identities = 10/14 (71%), Positives = 10/14 (71%), Gaps = 3/14 (21%) Query: 2 IVV----LI-AVISFP 12 IV LI AVISFP Sbjct: 172 IVAVWLISAVISFP 185 | Stimulation of alpha2-adrenergic receptor inhibits cholangiocarcinoma growth through modulation of Raf-1 and B-Raf activities. Beta adrenergic receptor is overexpressed in pulmonary adenocarcinoma |
| 2C12 | gi\|15072584\|emb\|AL442003.8\|, Human DNA sequence from clone RP11-324H6 on chromosome 10, complete sequence | PMRCSCTM GEIQMQIHC GARRRKAV PSSKDNVQ SSAH (SEQ ID NO: 58) | 37 AA | gi\|2851534\|sp\|Q13724\| GCS1_HUMAN, Mannosyl-oligosaccharide glucosidase (Processing A-glucosidase I) | Hs.516120 | 4-12 Score = 24.0 bits (49), Expect = 40 Identities = 7/9 (77%), Positives = 8/9 (88%) Query: 18 GARRRKAVP 26 G RRR+AVP Sbjct: 4 GERRRRAVP 12 | Not associated with cancer |
| 2D7 | gi\|34882281\|ref\|XM_236768.2\|, Rattus norvegicus hypothetical LOC316116 (LOC316116), mRNA | LRGTSGVQP PEIEQ (SEQ ID NO: 59) | 14 AA | gi\|32172435\|sp\|P46934\| NED4_HUMAN, Ubiquitin-protein ligase Nedd-4 | Hs.1565 | 514-520 Score = 22.7 bits (46), Expect = 70 Identities = 6/7 (85%), Positives = 6/7 (85%) Query: 8 QPPEIEQ 14 QP EIEQ Sbjct: 514 QPSEIEQ 520 | RING protein Trim32 associated with skin carcinogenesis has E3-ubiquitin ligase properties |
| 2D12 | gi\|34783327\|gb\|BC022049.2\|, Homo sapiens cDNA clone IMAGE: 4291567, partial cds | ILHLH (SEQ ID NO: 60) | 5 AA | gi\|128616\|sp\|P23975\| S6A2_HUMAN, Sodium-dependent noradrenaline transporter (Norepinephrine transporter) (NET) | Hs.78036 | 218-222 Score = 17.6 bits (34), Expect = 2425 Identities = 4/5 (80%), Positives = 5/5 (100%) Query: 1 ILHLH 5 +LHLH Sbjct: 218 VLHLH 222 | NET is involved in neurotransmitter removal from neuronal synapses |

| Stage (II-IV) clones | Description of the genes that are in Mimotope clones | Peptide sequences of the Mimotopes that are in-frame with T7 of the 10 B gene | Size of the peptide Mimotope | Description of the sequences that Mimotope mimic | Unigene # | Region of similarity of AA | Antigen expression in any type of AA cancer |
|---|---|---|---|---|---|---|---|
| 2E7 | gi\|6330364\|dbj\|AB033020.1\|, Homo sapiens mRNA for KIAA1194 protein | VLSALPEKN CNTVPFQPP EDLRYQHC SSRFLE (SEQ ID NO: 61) | 32 AA | gi\|34395825\|sp\|Q9H106\| PTL2_HUMAN Protein tyrosine phosphatase non-receptor type substrate 1-like 2 precursor | Hs.339789 | 167-174 Score = 24.4 bits (50), Expect = 21 Identities = 7/8 (87%), Positives = 8/8 (100%) Query: 2 LSALPEKN 9 LSALPE+N Sbjct: 167 LSALPERN 174 | Protein-tyrosine phosphatase (SAP-1) is overexpressed in gastrointestinal cancer |
| 2G10 | gi\|16307467\|gb\|BC010282.1\|, Homo sapiens leucine-rich PPR-motif containing, mRNA | WGFNERDR LSSILQQRC VTL (SEQ ID NO: 62) | 20 AA | gi\|13638201\|sp\|P41214\| LIGA_HUMAN, Ligatin (Hepatocellular carcinoma-associated antigen 56) | Hs.274151 | 523-528 Score = 24.0 bits (49), Expect = 29 Identities = 6/6 (100%), Positives = 6/6 (100%) Query: 12 ILQQRC 17 ILQQRC Sbjct: 523 ILQQRC 528 | CD15 and CD50 antigens are both overexpressed in hepatocarcinoma. |
| 2G11 | gi\|7329921\|emb\|AL117379.14\| HSJ563E14, Human DNA sequence from clone RP4-563E14 on chromosome 20 Contains the 5' of the DATF1 gene encoding the death associated transcription factor 1, the 5' end of a novel gene, ESTs, STSs, GSSs and four CpG islands, complete sequence. | VVSGFFSTF SL (SEQ ID NO: 63) | 11 AA | gi\|1705762\|sp\|P13569\| CFTR_HUMAN, Cystic fibrosis transmembrane conductance regulator (CFTR) | Hs.521149 | 429-435 Score = 21.8 bits (44), Expect = 128 Identities = 6/7 (85%), Positives = 6/7 (85%) Query: 5 FFSTFSL 11 FFS FSL Sbjct: 429 FFSNFSL 435 | Mutation of CFTR is observed in Cystic Fibrosis |
| 2H8 | gi\|5714635\|gb\|AF159295.1\| AF159295, Homo sapiens serine/threonine protein kinase Kp78 splice variant CTAK75a mRNA | LTRPGHGQ D (SEQ ID NO: 64) | 9 AA | gi\|2499758\|sp\|Q92729\| PTPU_HUMAN, Receptor-type protein-tyrosine phosphatase U precursor (R-PTP-U) (Protein-tyrosine phosphatase J) (PTP-J) (Pancreatic carcinoma phosphatase 2) PCP-2 | Hs.19718 | 355-361 Score = 19.3 bits (38), Expect = 748 Identities = 6/7 (85%), Positives = 6/7 (85%) Query: 1 LTRPGHG 7 LTRPG G Sbjct: 355 LTRPGDG 361 | A potential role of PCP-2 in cell-cell recognition and adhesion is supported by its co-localization with cell adhesion molecules, such as catenin and |

-continued

| Stage (II-IV) clones | Description of the genes that are in Mimotope clones | Peptide sequences of the Mimotopes that are in-frame with T7 of the 10 B gene | Size peptide | Description of the sequences that Mimotopes mimic | Unigene # | Region of similarity of AA | Antigen expression in any type of AA cancer |
|---|---|---|---|---|---|---|---|
| | | | | | | | E-cadherin, at sites of cell-cell contact. |
| 4C5 | gi\|19683998\|gb\|BC025957.1\| Homo sapiens coated vesicle membrane protein, mRNA | LYINEMKSK KL (SEQ ID NO: 65) | 11 AA | gi\|417216\|sp\|P33176\| KINH_HUMAN, Kinesin heavy chain (Ubiquitous kinesin heavy chain) (UKHC) | Hs.512922 | 592-599 Score = 22.3 bits (45), Expect = 95 Identities = 6/8 (75%), Positives = 8/8 (100%) Query: 1 LYINEMKS 8 LYI++ MKS Sbjct: 592 LYISKMKS 599 | Kinesin-1 links neurofibromin and merlin in a common cellular pathway of neurofibromatosis |
| 4H6 | gi\|22773353\|gb\|AC007998.10\|, Homo sapiens chromosome 18, clone RP11-322E11, complete sequence | LPQCPSRG SL (SEQ ID NO: 66) | 10 AA | gi\|1352515\|sp\|P48745\| NOV_HUMAN, NOV protein homolog precursor (NovH) (Nephroblastoma overexpressed gene protein homolog) | Hs.235935 | 37-42 Score = 20.2 bits (40), Expect = 414 Identities = 5/6 (83%), Positives = 5/6 (83%) Query: 2 PQCPSR 7 PQCP R Sbjct: 37 PQCPGR 42 | Altered expression of novH is associated with human adrenocortical tumorigenesis |
| 5A2 | gi\|40788180\|emb\|AJ583821.2\|, Homo sapiens mRNA for ubiquitin specific proteinase 40 (USP40 gene) | PGWDCRLP EAESCRFLL SSRGED (SEQ ID NO: 67) | 23 AA | gi\|21759008\|sp\|Q96CA5\| BIR7_HUMAN, Baculoviral IAP repeat-containing protein 7 (Kidney inhibitor of apoptosis protein) (KIAP) (Melanoma inhibitor of apoptosis protein) (ML-IAP) (Livin) | Hs.256126 | 150-159 Score = 22.7 bits (46), Expect = 68 Identities = 7/10 (70%), Positives = 9/10 (90%) Query: 12 SCRFLLSRG 21 SC+FLL S+G Sbjct: 150 SCQFLLRSKG 159 | ML-IAP, a novel inhibitor of apoptosis, is preferentially expressed in human melanomas |
| 5A7 | gi\|16508181\|emb\|AL138765.18\|, Human DNA sequence from clone RP11-34E5 on chromosome 10, complete sequence | KKMRTKM (SEQ ID NO: 68) | 7 AA | gi\|30580423\|sp\|Q8IX29\| FX16_HUMAN, F-box only protein 16 (SEQ ID NO: 174) | Hs.511876 | 14-19 Score = 20.6 bits (41), Expect = 310 Identities = 5/6 (83%), Positives = 6/6 (100%) Query: 2 KMRTKM 7 KM+TKM Sbjct: 14 KMQTKM 19 | A high expression level of F-box protein, Skp2 is observed in diffuse large cell B lymphoma. |

-continued

| Stage (II-IV) clones | Description of the genes that are in Mimotope clones | Peptide sequences of the Mimotopes that are in-frame with T7 of the 10 B gene | Size of the peptide Mimotopes mimic | Description of the sequences that Mimotopes mimic | Unigene # | Region of similarity of AA | Antigen expression in any type of AA cancer |
|---|---|---|---|---|---|---|---|
| 5B9 | gi\|27469381\|gb\|BC042411.1\|, Mus musculus, clone IMAGE: 414861, mRNA | QIDSSFSIP WVVHGRS (SEQ ID NO: 69) | 17 AA | gi\|126885\|sp\|P08235\| MCR_HUMAN, Mineralocorticoid receptor (MR) | Hs.331409 | 420-426 Score = 22.3 bits (45), Expect = 93 Identities = 6/7 (85%), Positives = 7/7 (100%) Query: 3 DSSFSIP 9 DSSFS+P Sbjct: 420 DSSFSVP 426 | Glucocorticoid and mineralocorticoid cross-talk with progesterone receptor to induce focal adhesion and growth inhibition in breast cancer cells |
| 5B12 | gi\|34996477\|tpg\|BK001418.1\|, TPA: Homo sapiens metastasis associated in lung adenocarcinoma transcript 1 long isoform, transcribed non-coding RNA, complete sequence | GGRRSLRK PQISFFLFER (SEQ ID NO: 70) | 18 AA | gi\|34223735\|sp\|Q08462\| CYA2_HUMAN, Adenylate cyclase, type II (ATP pyrophosphate-lyase) (Adenylyl cyclase) | Hs.414591 | 136-142 Score = 24.4 bits (50), Expect = 21 Identities = 6/7 (85%), Positives = 7/7 (100%) Query: 10 QISFFLF 16 Q+SFFLF Sbjct: 136 QVSFFLF 142 | In human Y-79 retinoblastoma cells, corticotropin-releasing hormone (CRH) stimulates adenylyl cyclase activity and increases cyclic AMP accumulation |
| 5D6 | gi\|16741726\|gb\|BC016660.1\|, Homo sapiens heat shock 70 kDa protein 8, transcript variant 1, mRNA | GIRVEPPTR TIS (SEQ ID NO: 71) | 12 AA | gi\|6226869\|sp\|P34932\| HS74_HUMAN, HEAT SHOCK 70 KDA PROTEIN 4 (HEAT SHOCK 70-RELATED PROTEIN APG-2) (HSP70RY) | Hs.90093 | 316-328 Score = 21.0 bits (42), Expect = 229 Identities = 6/9 (66%), Positives = 8/9 (88%) Query: 3 RVEPPTRTI 11 RVEPP R++ Sbjct: 316 RVEPPLRSV 324 | Expression of HSP70 is observed in human hepatocellular carcinoma |

| Stage (II-IV) clones | Description of the genes that are in Mimotope clones | Peptide sequences of the Mimotopes that are in-frame with T7 of the 10 B gene | Size peptide | Description of the sequences that Mimotopes mimic | Unigene # | Region of similarity of AA cancer | Antigen expression in any type of AA cancer |
|---|---|---|---|---|---|---|---|
| 5E3 | gi\|40849693\|gb\|AY495321.1\|, Homo sapiens isolate V1-16 mitochondrion, complete genome | RNRYSTARER (SEQ ID NO: 72) | 10 AA | gi\|2501463\|sp\|Q93008\| FAFX_HUMAN, Probable ubiquitin carboxyl-terminal hydrolase FAF-X | Hs.77578 | 1356-1361 Score = 21.4 bits (43), Expect = 172 Identities = 6/6 (100%), Positives = 6/6 (100%) Query: 5 STARER 10 STARER Sbjct: 1356 STARER 1361 | Oxidative Modifications and Down-regulation of Ubiquitin Carboxyl-terminal Hydrolase L1 Associated with Idiopathic Parkinson's and Alzheimer's Diseases. |
| 5H8 | gi\|13273214\|gb\|AAK17820\|, cytochrome c oxidase subunit I [Homo sapiens] | GKRHIGGTDY (SEQ ID NO: 73) | 10 AA | gi\|41713338\|sp\|Q8N690\| D119_HUMAN Beta-defensin 119 precursor (Beta-defensin 19) (DEFB-19) | Corresponding Unigene number is not found | Score = 19.3 bits (38), Expect = 550 Identities = 5/5 (100%), Positives = 5/5 (100%) Query: 1 GKRHI 5 GKRHI Sbjct: 21 GKRHI 25 | The expression of human beta-defensin genes in oral squamous cell carcinomas (SCCs) was demonstrated by in situ hybridization. |
| 5A4 | gi\|17149463\|gb\|AC068228.8\|, Homo sapiens chromosome 8, clone RP11-539E17, complete sequence | VVSQLTAEMRLE (SEQ ID NO: 74) | 12 AA | gi\|129825\|sp\|P05164\| PERM_HUMAN, Myeloperoxidase precursor (MPO) | Hs.458272 | 23-29 Score = 22.7 bits (46), Expect = 71 Identities = 6/7 (85%), Positives = 7/7 (100%) Query: 5 LTAEMRL 11 LTAEM+L Sbjct: 23 LTAEMKL 29 | Myeloperoxidase immunoreactivity is observed in adult acute lymphoblastic leukemia |
| 5E7 | gi\|4885510\|ref\|NM_005381.1\|, Homo sapiens nucleolin (NCL), mRNA | RACQRSTWKTKEGNGQTESSS (SEQ ID NO: 75) | 21 AA | gi\|25453064\|sp\|Q9UPT6\| JIP3_HUMAN, C-jun-amino-terminal kinase interacting protein 3 (JNK-interacting protein 3) (JIP-3) | Hs.514335 | 192-199 Score = 23.1 bits (47), Expect = 51 Identities = 7/8 (87%), Positives = 7/8 (87%) Query: 13 GNGQTESS 20 GN QTESS Sbjct: 192 GNSQTESS 199 | JNK interacting protein (JIP) can inhibit JNK signaling pathway in NPC cell (nasopharyngeal carcinoma) |

FF

REFERENCES

1. Alizadeh A A, et al. Distinct types of diffuse large B-cell lymphoma identified by gene expression profiling. Nature 403:503-511, (2000).
2. An, A, et al. A learning system for more accurate classifications. Lecture Notes in Artificial Intelligence, Vancouver. 1418:426-441, (1998).
3. Aunoble B, et al. Major oncogenes and tumor suppressor genes involved in epithelial ovarian cancer. Int J Oncol 16:567-76, (2000).
4. Baron A T, et al. Serum sErbB1 and Epidermal Growth Factor Levels As Tumor Biomarkers in Women with Stage III or IV Epithelial Ovarian Cancer Epidemiology. Biomarkers & Prevention 8:129-137, 1999.
5. Bauer R, et al. Cloning and characterization of the *Drosophila* homologue of the AP-2 transcription factor. Oncogene 17:1911-1922 (1998).
6. Bast R C, et al. Reactivity of a monoclonal antibody with human ovarian carcinoma. J. Clin Invest 68:1331-1337 (1981).
7. Bast R C et al. A radioimmunoassay using a monoclonal antibody to monitor the course of epithelial ovarian cancer. N Engl J Med 309: 883-887 (1983).
8. Berek, J S et al. Serum interleukins-6 levels correlate with disease status in patients with epithelial ovarian cancer. Am J Obstet Gynecol 164: 1038-1043 (1991).
9. Bittner, M et al. Molecular Classification of Cutaneous Malignant Melanoma by Gene Expression Profiling. Nature 406:536-540 (2000).
10. Blake C, et al. UCI respitory of machine learning databases (1998).
11. Boyd J, et al. Molecular genetic and clinical implications [Review]. Gynecol Oncol 64:196-206 (1997).
12. Breiman L, et al. Classification and regression trees, Wadsworth and Brooks (1984).
13. Buettner R, et al. An alternatively spliced form of AP-2 encodes a negative regulator of transcriptional activation by AP-2. Mol. Cell Biol 13:4174-4185 (1993).
14. Chiao P J, et al. Elevated expression of the human ribosomal S2 gene in human tumors. Molecular Carcinogenesis 5:219-231 (1992).
15. Clark P, et al. The CN2 induction algorithm. Machine Learning 3:261-283 (1989).
16. Coleman M P, et al. Trends in cancer incidence and mortality. Lyon, France: IARC Scientific Publications 121:477-498 (1993).
17. Deyo J, et al. A novel protein expressed at high cell density but not during growth arrest. DNA and Cell Biol 17:437-447 (1998).
18. Draghici S. The Constraint Based Decomposition, accepted for publication in Neural Networks, to appear (2001).
19. Einhorn, N. et al. Prospective evaluation of serum CA 125 levels for early detection of ovarian cancer. Obstet Gynecol 80:14-18 (1992).
20. Golub T R, et al. Molecular classification of cancer: class discovery and class prediction by gene expression monitoring. Science 286:531-537 (1999).
21. Gotlieb W H, et al. Presence of interleukins in the ascites of patients with ovarian and other intra-abdominal cancers. Cytokine 4:385-390 (1992).
22. Greenlee R T, et al. Cancer Statistics. CA Cancer J Clin 50:7-33 (2000).
23. Heath, S. et al. Induction of oblique decision tree. In IJCAI-93. Washington, D.C. (1993).
24. Hogdall E V, et al. Predictive values of serum tumor markers tetranectin, OVX1, CASA and CA125 in patients with a pelvic mass. Int J serum tumor markers tetranectin, OVX1, CASA and CA125 in patients with a pelvic mass. Int J Cancer 89:519-523 (2000).
25. Holschneider C H, et al. Ovarian cancer: epidemiology, biology, and prognostic factors. Semin Surg Oncol 1:3-10 (2000).
26. Houts T M: Improved 2-Color Normalization For Microarray Analyses Employing Cyanine Dyes, CAMDA (2000). Critical Assessment of Techniques for Microarray Data Mining. Duke University Medical Center, Dec. 18-19 (2000).
27. Jacobs I J, et al. Potential screening tests for ovarian cancer, in Sharp F, Mason W P, Leake R E (eds). Ovarian Cancer. London, Chapman and Hall Medical, 197-205 (1997).
28. Jacobs, I. Et al. Multimodal approach to screening for ovarian cancer. Lancet I 268-271 (1988).
29. Jacobs I, et al. The CA 125 tumor-associated antigen: a review of the literature. Hum Reprod 4:1-12 (1989).
30. Kacinski B M et al. Macrophage colony-stimulating factor is produced by human ovarian and endometrial adenocarcinoma-derived cell lines and is present at abnormally high levels in the plasma of ovarian carcinoma patients with active disease. Cancer Cells 7:333-337 (1989).
31. Kerr, Martin, Churchill. Analysis of variance for gene expression microarray data. Journal of Computational Biology (2000).
32. Kim, S Y et al. Coordinate Control of Growth and Cytokeratin 13 Expression by Retinoic Acid. Molecular Carcinogenesis 16:6-11 (1996).
33. Kohonen T. Learning vector quantization. Neural Networks, 1 (suppl.1):303 (1988).
34. Kohonen T. Learning vector quantization. In the handbook of brain theory and neural networks pp. 537-540. Cambridge Mass.: MIT press (1995).
35. Macbeth G. et al. Printing proteins as microarrays for high-throughput function determination. Science 289: 1760-3 (2000).
36. Murthy K. On growing better decision trees from data. Unpublished doctoral dissertation. John Hopkins University (1995).
37. Musavi M. et al. On the training of radial basis functions classifiers. Neural Networks 5:595-603 (1992).
38. Patsner B. et al. Comparison of serum CA 125 and lipid associated sialic acid (LASA-P) in monitoring patients with invasive ovarian adenocarcinoma. Gynecol Oncol 30(1): 98-103 (1988).
39. Peng Y S, et al. ARHI is the center of allelic deletion on chromosome Ip31 in ovarian and breast cancers. Int J Cancer 86:690-4 (2000).
40. Precup D, et al. Classification using $/Phi$-machines and constructive function approximation. In Proc. 15th International Conf. On Machine Learning, pages 439-444. Morgan Kaufmann, San Francisco, Calif. (1998).
41. Poggio T, et al. Networks for approximation and learning. Proceedings of IEEE 78(9):1481-149 (1990).
42. Quinlan J R: C4.5: Programs for machine learning, Morgan-Kaufmann (1993).
43. Rumelhart, D E, et al. Learning internal representations by error backpropagation. Parallel Distributed Processing: Explorations in the Microstructures of Cognition, MIT Press/Bradford Books (1986).

44. Schwartz P E, et al. Circulating tumor markers in the monitoring of gynecologic malignancies. Cancer 60:353-361 (1987).
45. Schmittgen T D et al. Quantitative reverse transcription-polymerase chain reaction to study mRNA decay: comparison of endpoint and real-time methods. Anal Biochem, 285:194-204 (2000).
46. Sonoda K, Nakashima M, Kaku T, Kamura T, Nakano H, Watanabe T. A novel tumor-associated antigen expressed in human uterine and ovarian carcinomas. Cancer 1996 77:1501-9,
47. Nakashima M, Sonoda K, Watanabe T. Inhibition of cell growth and induction of apoptotic cell death by the human tumor-associated antigen RCAS1. Nat Med. 1999 5:938-42.
48. Lindstrom M S, Klangby U, Wiman K G. p14ARF homozygous deletion or MDM2 overexpression in Burkitt lymphoma lines carrying wild type p53. Oncogene. 20(17):2171-7, 2001.

SEQUENCE LISTING (197 sequences)

SEQ ID NO: 1 - DNA, 20 bp, Artificial Sequence
  T7 coat protein forward primer
tcttcgcccagaagctgcag

SEQ ID NO: 2 - DNA, 22 bp, Artificial Sequence
  T7 coat protein reverse primer
cctcctttcagcaaaaaacccc

SEQ ID NO: 3 - DNA, 14 bp, Artificial Sequence
  EcoRI/HindIII Directional Linker
gcttgaattcaagc

SEQ ID NO: 4 - DNA, 6 bp, Artificial Sequence
  HindIII site
aagctt

SEQ ID NO: 5 - DNA, 8 bp, Artificial Sequence
  HindIII random primer
  misc_feature (3)..(8): n is a, c, g, or t
ttnnnnnn

SEQ ID NO: 6 - DNA, 17 bp, Artificial Sequence
  T7 forward primer
tcttcgcccagaagcag

SEQ ID NO: 7 - DNA, 20 bp, Artificial Sequence
  T7 reverse primer
cctccttcagcaaaaacccc

SEQ ID NO: 8 - DNA, 21 bp, Artificial Sequence
  forward PCR primer
gttctatccgcaacgttatgg

SEQ ID NO: 9 - DNA, 22 bp, Artificial Sequence
  reverse PCR primer
ggaggaaagtcgttttttgggg

SEQ ID NO: 10 - DNA, 20 bp, Artificial Sequence
  forward Sequencing primer
tgctaaggacaacgttatcg

SEQ ID NO: 11 - protein, 25 aa, Homo sapiens
AAWQAEEVLRQQKLADREKRAAEQQ

SEQ ID NO: 12 - protein, 212 aa, Homo sapiens
  MISC_FEATURE (23)..(23): Xaa can be any naturally occurring amino acid
EKGGQEKQGEVIVSIEEKPKEVXEEQPVVTLEKQGTAVEVEAESLDPTVKPVDVGGDEPEEKVVTSENEAGKAVLEQLVGQEVPPAEESPEVTTEAAEASAVEAGSEVSEKPGQEAPVLPKDGAVNGPSVVGDQTPIEPQTSIERLTETKDGSGLEEKVRAKLVPSQEETKLSVEESEAAGDGVDTKVAQGATEKSPEDKVQIAANEETQER

SEQ ID NO: 13 - protein, 15 aa, Homo sapiens
EKGGQEKQGEVIVSI

SEQ ID NO: 14 - protein, 148 aa, Homo sapiens
MADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEHKFDCGEQILITVLSAMTEEALVA

SEQ ID NO: 15 - protein, 25 aa, Homo sapiens
QKTGGADQSLQQGEGSKKGKGKKKK

SEQ ID NO: 16 - protein, 68 aa, Homo sapiens
ALQAKSDEKAAVAGKKPVVGKKGKKAAVGVKKQKKPLVGKKAAATKKPSPEKKPAENKPTTEDNKPAA

SEQ ID NO: 17 - protein, 86 aa, Homo sapiens
QQQQQQQHQASSNSGSEEDSSSSEDSDDSSSEVKRKKHKDEDWQMSGSGSPSQSGSDSESEEEREKSSCDETESDYEPKNKVKSRK

SEQ ID NO: 18 - protein, 101 aa, Homo sapiens
  MISC_FEATURE (80)..(100): Xaa can be any naturally occurring amino acid
PTKLPSINKSKDRASQQQQTNSIRNYFQPSTKKRERDEENQEMSSCKSARIETSCSLLEQTQPATPSLWKNKEQHLSENXPVDTXSXXNLFTGYXFRXGXE

SEQ ID NO: 19 - protein, 118 aa, Homo sapiens
MADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLPLPEGD

SEQ ID NO: 20 - protein, 121 aa, Homo sapiens
PKFKMPDVHFKSPQISMSDIDLNLKGPKIKGDMDISVPKLEGDLKGPKVDVKGPKVGIDTPDIDIHGPEGKLKGPKFKMPDLHLKAPKISMPEVDLNLKGPKVKGDMDISLPKVEGDLKGP

SEQ ID NO: 21 - protein, 173 aa, Homo sapiens
  misc_feature (127)..(173): Xaa can be any naturally occurring amino acid
GVCSSKVYVGKNTSEVKEDVVLGKSNQVCQSSGNHLENKVTHGLVTVEGQLTSDERGAHIMNSTCAAMPKLHEPYASSQCIASPNFGTVSGLKPASMLEKNCSLQTELNKSYDVKNPSPLLMQNQNXRQQMDTPMVSCGNEQFLDNSFEKXKRXLDLXIDGXQKXXCPXVXXX

SEQ ID NO: 22 - protein, 5 aa, Homo sapiens
ELLRT

SEQ ID NO: 23 - protein, 5 aa, Homo sapiens
GQTSM

SEQ ID NO: 24 - protein, 5 aa, Homo sapiens
KKGPI

SEQ ID NO: 25 - protein, 6 aa, Homo sapiens
AKVIMR

SEQ ID NO: 26 - protein, 6 aa, Homo sapiens
YACLKD

SEQ ID NO: 27 - protein, 7 aa, Homo sapiens
QILFMDP

SEQ ID NO: 28 - protein, 8 aa, Homo sapiens
LNTVNTLI

SEQ ID NO: 29 - protein, 8 aa, Homo sapiens
GNSILLIA

SEQ ID NO: 30 - protein, 8 aa, Homo sapiens
WDLKSEYS

SEQ ID NO: 31 - protein, 8 aa, Homo sapiens
PGCSTTLS

SEQ ID NO: 32 - protein, 8 aa, Homo sapiens
PRCSTTLS

SEQ ID NO: 33 - protein, 9 aa, Homo sapiens
GDRSQLWRK

SEQ ID NO: 34 - protein, 9 aa, Homo sapiens
KKQSSWYQI

SEQ ID NO: 35 - protein, 9 aa, Homo sapiens
KKQSSWYQI

SEQ ID NO: 36 - protein, 9 aa, Homo sapiens
PEGGTDASR

SEQ ID NO: 37 - protein, 9 aa, Homo sapiens
ASFTLKLQS

SEQ ID NO: 38 - protein, 10 aa, Homo sapiens
GGGSNGRTSV

SEQ ID NO: 39 - protein, 11 aa, Homo sapiens
NSFLMTSSKPR

SEQ ID NO: 40 - protein, 11 aa, Homo sapiens
ACSSTVSFIWI

SEQ ID NO: 41 - protein, 14 aa, Homo sapiens
KKKKKKKRVGGPLQ

SEQ ID NO: 42 - protein, 14 aa, Homo sapiens [sequence omitted]

SEQ ID NO: 43 - protein, 15 aa, Homo sapiens
APFTCWPTVATNTWE

SEQ ID NO: 44 - protein, 15 aa, Homo sapiens
TDQSSISPGNRKAPG

SEQ ID NO: 45 - protein, 15 aa, Homo sapiens
RIMGGGIQRETWISS

SEQ ID NO: 46 - protein, 16 aa, Homo sapiens
CGSWGKYNLWQSSSSK

SEQ ID NO: 47 - protein, 18 aa, Homo sapiens
EILKPEGQHMKLRSEETS

SEQ ID NO: 48 - protein, 21 aa, Homo sapiens
AKARALARRSEPCSTGKLQLR

SEQ ID NO: 49 - protein, 23 aa, Homo sapiens
VQRGIGTIPSETIPVNRKRVNPP

SEQ ID NO: 50 - protein, 28 aa, Homo sapiens
VSWFPSWARSCGRQTPLGATYKDTLLPV

SEQ ID NO: 51 - protein, 35 aa, Homo sapiens
DLQPPGRRWLPQQCPGSPGRCDASVPLWSDHLPSL

SEQ ID NO: 52 - protein, 36 aa, Homo sapiens
RGLGPLAAACGRSGGGGGGGAGGTGSSNVNKKTPPN

SEQ ID NO: 53 - protein, 37 aa, Homo sapiens
PMRCSCTMGEIQMQIHCGARRRKAVPSSKDNVQSSAH

SEQ ID NO: 54 - protein, 48 aa, Homo sapiens [sequence omitted]

SEQ ID NO: 55 - protein, 103 aa, Homo sapiens
  misc_feature (14)..(14): Xaa can be any naturally occurring amino acid
DDDSDYGSSKKKNXKMVKKSKPERKEKKMPKPRLKATVTPSPVKGKGKVGRPTASKASKEKTPSPKEEDEEPESPPEKKTSISPPPEKSGDEGSEDEAPSGED

SEQ ID NO: 56 - protein, 10 aa, Homo sapiens
LSTSSFDEQN

SEQ ID NO: 57 - protein, 18 aa, Homo sapiens
VIVVLIAVISFPQNYTWL

SEQ ID NO: 58 - protein, 37 aa, Homo sapiens; identical to SEQ ID NO: 53

SEQ ID NO: 59 - protein, 14 aa, Homo sapiens
LRGTSGVQPPEIEQ

SEQ ID NO: 60 - protein, 5 aa, Homo sapiens
ILHLH

SEQ ID NO: 61 - protein, 32 aa, Homo sapiens
VLSALPEKNCNTVPFQPPEDLRYQHCSSRFLE

SEQ ID NO: 62 - protein, 20 aa, Homo sapiens [sequence omitted]

SEQ ID NO: 63 - protein, 11 aa, Homo sapiens
VVSGFFSTFSL

SEQ ID NO: 64 - protein, 9 aa, Homo sapiens
LTRPGHGQD

SEQ ID NO: 65 - protein, 11 aa, Homo sapiens
LYINEMKSKKL

SEQ ID NO: 66 - protein, 10 aa, Homo sapiens
LPQCPSRGSL

SEQ ID NO: 67 - protein, 23 aa, Homo sapiens [sequence omitted]

SEQ ID NO: 68 - protein, 7 aa, Homo sapiens
KKMRTKM

SEQ ID NO: 69 - protein, 17 aa, Homo sapiens
QIDSSFSIPWVVVHGRS

SEQ ID NO: 70 - protein, 18 aa, Homo sapiens
GGRRSLRKPQISFFLFER

SEQ ID NO: 71 - protein, 12 aa, Homo sapiens
GIRVEPPTRTIS

SEQ ID NO: 72 - protein, 10 aa, Homo sapiens
RNRYSTARER

SEQ ID NO: 73 - protein, 10 aa, Homo sapiens
GKRHIGGTDY

SEQ ID NO: 74 - protein, 12 aa, Homo sapiens
VVSQLTAEMRLE

SEQ ID NO: 75 - protein, 21 aa, Homo sapiens
RACQRSTWKTKEGNGQTESSS

SEQ ID NO: 76-100 - skipped (25 entries)

SEQ ID NO: 101 - DNA, 159758 bp, Homo sapiens
aagcttctcaagggtctctgaactcccctgcatgggtttgaagatttttgaaatcttgcttatatttgactggggaattctttacgatagacattcttcctgtcaaaccttattttggggattcccattcactctaaatttcctcaaaactttgtagtcagggatacttcaaagctaagaggaggtgctctttccaacacccttatcatctgtggtttgaggacccagcagtctcatgttcccattaatcttttaggagctgtgtgccatatgtcctgcagaccgtggtttacttcctactctggaggaagatttgtttcagaccctcaccgacatctcctcagtaatatcccagggcatataaatcactgggaagcaaagggagctgtgtcctctgatgaaaggaaggagcagtccttctggaggagggagtttgtcttccaggaaccttcctcagccattggtctgtgaatttcaaagctgacctaaacaagcaaaatcaaaacaccataaaatgcccattatgctgcaaggaagaaaactcctttaacttttttcagtcaagccctctgcttccattgtataaataagatagtctcgtgttgtagaattttgaaatggattgcatgaggaaatatgcacataggagttgtatactctcacagagtattctttggaccaacagttattgagaagacctgctaacatgtaggctgcagaataccgattgtgaagttgctgtgggctttctgtggttgaatccctggctcacacctagtcagaagacatctcatggttattcaaccagagacctgaaggtggcacctggtgctcatacccatgatttgatagttagtggtagcctgactttaggacaaaaacagtctttaggtgctcaataaataaagtcataaaagtaagtttacaccaataattttaagtcataattttgatcctaccaggaaaatagttcagactcctgtcatagtgtataggattttaatttctgatactctgaaaccacttttgtcagaattaggcaacattattttgaaaaagtcaaaataaggaacaaagaaaacatagtagttaccacttaactaccaacaacattgagaagcctgcttcattcattcagtcaacaaatactgagtttctaacatatgccagacattataacttggtactggcaccatgtaaaatatactgaacaaaaatgtagcacagcccctgccctcaagtttacctgtggaggagatagataataagcaagtaattgcacgggtagttgtattataagcactacaaagagctatgcaggaaaggtacagttgtgctatgtgggtgtacagcagacaagtttgagaggtcaaggagggtgtctcttactgagagaccttgcctctgtgccttcaaggtgaacaggcactccctaggcaagagagtagggaatctttccaggtagaaagagcaatgtgtttgaagcttcagtgttcagagggcacgtggtcctttcagggaactaaatgccagtgcggctgtagcgccaaatgacagagggtcggagagagggctggtgaggcgatgagagaccaaacctggcaaggccccgtaggtcctatcaaggattttggtttttatcttaagagtcatgggaagtcattgcattgtttatgaaaagtacttgctgagccactgaactgcaaagaatgagtagtttgaaccccagaaagtgaattaaaatgacccctttgcaggtaaattcccttctgaaaaaatccagtaaattctcatgatctttgactcttagcagacattcgtagtcgggtcagtgtcactgctgtttcttcgcaaatggattgttttgtggggaggagagaatgacagtccttcatgtttctacagctctgtgccatttaccaagtgttttcacaggcacagtctccattcttttattcatttgttcaaacttttactgaggacctatcaggtgccaaaccctttgccctaaataaggcacaattcctgccttcaaagacttgaataaccaataaatgcagtaaagggaagataaagcctttgatcactgcaaaaattctaagggcaataagttttatgtctatttactgatgagagatttgaggcttaaagagtaatcagctaggtgacttgcaactaagcaggagcaagccggagcctaaatctgctcccatgtggtctagtcctgtttttcctacaccaggctcaagccactgtctgtcctctgaagtcttgccttggctacaaatagtagctgcctgaaagttcatcaaagcacaggttagaagagattttctgatctccgcattcacctaatgcaagaatcccttccatgacatctcaccccagaaggctcccagtgtaatagtcattacttatccagtggtggctatgagaaattttcttcttgtatcaatctgaaaactattactctgtagcatccattcattcatctttgttttgccctctgggacatcacagattgtttatttcccctcaaatacagcaacgctacaattatttgaaggcagctccaacatctttcctaagtgttcccttatccaggccaaacatttctggttccttgaatcattccttcagtaaatgcaatttccacacccatcaccacagttacccttgtgtgaacactctagtgtgttatgttcccttttaaaaatctggcagccggaattacacacagtattccaaatgtggtctaaccagctattaactccctatgcttccattaataaagtaaaagatagagttagctttttattaatgagttcagactgtctgttattattgaacttgtggtcaaccacatcccccaggtctttatcatatgacttgctatacagttgactttttgaacccaaagacaggactttacatttatcccaaataaattaagtcttgttgatattggcctagtccagcttgttgaaatcactttttaaaaaattgtgatgctgtcatctaacatattaagtattcctggtagctttatgtcatccatagatgtggtgagcgtgcattctacatgttcatccaggtcattaataaatatgttgaacaggacaagttcatggttgacatactgcagtgaatcattagacacttcccgaatgcatggggtcaatcagccagactccactctcatctagcccatgtttcttaaataagaaaatgcatctaaaatcacttttaaactatacagtataagatattatctacaagaatatcagaacatactttgttaagtgccttgatgaaccaggactcaaatgtgtaatctgtccatttggtgcagatcacacagaggtaaccttgaacactaaagcttaaagcagcaggtagtaattttcagagttatgtctaccctccaattcaggaatttttataaagaaaaaaagtcagtgcaggtgaatatctgatttataaaatgtgtaatgcaggtattttgacttcttgcttacttcgctcaccttcccagtactccagggcacagtcgaacagataccagcaagttggcactgacttctgaatgtctgctaggtaccctggtctagagtctcctctgtgtttacagtttgttctggctgagtcacaactgtttccaaagatactcaggagtagtgatttccctaagatgtttttcaagaagtatacagtaggaaaaattacatccagaatatccactgttttcttttcatctctgtccaatccttcctaccttgatcaacttagaaattcatcttcctttcttctcttggatatctaattcacctcatagctttagctactgcctgtcacccagtcactcccagaaattgatctccgggccccatattactcccagtgtacaaatctgtgcttctgcctacccactagacatgtcagcctgaaaatcctacaagcatctgaaatcaacacatctgaaaccaagatgatcatttttcttaccccaagccagcttcttctagagtctctgcatcagttaatgtcatcactgttttcccagtacaaaaaccataaataaaatggattcagataatattgaatgcctgttttatctcaagctctctaaaggtatagtcattagtccctgtcacatcctttaaaagtagatgctacccaaagctctgagaggtgaacttgctcaggataaatggtcctgggattcaaacctgggactgtgtggtttcccagcctaccttctgcctactgcttctcagtgtcttcctttctctctgatcctccacacatccagtaggccaccagcttctatcagaaatatctcagaaacgtctctggaatctgcccctttcttctgtgactggggtctgcttcaggcctttggttcatcatctccctcccagattttagccatagcgccttaataggtctctccattgtcagcctctccaacctcaagtctctctctgtaactaacccccaaatgattcctaagacacagactccagcccagagaagagaacccagtccaccaggttgcttaaaacagacctccacctgagaccaatcaggccccgtctcactcctgttccccctctacaggccagggctcaatcacctcttcccgcctttcaaagtctaagtctataattcttccatagcatggtttcctagttaagatactcttttacaaaccacatatatagagatatcagtagtacattttaaatttattccttcccaaaatgggagatgatattttttgtaagaaatgacttttagcccaaagtcagctgcacaaataaaatgcctaagtagcatattttcagatcagtttagacatatcaacttgcagcaaaagatgagtgtgatactatctgcaacttaaatgttcaaaagtagggagactaggtgcaatggcttatgcctataatcccaacacttcaggaggctgaggcaggagcatcacgtggggccaggagtttgagacccatctgggcaacatagcaagaacccctgtctctacagaaatttaaaaaaaaaaaaatcaccaagcgtggtggtgcacacctctattcccaactactcaggatgctaaggtgggaggatcacttgagcccagaagttggagactgccttgagctatgatcacgccacagcattccggcctggttaacagagcaaaacccgtctctattttttaaaaaaacaaaaaacttcccactattttctttgtcaccttgtaattaatttacttagtaaaattgttataattctaaaaaatttgttacatataaataatcattcaaataaagataactgagtacatagaaaagcagaagttatattaaaatgcttcttgttagtaattgtggtagaagatattgtactaagtagaaaccagtatccaggcctcaaatggttttcttagacctaacatatgtatgatggggctgagcacagagacttatgcctgtaatcccagcactttgggagattaagacaggcagattgcttgagcccaggagtttgagaccagcacgggcaacatggcaaaattctgttgctatgaaaaatacaaaacttagctggacatggtggcaaacgcctgtaatcccagctactcaggaggctgaggtgggaggatcacctgagcccagggaggcggaggttgcagtgagccatgatcgtgccacttcactccatcctgggtaacagagtgagactgagaccctctctcaaaaaataaatatgatagtgtcttgctgactgaagtgctctaacacagattcaaatggcaaaacggtgagtctcttagtatatgtcacctagagccttccatgccaccccacctcaccctactagtgaagaaagtaaaaagaaccaaatgatggcattgatcaggactggccgggttattctgtgataacaaacagctgaaaaaaaaatccccttggccatcagtcattaattatttttttccccacacacagaacaaatcttccccgcaaggttggaagcagtcactccatcacccttgaagtctagcacttctaagcgatgctcagtctgtatgtgatgccctttgatctggagacctatggaattacctgctccccctttccctgctgttttataggacagggtaacagtaataacccctccactgtggaagggggaagaatgagagacatacggcagtctcttgcctatggcagttctgaatgttttctgggcacatattgtggggtctataccctggcagcaagaaatcagctttcactgagcactgtttctaatcctgaaggagctcttaccattgtccttcaggttcctggctccaccttctgggagatcttccttggacacttgaagtttgtgtttcatctcacataatcacagtctcttttactccaggtttgtaagtatatagggcagtggtaatttctcaactcagtagacttcttacctatttggttccagaaaattccctgtgccaggaaccatattcatggtccttaagacacatttctttgcttacttgcttccttcctctctggatttaagagagcttctacaggaaagttatacccttgatttacatttttttccaagtcaatataacagttaagttttaacagtgagtgtgttgcctatagtcagtcttaaggctgagtgttaatctgccttcgtgttcagaggctaagtttagaccttgctatttgaggctttatcttagtctgttcaggctgctatatcaaaatacctcagactggtagcttataaacaacagaaacttattgtcacagttctggagtctaggaagtccaacatcagggtactggcagattcggtatctggtgaggacccacttcctagttcatggatgaccatcttttcactgtaacctcacatgatggaagggatgaggggctttctcaggctttttttttttttttttgagacggagtttcactcttgttgctcaggctggatggagtgcagtggcccggtctcggctcactgcaacctccgcctcccgggttcaagtgattctcctgcctcagcctcccgagtagctgggattacaggcacccgccaccatgcccagctaatttttgtatttttaggagagatgaggttttaccatgtgtcagtcaggctggtcccgaactcctgatctcaggcaatccgcccgcctcagcctcccgaagtgctaagattacaggcgtgagctaccgcccccggcctcaggcttcttttataaggacactaattgcatcccaaagaccctgccttctaatatcatcacattggggggctagaatttcagcgtatgaattttgggggaacacaaacattcagaccatagcaggtttaaaattatttctaactttgcaaggttctacatttctggaatctctctattatcttccatttttatttgcaacctggccaattctttcctgagctcatctcttcataaaacaaaacgtaatgttccagacacaggcaacagcagccaacataacaccactgatgcttggttttcagacctcatcttctagagctacagatttatgaagtttatgatctacctctcaagtcatctcaagcaacagttttactgaatatcttaccacttcaaaacatatatgcccatttttatagctttcaatatcgatttctactgtctgaccattaagccagggtctcctgttgtaggattttgctagaacactacttctatcaacaatatctatattagtagtataagctcagttatgctgcctatcataagcctagaacttacctcttgttcatgctaaatgcctagtgtgtgtcctcagggggttttgttctacatggtcactcagggacccaggttgagggaaagtccatcatctcgtatcttcccccttgtaactaaccaccccaaaacctactggcttaaaagaagaatgattaacaacttctcaagattctgaggaagtggccaagtgacttttctgcaggatgagcctgggatcactcgtgcatctgcattcacctagagagttggctgaggtatgggtgcagctgggaagtctgggtgtctctctcaccattctgtctgtcctccttaaggaggctagcccagggtggcaagcaggaaaaccccaataagcaagctgtatcaagcttcttacttgctgatgtcatgttagctgaagaaagtcgcatagccacgcccaatgtcagtatgggaaggtactacacaagggcatggatactgggatgtacaattcattgtgcaacagtcttccacagctatctagagcaggagtcaacaaatatttttttaaggtctggattgtaaatattttaggttttgcaggccttatgttttcccgacttctcaatagatggagagatatgtaagtaaatgagcatgttccaataaagccttattcacaatagcaggcagtggaccagatttggcccaccactgagctgtggaacataaagcccttatttattctctagaaggaatacatgtcaattctgcctttagcccattggccaaaactagtcacaagaccatatctaactgcaggggtggcggggagtataatcctgctctattcccagaaggagagaagagctagacatgtgtggacactagaagtcaatacagcagaagccacattgagaagatgtatgttcagatcatcagctttatctttattgagtacccggcactggttgtaagtactgaagaaaacacacacaaaaccattgccctcatggaacttacacagagtccatgatggtgaatacactgagagggagacgcattttatacacctgtggtctggaattgttagttgtcatctcattgtttgtgtacttggctttttcgccaactaggctgtgagcagtgcgagggtaggattgcatcttctctgtgcctgatgcagtgactaattctttgtaggcactctttaagtgtttgtcaagtaattgattgttcaaaccattagaccaagataaggatttactttggacttgtggggaacctggatatagatgcctaattcctgtatcactcaggtacctaactatctaacccctagagctgccatcatgcaaaaggctacaaggtgtgagttgtttctctaaatgtgaaaagacaaggatagactaaagtctgtgtttcttccattcatagcagtgagtgaaagggacaacaagcaaaaatttccctccagagtctaggttttttgccagaagaagtaccgtgaaagttcagattaatttgcttgccttcagaaggcccttggggcatttaacagaaaccatcaccttaccttaggtttattatcttagaaagtgtaagtatcctcatttcataatgcctgaaaatcacttagagaagagaacagtaaatatttctctattcgcatcccctccctctctcctctaaggggtcctgaagttatggacggtgacttaggaaaaggaatatgagatgggagcatgggacttaaaaaggtttctactgaatggataatttcatatctttcaacctagtaaagaaaagcaattgatttaccttatgtatcatacaaagggatggtgtttatagataggaatatttcttaaagaatatctcttttgttttagattcatgagctgagccatttttaagccattaattatgtttattctcaaattttattgtaagtttaatttttaccttggaacaaatagggcaaattcagaatacaagtcttttgaaaaagatatttttgcaaaacagtccatttgggaaacgtgttcatagagaatacagatacaacaaatggactccatttctgctgtcaagagatttacaatctaataattgggtcagacacataagtaactgtagtacagacaataatatttttgatcaaatagaaatatggttaaaattgttttagaatgtagaagtaggtgtcagtccagaagggaacagaaaaattaaggaatggctctatggagtaagctatcctttaagctgtatgcaccaggacatacaggcttttgaaaggacttatatggagaaaagtatattctaggcgtggtgagtagtgagtggcaggcaagggcctcagctgaagcagaggctgtaaaatgaaaaagaaggcagcagtggaagaaccaggaagagctggaggggctgggctgcagcaaggagcagagggagaaggcagagatgacatccaggtaacctgcatgctgaagatggtcagaaattctgaatttctgaagtccatgagaaagccattgcatgagaaagaagaccagtgaccttgaagttgcttccaaataactctctggctttctcctgtggttctgtgtacactctggtgcttcttcatgtgatcaaaattagaatatattcattgttggtcaagcaagaggccacctttgttccgtcatccaggaattttcagtatgtctgattttatttgctgccctaataataacatagggcccagacttggactgaattgatactgcaaatcatcagaaccagccttcccaagcataaggaggtttttgcccctaccctcaggtaatcctggctgtgaacatgatgttcttggagttgttttttaaatagccctgttctgttttcaaatatttacccatttaagcaactcactatttaatactgaaagggtgtttgttccactgtctggcacctggatcctgaggtagagcttttttctaggtcttagtccatattctcatggtagaaaaattaattttttactccgagcaaattaacttatatctaacattcttgttacgagttacatgaaagaccctagaggggttgtgatatgctcctaggtgggttttgaggtatgtttttgtgtccctagcccagaaggacacccctatagaagtaagtcaacacccaagagcctgaaagttgtttgcacattgcacttcaagtcccaagttttagtttttttcccacaaagatccatatgcacacatatagtgggccccatgtctgaactccagcccacacagagttacttgccagttccaaagaagcagagaatgaagatactcatgccccatcatccatcatttttttctatgaaccttacagctgaatattgaaaaatctggttttgatcttttgggtattttttttcatttcaagtcaactgaatagcccgtacacatggatataaagaaatataaccaggaattgtttgtggtattgaatcagaactggagacatttgaagtcaagccacttcaatagtgtttcttatttctttttaatcagattttgaatattctttctgcaggttgtgttcctgactggctttggctatgtgtatgtggatgttgtacatcagtgtggcacagtcttcatcactgtggccccagaaggaaaagcaggacctattttaaccaataccaacaggtaggtttaattattttcccagtgacaacatagtaagtgttactgttacaaagttgtaaacttagtatttatctttgtcatctccacataatgtattaaagcttttggttaattatcatgtaatccataaaaaatatggttattagcactaaatcatcccttcaataggtagcaataaaccgtctttcctagataccacttgcactccttctgtggtagggttaacaaactgatttacaaactatgcatcttggaatcataccactattattagcatgaaatgcacattaatacctctgtgtctgcatgacagtgtagtaattaataataaaacttagcaattagagctacatcaaatataaatacgcctcttagagccatattttccaccccccactttgacctgaatgttgccatcaggttttaaaaacatgaaatagacaaagagttaatatccttaatttaaaagaattcacataattcaataggaataatataaagatggccttacagaaacaaaaataggggcaataggcatgaacagaaaattctaagaagaggaaatataagtaatcaaagaaatgctaatttatcaaattaacaatgatgttgtatcatatacagtcctggtgaaagtataaattggtactatttccaatttataagcactttggtaatacatattaagagctttaaaatccttttggcttagaaattccacttttaagtgtgttaggagtttcagagttaaggaaatggagaagtgggcaaagatatacacagagagatgtacacagtgagagatatcacacagttaattacaatggcaaaatattcaaagtaaaaatgcccatccatagggaaatagatgatacataattgtactataaatgttacaactgcaaaaagtagatctcaaagaattttaatggaatagaaaatgcatattataatctaaaataaaacaagtagaatataatattgaatatatatgatcctagttatgtgttatctgtacatacatacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacatacataagtacgcatgtatgtacttatacatacatacataagtacgcatgtatgtacttatacatacataagtacgcatgtatgtacttatacatacataagtacgcatgtatgtacttatacatacatacataagtacgcatgtatgtacttatacatacatacataagtacgcatgtatgtacttatacatacacagaaaacattcctagaaataagactgaaaagaaaaaaactcaaaattggtaacagatgtggggttaatgagttatttaatatgtaattattatttgatttctgtattttgattatttataatagcatttattttatgatcagaaaaaataacttaatattaaaatataaataccaccaactttcatacgtttgtttaaatctttcttttaaaaagctcattgcagccaggtgtggtggctcacacctgtaatcccagcactttgggaggccgaggtgggtggatcacctgaggtcaggagtttgagatcagcctggccaacatggcgaaaccctgtctctactaacagtacaaaaattagccaggcttggtggtaggcacctgtaatcccagctcttcaagaggctgaggcaagagaatcgcttgaacctgggaggcggaggttgtagtgagccaagatcatgccactgcactccagcctgggcgacagagcgagactccatcttggaaaaaaaacaaaacaaaacaacaacaaaaaaagtttattgcttctcatatatggttaagaactcattaatttggactctgctaatttgaatttataatatttcaaacaatgttggatagaatgttttctttgcccaaaagtgttcataaaaaattaatagcataacaaaattgaagacgaacttttaactagtatagcacaaaatttcgggtttattcaacaatttcagaaacattttatctagggcataaatgttaataacaatagaagcaaactttcatgagaaaggtacaagtatttcttggaatttcattcattcattcaacaaatgtttttcaagggcttattggatgcctagcatgggatgaggatacatccataaataaaaaggcccaatcccttccctagagaagatgactttctcctcataggcatggaattgggcaaggtgatggggggtgtagagagtaaacctaaaaagaaaggaaatgttatggtgcagtagaaggtcagcattctacagggatgaaaacagagctcagtaagaggggctggaagtgccagggccaagggactgggaaagtgtagttttaaacaaattggtgtaggtaagctgcactgagaagttgatgtttgggcggagactggaaagcagtagggggttagtaatgtgactatctgaaggaagaacttcccaggcagagggcacagccagttcaaaggcctgcaacaacatgcctggcatcaaggaggagcagggaagaggctgttgtgggcccagtggagggggtggaagtggaagtagcagtgcatgaggtccaggaggtaagagctagaaggagggagacctcatgggccattgaagggcttagctttaattctaagtgaaatgaggaactcattggatcatttttgaacatagaagtgacaccctgtgacttaaatttctagaagatcattggccgctttgttgaagtagactgtagagaaacaagggcacaagcaagcagggagactagttaggagaggattacagttgctcacattagagacactgatggcttagactacagtggtgtcagtggaagtggcagaaagagtcagattctggatatgcttctaaggaaaagtcaatgggattttcctaatacattgagtaatggctaaaaatagaggcatcaaggatgacaccgaaatttttggtctgagcaactggtaggatatggctgccattaactaagatgagagagactatctgcagatttaggaggaaagatcaagagattggttatagacatgataagctgagatgtcatttagacatctaagtgactgtgtggataggtagtttgatacacaagattggagttcagtagggagctccaggataagtatatactttggaagccatcaacatatagatggtatttcaggtcataagactggatgagatccccaaggaagtcagtgaagatgggggtgagaagaggaccaagggctgagccctaggcactttaagaggtcagggagaggaagagggatctgcataaataactgaggtcagagaagtagaagagctgagagaagacaggaaagaaaagtatttccaggaggagggagttgtcagcaatgtcatatgttgttagtatgtcgaataagcaaaaaactgaaagtccatcatttgatgtagccaaatggaagtcactgatgacgagttgttttattaggctggggatggaggcacaaaaggctgcttagagcaagccttaaagagcagggaaggagaggagttggagacagtgtgtatagaacacactttagagtttctgtgtagagaggatcagaaaaatgagtggtagctaagggagagagtggagtcatgagggattttttgagctgagagatgacagcatgtttacaagctgctagtaatgaagaaaaagatgatggaggaaaggggtgtgagttgctggagggatgtctttgagtaggtgagagcagagtgacttggtgcactttggagaggggttcacctgagacagaagcaagggtggttccgccccagaaatggaggtggagaagagccaagcatggactcaggcacggttgatgggcagttgtggcaggaattcctgctaagttttcttctgctcacatcactttttcaatttagggagtctcagttactttattatctctttctgtcttgtgatcatcatgatagagaattagtacacaaagactagagggattttggggtaaaaatctggtgttgataagggaaacataaggaaacatgacaagagcttgtaatagtcccattgggaacatttcccaatactgttggagtgtgactgactccgtccagacacaatgtactgaaagttgagttcttatttgtttcttatgagaatctgatgtcccatcaggaggtatttaatagggtactgtcaataaaaaagaaagaagagagaaagaaaaggtgagtggggggactaatgttcttgtccctttctcctctagagcgccagagaagattgttacatttaaaatgttcatcactcagttaagcctggcagtgtttgatgacctcacccaccacaaagcatcagctgagcttctgagactcacactggacaacatttttctctgtgtggccccgggagctggtcccctccctggggaagagcctgtggctgcgttgtttgaactttactgtgtggagatctgctgtggggacctgcagctagacaaccagctttataacaagtccaatttccactttgctgtcttagtctgccagggagaaaaagcagaacccattcagtgttccaaaatgcagagtctcctcatatccaacaaagagttggaagaatacaaggaaaaatgttttatcaaactttgcatcaccttaaatgaaggcaagagcatcctctgtgatattaatgagttcagctttgaattaaaacctgctcggttatacgtggaagacacatttgtatactacatcaagactttgtttgacacctaccttcctaacagcaggttggctggtcactccacacacctctccgggggtaaacaggtgttgcccatgcaggtcacacagcacgccagggccttggtgaatcctgtgaagttacggaaactggtgatccagccagtaaatttgctcgtcagcatccacgcttccctcaagctgtacatagcctcagaccacactcctctctccttctcggtgtttgaaagaggacccatcttcaccactgcgaggcagcttgtgcacgccctggcaatgcactatgccgctggggccctttttagagcaggtaagaacacaagctgagggtctgtgatgagctagagcccgggtagaaatgacacgcttgggggtagcacctcatttcaagacctaaagaagcaattggcaagaggtgacacacctgagctctacagttacacagaactggatctaaatctagagcctgccactgttagctgtaagactttgggcaagttattgaaccttcctgagtctccatttcctcatcgataaaatggctttgaagatttctgagaggatcagatgaaagtacgtgaggtacccagcattttgcttgccactcaataaacattcaagcagtagtagctgttctgtaacttagaattttagttcagtttagcacacacttttttttagcaacttgcaggcacagagccctttcttagcacactagagcaactaggaaaactagcccaggtcttcagtccctcggcctaaaaggagtccagttctcgtttattttcttcattgctatttatgaatagcggtaggtgagaaattcagaggatttgtgtgcttgtaagatgcacattgagccctctatctacccagtgctgcactgcctgtctatatagctggcaaagggaaggctgtgagtgtgtcagcctctccacagacctgagctcaaagagaaggaatggcccatccactctctggggccaggcaggtggcctcttgcaggctgagggctgctgtttctcagggactcagtgggaaaagtaaggattcccttttcagtctggctggaaaagtctgcagggggtggtttgaacatgcatacaaaattttatagagggactactgtgtactagcaactggtgggtagcaggcgcagtggctcacacctgtaatcccagcactttgggaggctgaggtgggaggatcacttgagcacgggagttcaagaccagcttggccaactggtgaaaccttgtctctataaaaaattaaagtttaaaaaattacccaggtgtggtgtcgtgcacctgtagtcccagctactactgaggctgaggtgggaggattgctcgagcccaggactttgaggctacagtgagctatgatcacatcactacactccagccggggtgacagagcaagaccttgtcccaaaaaataagattgagtggtgggaaccatgtggtctcagggtacgttatggtaatcggcatcacagtgtgtgttcttgagccaggttcactctaaagcagttttaatttgataattgggttcccagaaattcaagcaaagaacagcatccagagttagccttgtcagccctttccaataaagaacatggaaatcttactttctgaaagtaacagaggagagagcctttgttctatcctctttgtaaagttgtactttgtgaatgcgttcccatgtaagattaagattgcagcagtaaacgacctgtgttattgccatattggtcagattacattttctccataatgaaattcatagacttactagggttatctagactcttttataaaagataacaacaagatcagggagagggtcctgccagacctgttgtcttgatagcttgcacaacaatgaagaaaacatttccctattgctaaaaactcatttaaaaataagcagtccacatttcaagtttaatagatgggtgtatttataaacagttccagaaactttcccttcaggcagcctttgctttttcacataagaagcaggcacgtaggttactgagctccaatctgaggcctggcaaggacgaaggctcccattcagtctctgcacgacgcagcagtgcagtaagcagcagggaaactctacctgtggcaccaagtaacgggccctgcagcccgtgtgctaaaaacgagctctctttgttttggtttatatttttaatgagctttcacaagaacattctatttgaattttatagaattcacccaaaaatcctctaagctgccgttccaatctcactgtataccaagataagggattctaatatagagggccaagttttcagagcctgttggaaactctgtcactaaaaatctatggacaatctgaagaccatctgaaagaaagcagtgattgaaggagtaggaaatgggaagatgctggaggctccagactcccaggttagcatccttgtcgagggaagggagagagctggctgcaggtgggcaagttgcccacccacatctcacttgagtcagagtgcccctgcctgtcatggaaaacaccctgacctcatttctagggaagttgtggtatcaacttgaagaggttttaaaaataaagaaacaggccgggcgcagtggctcacgcctgtaatcccagcactttgggaggccgaggtgggcgaattgcctgtgctcaggagttcaagaccagcctgggcaacatggtgaaaccctgtctctactaaaatacaaaaaattagccaggtgtgggggcatgcacctgtagtcccagctacttgggaggctgaggcaggtgaattgcttgaacctgggaggcagaggttgcagtgagccaagactgcaccactgcactccaacctggacaacagagcgagactccatctccaaaaacataaaaaatatttaaaaattaaacaactaaaaataaaaaagtatgggtgggagaggcagaataaaaataaatagtaattggaaatcagtaactgaccctatctgaaggaaagcatgtggtctttatcctgaggcccctctctaacccaaagtctcagtttgttgggagccaggcagactcccttcttcaaccaatttccaaacgactgagcaaaagatagatttgcttttgaagggcaataaaggagtacccttggatctgtctgcccttttctgaccagctaagatgtcactgagatgtagctctggcctacacatagcccttctatcaggcagtggcttcaggattcaagggttccaaccccacgacaggggaggacctgccactggcaggagcaagaggccgaggcggattcccactccctctctacgcccacggcaccgacctgaacaggcctgtcgtgggggacactgcttggccatagctgctactcctttcttttatacatggactccgtggagagatggggaattaagatgtttctagaccaaccttctgccgttaggtacacccttacagccattcagggctaaagggaatctgctgtttctttacctccagagaaggccctccatggaggaatattccacagcctccccagctccctcgcctactctttgcagcctgagctcacagaagaaagaggtgggtgagcttcagaattaggaaaacctgggttggaaacccagcccacaggtggatcatccaggggactgtgagcagttggcttagtctccaagcctcagtctcctccttttcctgcctgtgaggccgtggaagcagtaccaccatgttgcattcacctctgcctcctgtgcctggtccattccctgacccagacagcagctcagtcaccagttagcctgcactgatttgaagggagagaatacttttcttgcagttaccgtgagaattaaatgtgttgaatgcctggcatccatagggcctctcatttgtaatctttatcttccagaaattattccctcctttgccctaaaccctagtgttatcatcctaacgttccagagaagggaggagggctcaaaatttaagagcgtccctctcttcgtgggctgggcatgggattcttcgggaccttggcgtggctgttgtaccctcaccttcctgatcccctcagatcgctgagctgaggatctctgtcacaggactgtcctcctcttcagagcctgctggtgaaggagggatggctcccacccagtcctgtccccacagccttcccattaccaggctctgagcaccaggctggggaggtcagtggcttcccggagaaagctgtcttttcagactcctcctctcctgggccctcacttgcccctccaattcttggggcctacagccccaaatccccaccccagagagccagggtaagggcagtgcctgccagactccacgcacagccgcgttcccatggggcagcagcggctgagtggcaggccagcttctggccagcccaagcttcaggaggaaaccagatccaaagctgccctcctgggacatgcacaagggaacactcccctctcactaacctcatcagaatgtccctgtcacagagttcaagaccagcctggcctacatggtgaatccccatctctactaaaaatacaaaatcagccaggcgtggtggcatgtgcctgtaatctcagctgcttgggaggctgaggcagaagaatcgcttgaacccaggagtcagaggttgcagtgagccgagattgcaccactgcactccagcctgggtgacagagtgagactcgatctcaaaaaaaaaaaatgtccctgtctctggtgtttacataaccggagcaggggttgaagggtccaagacatttgtctgggtctagctctgctccaaagggaagcactcaactcagtaggattgggaaagattaaaaacaacccctccattcttgtcagaagtttgcatcccctttgcgacatgccattgagcatctggccgcccctggccaggcatctcctcctatcctggtgcctccgctgtcccggggaggctttagagagaacctcccacctgcaaacacctgcaacccaagaaggcgcccttcctcaggtggtagcagagtgcatccccgccacatggacccccgttagcaggaatatgggaggcttgggcaaggcagtcatattaaagccatttgtggggccgtcagaggatcactttgatttataaagtatgaaagtttgccatttatgaattcacagagaatgacttatttcccttattttcttccaaagaaacagattactttcccaattctagtgtgaaaaatgaattgcagggaaaatgggtcactttttcacaaatgttgaaagttctgcatttgaggtttcaatcaccccttccctcttgtgcgttgcaggctgggtagttgggtctctggatattcttggcagccctgcaagcctggtgagaagcatcgggaacggggtcgccgacttcttcaggcttccgtatgaggggctgacccggggccctggagccttcgtgagtggcgtctccagagggaccacatcgtttgtaaagcacatctccaaaggtagcgggttccgttccttgtaataatgccttcactccttccctttttttttttttttaaagaatgtgctaaagttttaaatgcattcagattgcctctagctttgtttggccttttagcttgcagtgagagtttgggtttgtaacaaagctcatatataatgtcttatgttttgaacagatcactacttgcctctggtgtgtgaaaatgtttcagaaacttcagaattttaagcctcccattgggaaaacaaggattggctcaaatgttatttcatgtgataaacacagaaatattaaaggtgttcaggatttctgctaaacatcagaaaccctacactgtgttgcctcatcatatttttttaaatgtagatacagttgtcataactttcttaaggatatggatacattctgacatggaagcggatttgggggtgaaacagccaacttttctctagcacgccacgtaaacagtgccatcttgtggcccagacaggtcatcgggcatggaggccaaagtgcttcccgcaaggacagtgttttagttttatctgtgtgtgtgtgcttgatgttattttggtcaggttggcagagacttgggaactaacaagggccatctgagtccccttttcttctcagcaggaggcaaggaaaacagggcaaagggcttcttcccgtaaaaggcatctgactataggccataggacaggtctgtgaaagtctctggaaggcctcaaaagaagacttgatcttgaaataggagaatccatgatccatagagcgggtgagggactgtgggtgggagggctggcaagagaacagccagagtcataaaaacaaattccacggacaatgaaaaggacactcccccaggcctcaaatcatctgggaggactgggggctgagctgcagaaactcaccccatgagtcactggcagactgctcactcttgacactggaatctctgtggttctgttgtttttatgttaaaataagacaactaacacctgctaaattgaacctcagtggtattttcagcctactgactcactgaatgttttttacacttgttcttttcttctcttagcaaaatctttttggtttgttggcatccctatgtgtgtgcgcacacagatatttttcttttcagattactggtaaagatgcagctgcaaaaacgacattgagcatttcttcctgaaactggacctgcaataacagatgagctagtttgttagtgtccagatctgtccatgaaagtcgctcagtttcgctcactaagatgtgtgcagacctgctagaggaattgtggctattgtgagcaaatgctgaaatagcccttcttaggaaaaccagacagattcacggctctcacatgatttactccctttattcccctcactggtttttcagttaacatcctgaatatcaaaattgcacatattctccatggcacaataattacatcctcagaatggcaaatgataaggtttagtatctccccctttgttatgactgaagttatatggagggaataaaatttattcctaaagctgaagtatttctttataatctttctaaaacttagcaacataactttaccctttaaaatcacagcaggcagattttaaccttcaaaattgggcgtcagtgaaggcatcaatactgttttaaccaaaccttgacaaattaaattatagtgaaggatagtttcatatgaaactctaggctgtgttctgcacctgcgattcttaccctttgaagagtgtcatcacccctgtgggcaagtgttcctctttacctcattttctttttcattttattgtatcttatcttatttgagacaaggtctcactctgccactcaggctggagtgcagtggtgcaattgcagctcactgcagccttgacgtcctgggcttaggcgatcctcccacctcagccccctgagtagctgagactacaggtgtgcaccaccacacccagctaattttttaacttttcatagagacagggttttgccatgttgcccaggctggtctcgaactgctaggctcaagcaatcctcctgcgctggcctcccacagtgctgggattacaggcgtgagccaccaccccagttgtttacctcttttcttaaggctctttcttcaaattgcctgagagggagccaccatcacttgccactgggcatgtccaggaggggccacaggtgctcccgctgcctctgaaactactgccttggggtccatcatgtatgcgacaaggaggctaaccccatgctcttgttccctcaggtaccctcacatccatcaccaacctcgccacaagcctggcccggaacatggaccggctctcactggatgaggagcactacaaccggcaggaggagtggcggcggcagctccccgagagcctgggcgaggggcttcgacagggcctgtcccggctgggcatcagcctgcttggtaaggggctgcggggcctcccacctgtctgtactccagcaggctgagatgcagggtctcccaggactgggcaacttcgccttctgcctgggaatgaccaggaaatgctcagagaaggtaaggcacttgctctgagttctacagtgcgtcccgccgggggctcacctgcacagccgcacatgcagcgcctgtgtttgctttgtgcatgaaatgtatcttgggcctcactgaagttcttaaaagaaatcctaatttgataggacctgctctaagcatagtggtgtctgcaagaggacagcagcatccagctgttggctttctgaagaacgtgatgggcaacgcttccgaagcactggctccctcactcccacacatgctgagccgcttcttttgtttgagaaacactagagcaacatgcaaatgtcacgtaaacttcagtgaggagcccactttgtcctttacttttttgagatcagcctgattcagagtaattattgtttgtagagcagccagatggtatagttagaggtgaagattgctctgcatatttcaaaatattacaaatgtttgaaaataagttgctttaaaaaatttatgaaaaggaagcttcagagctaaaagtttgcagggcaggattttcaaggatttttttgtttatttgtttgcaaaagaatttaaaactgtattgcttggcaatgtgccttccgcgcatctgaggaagtgtgtgcctcccagagatcaaagtgacccaaagcagtgcagagcaaagggtagaaaagatgagtttgaaaggactcgccctctctctgatcttcagttctctacagaactcctagattggcaactgcagctagctgaggctctgggaggaagtggtaaaatggtacaagttcaggttaagttgctggaaattatataggtaaaaacattcagtggtgtggggcactgtcatttgataatatgtggaaactgggaagctggtgacctgtggtaaacaagctgggtaagggagcaaccttcttgcttaactcagtaacccaaaggtgatggtgactcctttggggaaggtggtgtggcagtggaccctgccctcagaagccccagaccttgggctagggtgttcaagtcctttctttgtgacctcaggcaagttctcctctgaacctgagtttctcttttgtatattgggcctggtgataccattgttagaagtaacagtgggtagttatatggcagccaccatgctcatgtttggtaaacagaacctatcattatcatagtatggtagcaaatgaactgtaagagttgcctggtttccaagagtgcctcagcaaaaagaaatatttgagcaacggcagtaatattttcacttaatccaatggattaagtggctgtaaccagaggaagtgacaatgaggttatattgaggatctcaaggtcattgttttgcaattcgggacctgttgatgctattaattggagacttaagtaccactactctgctccaccccagcccttataggagcttctaggcaaagagagagagagagacccacccctgggctggctggtgtgtggctgtctccaccccaacccccgactcccttcctgcccgagggttccagtctcttcccagtcagagaaaccccagccaatgctccgttttcagtgtgtaagattgtacctgatgggaaaaatcagttgtgtgaggagtcacaaataagccctgatgaggtcatctttctgggcgtgggtcctgttgaccgggtaagtcataatgctctgatctttggtgtagtcattgtgtcttgcatatccttatccatgtgagggaattcatttttggaaactgcagtgggctcatggggtctttctgcatatctggtaatttccagaagattattaattcttggggtaacataagcctcctctgtagatgctggctgcacctgccaacactggccagccccagtcccagcccagctcacaccctgagcagtgtgtccatgtcttgactctgcagagttcacagtgggcatctcaagcttggctcaaaccagcttcctttcctgtaagacttcaaggacttcctttgtttcatgtactctttgggttatctcaaaatgtctggtcctagaactaccaggtgtgtggcaagaagaacaaagagcggagtacagcaaactgaaatctcctcactttggaaagttatatattggccaccatttaattcttccccagaaatggtgtttgaaattgccacatacaatgcagtgcctaattgaagttagagccattatcacataataatttgaaatccaggccgggtacatggctcacacttgtaatcctagcactttgggaagccaaagcaagtggattgcttgagcccaggagttcgagatcagcttgggcaatgtggcaaaaccccatctctacaaaaataaaatgaaatacaaaaattagccaggcatggtggcacatccctgtgggcccagctactcaggaggctgaggtggatcacttgagcccaggaggtcaaggctgcagtgagctgagattacaccactgcactccagcctggtggacagagtgagaccttgtctcaaaataataatagtaataataatagttttaaacccatgccagtgaaatagatattctagttgctcagtttcttcaataaaaagacagaaacgttaaggacccagttaataaaaatatattaaaggaaaagtttagagttggcaaagcgttttcaaaggtgtcatcttatttgatcttcacaacccttcacaacttcataacccttcatagcttcacaactttggatgaggtaaagcgacttagccaggtcaaacctccagcaaggacaggagcctgggcctttccaccatgtcgcctacccctgtggggctccaggcctggaaacaatcaggatgtggggagactgaacaattgcaagttccagtgtaggaaaaacacatttcccccaaatgtttacgggttcggcgggccttcttgactctgcttcaccctcatggggacactatggagcattatgaggcccttgaaaattaaagcaagtctgcagctccatgcccagccgcactgccccaggtcagcagggaaaagtgtctgctggctgagagatgctgccgaggcctttggatgagctccatgacagttttccaagagcaacggcttttggaaaaactccgtttagcctgcagtattggcatcagccttgcccacatttaccagatctgttccccaacaccctcactttctactacactctggagcctgcactgagaaaggacgtgcagctccgcatcacagctgcattctgcgtttcctcccaaacctgatgccttctcatgaacaccaaagctaggatgtcaagaattgcttctctgacccccacttcttttgggatgcttcctggtttgtgatgcgctgctggattccccagagaccacctcctctctcttcatgggcactcttggctatgccatctggaatcccaacaaaacaggcctccgccaggtgaaatcagaaaagtcccctccgagggagtgactcaagagttgcacatcccaagagacagcccttaagagtcatccctccaataccaccatctgccattagcagactggtgtgtattatagtcagtgcggaatttaggaatgactggcaaagtgcttccttgttggtttgctcgtctgttctggtcaaaaaaaagaagcgctgagctggaatgtgcagtacactctatgggtctcgttactttctggaagggcgagctgtggcgtggtatcccattttatgcctgtccttctgatagtgtgacaaaaaattgccagaaacaaaattacaccacatggtaaaggcagcatcaaaacagacacatcaccaggaacttccatagcccagtgaccaagtagtttctgcccaaggcctaggagcaagtcacagaaagaggtaagggaaggcctggtggtttcctgctccacaatgaaggctttcctcctcctgcgccttccaaggcacaacaggcaatagctcctgtgtcctgcggggtgcagcactcactcagtcctggaaacccctcccagtcacgctcttctctcttcactggcttcatcagatcacagccatctccatgtggtcgcccaccccacgggcctgaggccagcagacaagtcttgggatcagtttccactcctgaaagccttcgagcagagtttaagtctatgacagtccataatttaccagttgtgggatttagctggatatacttcagaggagagccattccaggctctcagagaggctgcctctctcaaagcagggctgcagggaccatgaagtggctgctggtctcttagcctctctgttctccagcttgtgagcacagaggtagataaggcacctggtggctggtgaggtgttggtgtgtgtgacaggccagctttccccctcaaaggtctgctgctgagcccagggcaggtggttccacagctccctctctgactctcagaatctaacaccttgtcatgggactcaggctttccacttttggggggctgcccaaatagtcttatctgtcaaagccacagtaaccgaagccttcactgtggccagagaaaacggaagagcagaacagagggggcctcacctgatacctgcatgtgctggagcaggtggctgtcagcaccctgtgcgggtgaccgcagctggcccaggccccactctttgatttgatgctgttcactttgataatctgctgaggtgactggaagagaagacccagggttcctgcctgtccctcagtgtggccactatgacttctgatcttccaaatggagtggagcatcaacggcaaatgaggggtgctcccagctgagcgccaggcctgactgtctgtggtactaaaagagtgaccctcactcttgatagctggggtggcctgggcctgccgggagcagcttcctctgctcactcttggcatttctgtagaaggtttggcagcacgactctaggctgggaaacaggtctgttgcctcaggtcattctgaatctgtcaatgcataaacttaaatgtctctgtcaaaacctagaggaaaggagtccatgaagagcattccctttacaattgacgtgatatgcactaaaatttctaccaggggccagagcattttcatcactcctagcagttttgaattgaaaacagagaattctgtcaagaattgtaaagaaattttcccttctttctgagatagggagccctccactccatcacgaaaaaaaaatcagaatggtaagacttttctagctctcactgttggcctctcaaagcaggagtagcaaaggggccgtatccacaggactgcctgaggggctcctttcatctgtagctgcctcaggctcagtgcaggagatggatgccctgtgctacagctgtgggagcagagctccaaggggttttggtcgctattctaagtgaggagtaagtggccaaacctcaattccagtgagagagaaaggttttccaagattggcaaagaggaagagcctgttttataaatgggataagcgagtatcttggtggttaagagctatgctgtgactcaaactctctgtacacttaacagctgtgtgaccttgggaaaaaactccttaacctctgtgcctcagtgtccgtatttggataaaaacaatgtatgactcctaggaatatgaggatcaaatgatctcatacaaataaagctcttagcacagtccccagacctagtaagcattcaagatagattacctataatccaaataataattactatatcaataattactcttaagtattaatactactaaattatgactgttatcattattatcaaaagtggagagttagaaaggggctaaccccttccagtttttcatcctcatgaatcagtgcaaatgtattgggctgaacagtctttctctgctcctgaggaactgttagctcctctctctcaactttgttgcctgacttctgaggaaagatgtatggatgacactctgaatagcctgacaggtttgttaaattctgaactaaacttcacagatcctgactgtgtggaccaaactccgtctgaacattgtattttgatgacgataataaatgtctactgcccttggtgtacttagataactggtaaacaaatgggtagtaaagacctttataatgagggtggggactcattttcaatccagataaaactgtgttccagatggagcctttcattttccgaggattttaagcctctgtccttactgagggcttttgttattccaggtgcaattgctggtatagttgatcagccgatgcagaacttccagaaaacatctgaggcacaggcttcagcaggacacaaggccaagggtgtcatctcgggtgtggggaaaggaatcatgggggtgttcacaaagcccatcggaggagctgctgagctggtgtcacagactggctatggtaagtcggtggaaaacccatcaggccaacccagacgttactgatttgcatgcttataccaagggttccctaagatagtgtaacctttcacatggcagacagtggctatctttcttacctctctatgcttatttacacagagtagaattttactactaataataaaaccatagaatcaggaaaccagttactagtttcagtctatatgtcgtagaatctttttacagtacacttgatagactgtaacgaaaagtaaccagtttagaggttgagggcagaatggagaatacagcagagaaaagaattaagactttttcctatgataaatgtggaaggagagagaggctgtgggaagataactctaagaagcagtagagaatgagacagagtgtggatgtgcacatgggtctttgggtgtgggtggccttctcacccacagaggacatcctgcccctcgcagccaggctgggcagaaacaaagggtctgcaaccagaagccctttcacaaggcagacagctgggaagtgcgtggcgcatggcagtacctgcacttggatggggcgtgccggggcctctccccgtgcagccgcatgcacacacgagtaatgggtgcctgtgaaaggaagcacctcctcccaggcttattttctgtgttcttggcagagcacattcaagtgactttccataaacctgtggctggaactgttaccattttacctaaaattggtgtcatcattttggtaatgaagcaggttgtctagctagtatcacaaacgacagaagcgccctcccgtttgtcagacatgtgagcacactgtgtctgcatccgcatctggccataaagcccatgggatgtgtttctagggaggcatcctgctcctcagcaggcctgacaagaggcagccagatcggggcataaaaacaaacagcgtctgaaaggaagggagtggagatgaatgagtgcccacacttcaggcagccatccggagagcatccttaagagaccacacagacgccagcatgtgttcctcttcgctttcccctcctcgcccgcctcatttccctctccttctgtgaatgacatgttcactcacagggaaactgtcaataagatgtgctataacctataagtgagaaaagttacactctcccttatgatagggactccagtgaggtaaagtgaagtcatacttcataaattcttttggttttgaaaatgccattgtccctcaccgtgtttcccagggctgaagaatgctcccttatgtaagaggatcttagagcagagcttcacatggccgttttggtttccatcactcttgtaaaacttttattaccgaactgaaggttttaaaaccactaactcttagtctaatgactatgcgtcgtttgtaaacatttacaagccctcagaaagcacacatgctgtaccatctttggtgctggagagtctatgtaaaggcctatgtggctgctgctgggtgccctcatttggtgctggcaccagggagagcatgtcataaaccaggggccccaagcgtgctcataaatgtatatggattcgtgtttaacagccggattaagtcgcttagcatttaagtagtgtatctaggcaaagggtgtgcctttgtatatatctgtgtgttttttattttttgactagccttagcacagatacagaagtattaaggaagttaactaacaatctagacttttttttttagacacagggttttgctgtcacccaggctgacattcagtgacacaatcatagctcactgcagcctccaactcctgggctcaagtgatcctcccacctcagcctctggagtagctaggactacaggcatgcaccactatttattttttgtagagatgggggtctcactttgtttcccaggctggtctctaactctgactcaagcaatcctcccaccttgatttgacctcccaaagttctaggattacatgcatgagccaccacaccagacctatctagacttttttaacacatcaattaaaatgatgtctaggctattgttcatgaccagctactttcggtgtttttgcttcctctaattgctagtctatgcttggactgtgtaacacattcatattttagtttgttactaatgcaagatcaccaaggttaagagcattgtaatgtttaatgattatctatacgcttgcttccaaagatgtgacatcattttggatctgtaacattttatggatggctctgaacagatgacatcattgcagcatgaaactgttttccagaaaacaagtagtaaaactcccttacttctcttaccacaggtattttacatggagctggactttctcagcttcccaaacagcgccatcagccaagtgatctacatgctgaccaggctccaaacagccatgtcaaatatgtctggtaaaattattgagatacgtgctcaactttacatccatattgtatgttaatagctcctggcttgctctcaagctaatgggccatgcttccagggagcccaggagtagccattgttggcactggcatctcaggcagcacaagagcactgtagagggacaggaagaggctgctgttgccaggtttggggctggctgcacaactcctctgttccgtacctaaccactcaaggaaggtcatacattggcagagaaacccagtcttgctagagggcctgagattccctgtggaaccagcactctaattagaggtgctatttctaatggggagaaaaggagctaataagcaaaaccaagggaaatctttgttcccaggaggaagcaggttctgttaatcagaatcagtctgagaactgacaattacatttcaagctaaaatgggtaactggattggtgagggccctttgcccttgtggaggttgccccattggtaaataatgagcactgataagtgaccatcttttcacagctggcccctggcctcacttttctccttttaaacaggaaaatgcttcagtctctgggcagaccagaagtccacatggccctggacgtggttctggtgaggggctcaggccaggagcatgaagggtgcttgctgctgacatcagaagtgctcttcgtggtgagtgtcagtgaggacacacagcagcaggccttccccgtcacagaaatcgactgtgcacaggacagcaagcagaacaacttactcacagtgcagctcaagcagccaagagtggcctgtgatgtggaggtacgtttcagaaaacagggcaaccaagactagctggccagggaggttgaggagcaggctggtcactggtacctaggcatttctgagctgcagcctctggagtggctgctggagaccaaggagagctgctacccagaggaggaagtgtagaggccggagggccgctgcgaaagggcactgggaagcccccatccagatatgcacataagccctgtataggagaacccagcaggcggccagcaggactcaaggtctaaagctaagtaaccaagccaattgaacaaggctgatctggcttggccgtcatggggctggggtgctcgatggacaggaaaatggagttacaaaacgagtgggttggttcaggaagggccaggattggggcagcaattccacgcaactgctccacaaaggaggtcccctggtctgaaagcctaaagtcaggtccttggctgcctgaggcctgcaactggctgcagggtgctggaggtctgtgggtgctggaaaggaccaatgcagaagcaaggggcatcatgaaacaagactctccactccctcccctacccccaaacctggagacttcaagggtcaacattttgtgaagtggtctctctctcaaatccactgctttgtattctgtggctgtgttctctttcccacaggatagtttcccaccccctgagtaccacagaatcccccctggggatgatacttaaggctcttggggcagctccatggctggctcctggcctgcataaattaatgtggaacagatgcgcaggcaaggcatactgggtgtcaagagtcaagggggagccccaaccagacagaccccagcttcctgtagcccagcccagggtaaaaacaggtgcacccactggaaaattgctctctgcccctccttcctggatgatggcctgatccatgagatcctaattatttacctaaataatagacatctttttccacacagcaagatagtggtggatcagtggcaaactggagtctgctggccctaacctggggactgagtggccccagcaaaggacagcaaacctacctccaataggttctgcctgatccctcctttcattattctcttcctgggatgggggcgtgtatctccttcacgccactgtttgggtaaaattatctgagaagatggaaagcagccaaccacaacaactcttaagatttctctagtttcttggatcatgatcatagtcaggctttaagctagggtttggcaccaggactacattgctgcttcaagttgatgactttctgagaataaacagaggtcagatgtccaggctgactttattagatctgccagaatcttctgatcagttgagtaaagcagcggtgatttggctataggatttggcaagggataatatcattacgattaaatctttagtccttaatgagaaacctccaaggccctgtgaccatcatgattccttagctgcttgggaaatatttcagatcttaaactattaagactgcagatttcttttgctgttgaactgtcttcaactgtgatccttctcttgtatttttgtttgaggcaggtactgtggagaatcatcatagctggaaggaaacagacctcagtttccctaggggttgagatagtatctggagtcaccactcctaaaagttgctgagattattgggattgtggaatcagagaagcaacactgaagctctagataccattttcagcactgattttccactgctgtccagggctgaaagagggttgggattaaggaatgcctaaaacagaagtgggaagacatgactgagagcaggagcactgtgcctgcacagccaaggcccggcactggctggaaggtagatgggccagtgtgccttcagcctccacattctgctttctctattccactttctctctcctgaagtcattaataggaataactgctgccttaatcctatgtctataaccccaacctctcctactcacccccaagaaaactcaagctgcagagcgtctttgagactaaaccctcccaagtgctgtaatctagagtattttcaacatgagtgggcaggggagggtggccagcagcactgccttgtcagtgagctttcttgagctgtctggctcttagtgcatcccaacataatccacagacatgaggaagcctgtctgccgtgaacacttccagtgaagactaaaagtagtattttaagatctataaatgacttttctggtttttagcttttgcctagttcctttgaattttggaaggaattaatttgtagatgacatcatgcagtacatttaaatatggcaggattgagatttattttttaagtcagcatttgcttttcttggttaaatgcaaccagtttaggggtaataactgcttaatatgcctggcacattattgaaatcccttatgagtggctcaaaatgagtcagaaggtcaatttagtccttggctgggttcctttcacaacaggggttttcctgtgctgctgttcaggaggagcaattaaaactttttgtgtattcaaagctttccagctgaattctggccccatcaaatgatatcagagctctggcttttgcctggtggtgcagagctttcgtctgttagtgaatctttggggaccgtttttccccaagcttaaaaacacaagattcaaactctaagggattccttacttattcttctagcaagcctctttactatctctctgccatcgcacggactttctccagcttttaagacactttgatagcattgttactggaccacacgcagaactagaaacaagtctttctttaccacttcttccagagtagtcttgccaatgttcagtaggcaaaaaccacggaaagtttggtggctacctgagattcacaaatcagtggcttacaattgcaaacttcccactccacttgatctacacactagatagctaaaggacttcagggtaggaagaatttatagcttcagctgcctttgatgagcgctttctcagaaaatctcactgaagaacctagtgtatctcagttctatttgtgttccactgaagatgagccagacttttatgaacaataaatgtactttacatcctctttttttccataaaaatttccccttccgctgcccagcttctctattttctctggctttaaatcctaggatttagaaaagcagaaaatgttacagttcaaaaggttttttaatgctccgtccaaagccactggtttgaaagaggtgttctccactttaagacgttctatctgaagaggtttggggagctaggcaaacagagcttttatttcagtgctgagtttaatgttgaatagatgatttatgtggaggaaagatttttctccttttttcttgggctggctgctaaagaacaatgacagatgttttaatggtgagtagaatgttatcaaatcgtcaacttcaaacatgggaattttatgcaacaccaaatgcttattctaaggaggctgtcctaagtctcatgcacaactttcagttatactgctaaaactgcattgttatcgttgccatatctcagaggaaaaaaggaaacattctggattaatggctttaatagatgacctaaaaggcataatgtacaaatatatcgaggcaaaagaactaattttgttctggaactctcgtaagggtctggcaactaatctttattatttttggatcctaggtagatggagtccgagagagactgtcagagcaacagtacaacagactggtggactacatcacaaagacatcttgtcacctggcccccagctgttcttccatgcaaataccatgccctgtggtggctgcagaacctcccccctccactgttaaaacataccattacctggttgatccacattttgctcaggtcttccttagtaaatttaccatggtgaaaaataaagccctgaggaaagggtttccttgagtcccctctgaggtgtttattcctgcttgtgtgatttagtttttgggtttctttgagacagggtctcactgcattgcccttgctgacctcaaattctggggttcaagcaatcctcccacctcaacccacaagtagctacgactgcaagcacctgccaccataaagggctgcattttgccaccataaagggctgcatttttttaaaaagcctaggcagctctaacatcatctgatatggacacaaggccaacagtttccttatttacatccttacctctaaaagatacttcaaagtgacaaaaacgtgttccttccccacttagagacaatgattaacagggccctatatgttcttaccacatacagaggatgcatttatttttgctctatgacacttgcaaaaatctctactgtaattaatttgggtctattaactctctgttccatcatagaatgtggccaggccttacaatggagagccagagttaaaacttcaagttgcatctgtttttgggctgagtcaccacctttgcctcatgctcctttgtctgcaaaggcctaggattctttctttaaatgaaatgcttaggactttgtggcttgttacatttgtcatttaactgcagtgctattctttgaaagctgctatgtgtattttctctgaagtctgcattttactaaaatttacaacagtctgatgattgattgattactgtccaggtacattttagaaaaagtgttcttcttccagtttgttttactaagcaaactttgagtaaatcctttgtcctatattgaatccagtcccaaagtgttcaggtgagtttctctagttccataaacaaaacatacatagtgggaactccctggtatgccatagagcacacaagaaccccaatattaatgctaacaattataccagtccattttgtttattctgtggaattgacttgacaaagcatgaagatattcccagtgtctgtctgataatattttgcatctaagaatgggtttgactcaagatcttgggttaccaagatgtcttaaatgttcagtaaatatctttcttacagtccagtagcttagagcatgtttgctgattgatattacatttaaacttggggctacagcttgttacctagaattttgagatactaagagaatgcaattttaaatgcccactggttttatttgttttggagagagggtctcattctgtcacccaggctagagtacagtgggaacagtcatggctcactgcagcttaagctcactgcctgggctcaagtgatcttactccagcctcccaagcagctgggactacaccaccacaggtatgcaccaccatacctggctgatttttaaaattttttctagagatgaggtctcactatgttgcccagctggtctcatactcctcagttcacgcattcctcccacctccacctcccaaactgctgggattacaggtgtgagccaccatgcccaacacccactgatctttaactctcacatgttgggcataagaagtcactatataattgttactggaaagcaagacttaacgaacaattctgactatgaaaaatgtctctttcagtttgttctgtaaatatttagaaaagtgacagctgtcaacctcagagtaactatttctaaaaatgtaaatatgtattaatccttgtatcttttatggtaattttgcatattgatatgaattatataaaattgtttaaaataaaaggtgtccttgaattactgaccacccatagatgtctactgttaccaggttttacaatgcaaattttcactaatacctgggtttaatacagctcacatcactgaatgttacacatgagtttaaatgggtaatatacaggttttgttataataaagttactgattaaattagctttgaataagtgtcattttttaaagttctccagtatcactttgctcgcaataaacatgaattaaagtcctaagaagacctctgaaaaagtaccatactctgcttgtcattaggagacattactcaattctagttaagtaaccttttctggattagatatatatccaaattctattacatactgttagcttgttattaataaagcaatactgagtaagaaaccctacatttgaattacctatttcaactatgtggtggtggcacagctaccaaatagtggcaatgaaggccaaggatagattttattaggattctatctcttcttagagcccacagtacagtagtcttacaggctcatgaagaacactttttaatccatagcccaagaccaagtaactgcaatgaaacggacaaactatcacagttaaagatgtgctagaacaatgaaattttaacaaaacacggaaatcaagttagcttcataaacagttaaatcccaaaccaattcttatgctagtaagtgccctgcattatcattaagaactgagaaagacttactgtccaaagtatttgttaattgtttatttatcaagaggaactatttcttagcccacatattcatgtgtcatagttcaggaacacaagtcagtgacaaacttctaggtaattcaacctgaagaaattctgtgaagagaaacacaaaggctaagttagagataaacactctctcaatactcaccatctttgaggatcaactgaggtctattcctactagtagacttcacaccttgatcactcaccctcagccacagaaaaagcacagttcaggctacctggactccaagtttcactctcctttacgctcctctaagctccctgaccactctgaatagcctcttttccattttgggcataccacaccttactctcattgcttgtgtgcattgaacaaattctgcttttttccttctcaattctatgcccaccaccgcccccacccccctgccattaacccttatagccacatactgtttctgttccaagccatatttttgttcctgtctccaaatatgttctctcatacaggtttttaaacataatcttaaaaatggtaaaaatctaacaaatttaaattagcctattaacatcttctgattataaaatgcatgctcactgtaaattttgaaaatttcaaagttaaagcagatatgttaagattataaacaaccattaatattttcttgattttttttccttaatacacatggtacccaacttatgatggtttgacttacaatttttttgactttctaatgggttttccagggtcttaaatgcatttttgacttacgatattctcaacatatgataaggtttattggaatgtaacccacatatatgtagtgcaactgaaatgcttatttaggaacactgcctgacaaaatagcagtttcacattctctgtgtcacagcaaactcatttacaaggcataaacccagactgaagtggcaaaaagaaactacattgttcttttttgttaaatatacacataagattccagagtaggaagtctcatcaaggtacttcatacatgctatcaaatcagtttagatgactttccatcagcacaccagtcagtccttttctagataatagaactttaattcacactgtccatgaggcataaggaccttgtgaatacaacagaccaaaccagacctatggaaagacagctagtcactcgtggacacccacctaacaaactatactgtcccaaatacttttttttaaaaaagtgacttctaaaagtgtaacattcgtaatgccaatctagcaattaatagcataacctataaaaatgattttgaacataaaaagtagtttcatgtcagcaagatagactgtgaagctccaggcccccaaacccccacaaaaaataatgaataaacatatggaccaaaaatttaaaaatgtttagctttatgagaactctagaaaccagttgagcagcaaccaaaggaaccacctatccaagaaaaagccacactcaaagtagcaggaaatttcatggcatttttgctcactcttgccaaatgccctcctcagtacaatagtcagaagaaaactaccctggctcttccctcaggacataaggtaaagaatgaaactgacctacaatgttctggtttgtgtggagctgcccaagggactgctttctgtcttgcctgaatcagagtgctaatgggaacaatggcatagtttggataggaggttggaaagagctgaaagcaatgatgggtaccatggcatgagtgagctgcaggggaacacagacctacagaaacctgtgggcaagagatcagagacaaaagaataacagaacagctaagactccaagaggaagctggaggcaaactcaggaaaactaagaaaaactgaaaggcagctgtgtataggaggaaactaaaactaatgcatatgcacaggcccagggaagatggcatccccaggaaaagtttgagaggacaccaagcctttatggtgcgctaatcagtgaaggcctttccatgcatggagccagtctgcaaagggacaggtagctggttttgcaaatgcctgaatttcacaaaagatcacaaggcacataaagaaatagggaaacacggacgattgaaagaaagaaatctccacaaaccaaccctaaagaaacagaggctgctgacttactctataaaaccttaagaacaactatctaaaaaatgctcaatgagctaaaggagagtgtggacaactaagcaaaattagataaacaatatataaacaagtgagaatataaacaaagagaaaattatttctaaaaaccaaacacactgtggagctgaaaaatgtagtaactgaatggggggagaaggggtcggaatcactagagggatttaacagcagactcaggcagaggaaagaatcaggaaacttcaagacagatcatttgaagttatcaagtctgaagagcaggccggacatggtggctcatgcctgtaatctgggaggccaaggcagtaggatcacctgagcctaggagttcaagaccagcccaggcaacatggtgagaccccatctctataaaattaaattaaattttaaaagtctgaagagaaaaaaaaaagtaactagcttaagatatctgactataccaagcagaccaatataggtattaccgagtcccagaagagaaaaagggcagagagcttaaaaaaacaaacaaaacacctgtcaattgagaataatacatcccacaaaacagtccttcaaaaatgaaggagaaattcccagataaaaaagtcaaaggagttttaccaattagatttgccctacagaaatgctaaagggaatccttcaagttgaaacaaaaaggacactagtcagtaactcaaagccatgtgaaaatataaagttctctggcaaagaacatagaagcttatattaaaatttggtttgtgccaggtacagtggctcatgcctgttatcccaggactttgggaggcccaggcaggcaaatcacttgaggtcaggagttcaagaccagtctggccaacacggtgaaatcccatctctactaaaaatataaaaattagctgagcacagtggggtgcatctgtaattcaagctactcgggaggctgaggcatgagaattgcttgaacccacgaggcggaagttgcagtgagccgagattgcatcactacattccagcctgggtgacagagtaagactccatctcttaaaaaaaaaaaaaaaattggtttgtaaattcatttttaattcttttataggatttaaaagacaaaagcataagaagtaactatataggtccatgttaatggatacataatatataaacacataatgtgtgatatcagtaacacaggaaaagagggtggtgctgtaaaggagttgagtttttatatgcaattgaggttgttttaagtttaaaataaatcgttctaactttagcatatttcatgtaatccccatggtaaccacaaagaaaatactgaatataaaaggaaagactgaaacatgtcactataaaataaaagagtgaggaaagaaatgagggacaaagaagctgtaagacacatagaaaacaaaatggcaatactgtgtctttatcagtaattatcttaaatgtaaatggattaaattccccaaccaaaagacaatgacagaatggattaaaaacctggatccaattatatgctgtctacaagagactcactgtagatctaaggacacacaagttgaaagtgaacgggtagaaaaagatgtcccacacatacagcaaccaggagaacaggggtagctacactaaatcagacaaaatagaccaagtctaaaatgtttcaagagacaaaaaagaacattctataatttaaaaagattaattcaccaataagatctagcaattataaatacatatgcaccaaacatcagagctctaaatatatgaagcaaacactgacagaattgaagggagaagcagacagctctacaatagcagtagaggacttcaatactccactttcaataattgacagaacaactagatagaaggattaataagaaaacatatgacttgaacaacactacaaatcaactggacttaacaaaacactccagctaacaacagaatacacatttttcccaagagaacatggaacattctccaagacaaaccatatgttaggtcacaaaataagtcttcaattttaaaagactggaaatcatacaaagtatcttttctgatcacaatggcatgaaactagaaatcaaaagccaaaggaaaagaggaaaatccacaaatgtgtttaaattaaacagactcttaacaatcaataaattaaaaaagaaattacaaggaaatttttaaaaaactgtatcaacctaagaactagaaaaagaggaattaaacccaaatgtagctgaataatattaaacaaaatgactacaatagagaaaaatcaaagccaacagttagttctttgaaaagatcaaatcaacaaacctttagtcagactaataaaaaaagagaaccaccaactaacagagggaacattacaactgattttacagatctaaaaaggagtgagaatgctatgaacaattatatgtaaacaaactggatgacctaatgaaatagaaatacataactcaaaaaaaaattttgtgggggagtggggacagcatctccctctgatgcctaggctggagtgcagtggtacaatcactgctcactgcagccttgacctcccaggctcaggtaatcttcccaggtagctgggactgcaggcgtgtgccatcacacccacattattttttgtattttttttgtagagacggggtttcgccatgttgcccaggctggtttcaaactcctgggctcaagcaattcacctgctttggtctcccaaagtgctgggattacaggccttatgagctaccacacccactctagaaacacaatctaaccaagactggatcaggaaaacaataatctgaacgtctataactagtaggaatttttaatcagtagccaaaaacttcaaaaaacaagagtccaagaccatatggtgaatcctaccaaacttttttgagacagggtctcatattctgttatccaggatggagtgcagtggtgtgatcatagcttatgcagccttaaactcctgtgctcaagtgaacctcctgcctcagcctcccaagtaactgagactacaggcatgtaccaccacacccagctaactatatatatatctgtgtgtgtgtatatatatgtgtgtgtgtgtatatatgtatgtgtgtgtgtgtgtgtgtgtatatatatatatatattttttttttttggtagagatggggtcttgccatgttgcacaggctgatctctaacttctggattatagtgatcctcctttctcagcctcccaaagtgctgggattacaggcatgagccaccatgcccagccctctatgaaaccagcaccaatcctcctcaagtttttccaaaaacagtgaggaaaagggaacatttccacattcattctataaggccagcattatcctgatatcaaagacaaacacacgagaaaactataggccaaatcctttaacacagatgcaaaaatcgtcaacaaaacactagcaaaccagatttgacatcgcattaaaagaatcatgtactatgattaagtgggatttatccctaggatgcaaggatagttcaacatatgcaaatcaatagatgtgacataccacactgacagaatgaaggataaaaaacacatctcaaaaaatgcagaaaaagtacttgacaaaattcaacatcctttcatgatcaaaactatcaacagaaggaatgtacttcaacccaacaatggccaaaaaggacaagtctagtatactgaacatggaaaacgtgaaagcttttcctctaatacctagaaccagacaaggatgcccgctcttgccacttctattcattgtagtactggaagtcctagccagagcaatgaggcaagaaggaataagcaacatccaaaaaggaaaggagtaagtaaaactatctgtttacagatcatataatcttacctccagcaaaccctaaagatttctaacacacaagtgtcagaatacatgaattctactaagttggaggatacaaaaatcagctctttctacacaccaacaatgaaggaaataaaggaatgcctaataaaggaaattaagaaaataattctatttataatagcaccaaaaataatacttaggaatgtatttaatcaggaatatgaaagacttaaacactgacctagatgaaacagatatatacctgtatactgctaaaaaaattagcaaatctcattcatgcaatccccatggtaaccacaaagaaaatacagaatatacacataaggaagtaagaaggaaactgaaacatgtcactataaaataaaggaaaagtacggaaagaaatgtgtgtccttggacacattgttttgattatagtagtctccttttatccaaggtgatatgtttcaagacccttccagtgaattactgaaactatggatggtaccaaaccctatacagctacgttttttcctatatatacacatacctataataaagcttaactcataaattaggcatagtaagagagtagcaacactaaaagaaattaaagatgcaaactactgctaaaagaaattaaagatacaaataagaggaaagacatcctgtgttcatggattggaatacttaatattgttacgatgtccatactaccaaagtaatctacagatttaatgcaatccctatcaaaatcccaatggcatttttacagaaatagaaaaatccatcctaaaattcacagactcttaaggaaccacaaatagctagagcaccctccgggtggggtgaaagaaagaacaaagctagaggactcacacttactgattttaaagcatactacaaagctacagtgtagcagtcatcccttatttgtggtttaaccttccaccgctttagttctacccacagtcaactgtggttcaaaaacaggtgagtacagtacagcaagatattgagagatcacattcaccttttattactatacactacaattgttctattttgttattgttgctcatctcttactatgtctaatttatgagttaaacgtcatcataggtatgtacgtacacgaaaaacaacataatatatacagggtttggtactatctgtggtttcaagaatccactagaggggtcttgaaacatatcttagataaaacggactactgtaatcaaaacagtgtagtactgccccgaagacagacatacagactaaagaaatagcccagaaataaactctcgcatttagagtcaaatgatttcaccaaggtaccaagaccactccatggaagaggacaatcttaaatgatttcgggaaaactggataccacatgtaaaagaatacagttggatctttacaccctacacaaaaattcaagtgaatcaaagatctaaacataagagctaaaactataaaagtcttagaagaacacataaaaaagacttcatgacattggatttggcaatgatttattgaatatgacactaaaagcacacagaacaaaaataaaaataaattcgacatcaaaatttctgtgcatcaagggacacaacagagtgaaaaggcaacctatgaaatgggagaaaatatttacaaatcatatctgataaggggttaatatccagaatatatacagaacaactcaaccaataaacaaaaaaccaaatttgaaaatgagcagaactgaataaacatttctccaaagataacatacaaatggccaataagtacatgaaaagatgctcaagaacacaaataatcagggaaatgcaaatcaaaaccacaatgataccacctcatacctattaggatggctactatcaaaaaataccaaaattatgccaggcacagtggctcacgcctgtaatcccaacgctttgggaggccaaggtggacggatcgcctgagcccaggaattcaagcacagcccaggtaatatggtgaaaccctgtctctactaaaaataaagaagttagccaggtgtggtggcacatgcctatagtgccagcttcttgggaggctgaggcaggaagatcccttgagcctgggaggttgaggctgcagtgagccatgatcgcactacagcactacggcctgggtgacagagggagaccctgttaaaaaaaaaattaacaagtgttggggaggatggaaagagtgtaaaatggtgcagccactatggaaaagggtatggcagtttcttaagaaattaaaaatcatatgatccaggaattccacttttgaatataccccaaaagaattgatagcaaggccttgaaggaatatttgcatgcctaggttcacagcatcactcacaacaatcaaaaagtggaagcaacccaagcatctactgatggatgaatggataacaatgtgacacaactaaaatagatcattcagctttaaaaagaaaggaaattctgacacatgctgtaacatggatgaaccttgagtacactacgctaagtgaaataagccagtcacaagaaaacaaatactgtgtgattctacttatgagatgcctggggtagccaaattcttagaaagtaacacagtggctgccagggtctgagtggaggtgtgaatgggttgcttaatggatatagggtttcaattctgtaagatgacgagttctggagactggttgcacaacaatgtgaatgaacttaacactactaaactgtacaattaaaaatggttaagatggcaaattttatattatagatgctccttaacttaccatcaggttacattctgataaaaccatcataagtttaaaatatcttaagttgaaaatgcatttaatacacctaacttacatcatagcttagccttccctaccttaaatgtgctcagaacacttatgttagcctacagctgaagaaaatcatctaacacaaagcctagcttataataaaacactgagtatctcacacaacactacagagtacagcatcagctgtttacccttgtgattatgtttctgactgggggatgtggtcattggtgctcccccacatcacaaaagtattgtgccacttattgctcatgtggacaaagatcaaaattcaaagtatggtttctaccaaatgtgtatcacttccacaccatcgtaaagtcaaaaaatcttaagtctaaacattgtgagggacagtcacctgtatttgcattttaccacaattagaaatttttttttaagtaacttcaaataaccatattacctttatattccaagattactttacactctgaaagataccagccttcctcatctcctcaaaatctttcatgacatcgtagtttctgtagaaatctgcgtatgccttctttctttgatcagccacacgaaactaaaaagcaaccatccattagagtttatttttcagattactggaaattagattccagattataatatataaagacaaggtagaacacatgtttttgttcaccctttaatttaaaccctacatttcctaaggggtggaggtggtgacagataaaaaggaagacaaagtctaagaaactgctaaatttgcaaagaaaagaatggggaataaggtgtctattttgttttgttcgaggtttccgtacacaaagggtgggtggggttcaacagagaaagaaaaaatgaagattcaagacaaaaatggaaagtttaagtgacttattattttttttaaagatggggtctcgcctgtagtcccagctactcgggaggctgaggcaggagaatggcgtgaacccgggagacggaggttgcagtgagccgagatctcaccactgcactccagcctgggggacagagcgagactctgtctcaaaaaaataaaaaataaaaaaaaataaaaaataaaaaaaaaataaaaaataaaaaagatggggtctccctctgcagaaatacacagaaatcatgctacttgatggagtaacgcagtaagaatcctttacctgaccagttttactgcttcacttctatttgaattcccaatttcttcccagtaataaaatcaagaggcagaggtcgggcatggtggctcatgcctacaatcccagcactttgggaggccaaggggggcgaatcacaaggtcaggaattggagaccagcctggccaacatgatgaaaccccatctctactaaaaatacaaaaattagccaggcatggtggtgggcacctgtaatcccagctacttgggaggctgaggcaggagaattgcttgaacctgggaggcctcggagggtacagtgagccgagatggtgacgctgcactctagcctgggtgacagagcaagactccgtcttgaaaaaattaaaataaaaagaggcagaagcacaagtgctgggggccatcattacatgtacggttaatttggactctccctacctcacttagtcatccatctgacagagagacagccaagggtcctagcaaaaacccaccttcaagcctaaaacagcctgaaggctgaaaggccagactgttggacccagatcccacgaccctgagggagagctgcacatttgcccaccctttcaggactgattctttttgagtaatggccacaggcacactgggggaacagggtggaaccaggagaagctgcaccttgtgcagtggggaggagcctagtctcttcagctcctgtgtggtagcctagtattcaatctgtgaggtgggggcctgttagcaggaccccctcttgctttgctgagagtctgttttcttttttccttttcacccaataaattcagccctcctcacccttcaatgtttccatgtgcctaattcctcctggtcatgacacaagaacccaaatttagctaaactaaggagcaaaaattctgcatcacatccatcccttctacaaacatttacttcatgcccactatatatgccaggcagcaggaatctcaaggaccaaaagactttgtgtgcttgtctctccaaagagtcccaaagcataggtccacttagtgctcccactcagtgttccatctcctctttgctctcccagttctccctaacttttttttttgagacaaagtctggctctatcgcccagcctggagtgcagcggcacgatctcggctcactgcaacctccacctcccaatttttttttttttttttgagacagagtctcgctcttgttgcccaggctggagtgtaatggtgcgaactcggctcactgtaacctccccttcctgggttcaagcaattctcctgcctcagcctgccgagcagctgggattacaggtgcccgacaccacgcccggctaatttttttgtatttttagtagagatggggtttcaccatgtaggccaggctggtctcgaactcctgacctcaggtgatctgcccgcctcagcctcccaaagtgctgggataactggcatgagccactgtacctggcctcgcctcccaatcttggctgacacctctgcctcccaggctaaagccaacctcccacctcaacttcctgagtagctagggccacaggcacatcatgtatttttgtatttttagaagaaatgcgaccgggtgcggtggctcacgcctataatcccagcactttgggaggccgaggcgggcggatcatgaggtcaggagatgggagaccatcctggctaacacggtgaaaccccgtctctactaaaaaatacacaaaaaattagccgggtgtggtggcggacgcctgtagtcccagctactcaggaggctgaggcaggagaatggcgtgaacccgggaggcggagcttgcactgagctgagttcacgccactgcactccagcatgggcaacagagtgagactccatctcaaaaaaacaaaaaaaaaaagaagaaaggcccagctaatttttgtattttagtagagacgtagtttctccatatcgcccaggctggtcttgaactcgtgagctcaagcaatccgcccacctcagcttcccaaagtgccaggattacaggcatgagacaccagacccagcccctctccctaacttgcaaggctcaaattccacctcctctatcaaatagctatgacccacaataactgtgaaccacaacatcccccaaaaccattctttcagttatgttctatcttgcaatgtcttctaatttttttcacctccccaacttgactctaagttctttaagaacagagatttagctacatgccttttgtgtcctccaaagcacttgaaactctacattacccaacactgtactgaattttatacactgcctcttattcaacaggtccttttaataacctatttgtgtgtcaggcacccaacaacagggtgccacagtaaacaaaagacatggtacctgccttaatgaggctcacagcccagtaaagaacataaacactaaacaaaaattaaatacaaagagttataaaagcaaagctctgaattctttcatggggtattatgacaagcatgataaacatatacatattatcaaaaacatttttacggaaaagttgtaaatgtgcagcctttgattaaaaataaagggcataacaaaatccacattaggcagagtgttaaaacgcaattctgtgacaattactcaaggtgtcaaacagaactataatcggcccaccattcctgcacgttccacactcatggattcaaaataataaaaaatgctacaaaattaaaaatacaatataaactattgacatagcatttacattgcattaggcattataagtagtccagagatgatttaaaatatcgtcagggctcctgaaccaattccccatggatagaggggcagctatgctgccttcccagcccctctgcatactagcttctgtaatgggttgaattgtgtttgaccaaaactcatgtgtttaagtcctaactctcagtacctcagaatctaaacgttttttggaaataagggctttataactaagttaaaatgaggcctttagggtgggccctaatccaatatgagtgatgttcttttaagaaattcagcaggccaggtgtggtggctcatgcctgtaatcccagcactttagcaggccaaggcaggtgaatcccttgagcccaggagttcaagaccagcctgaacaacgtggccatctctgaaacctcatctctacaaaaaatataaaaattagccagttccggtggtgtgtacctgcagtcccaggtaccgggagacagagtaagaccctgtttcaaagaaagaaaaaggaaagaaggaaagaaaatgaaaagaagggcagaaaaaggaaaggaaggaaaggtaaaggaaaagaaagggaaagaagttcagctacagatatatgcccacagaggaccctgtgaagacaaagggagccatctacaagccaacagaggcctcagaagatatcaaccctgccaacagatttctagcctccagaactgcgagcaaatttaaggcacccagtctgtggttctttgttacggcattccagcaaactaacaagcttcatttaaagatggaggacaagctatagttcctgtcacactgaggtgagtgcagaaagggttagaaagaaacacattacaagggggagtttctttaaaagatttttcaaccaaaaacacatactttatgaccttcggcacaaagtaaaaaacatacataccttatacaaagctgcaacccccagggatagcacgaatgctacagccatatgatttcgcagacgcctggccagaaggccacgcatccgaggttttggcaaaacttcgggagccatggtagttactgtccttgatacgtatgctaaccttaagagattcagaaaatatgattaagtacagagtttatttaagccacaaacttgagaatggccacctggaagcattgattggagctgccctgaatatacactccgattagcagcagttacaaatgaatgtttttcttttttggcagaaacagggtctagctatgctccccaggctggtcttaaactcctgccctcaagtgatcatcctacctcgtcctcccaaagtgctgggattccggcctacaagtgagttaagaaaaaatgagaggcaattcctaaactgtttatcaaaaatttacattaaaataacataagctattgactgactaaacgctgtcctttatatcacaaattcaggaataagatttgggttgagacatgggtgaggggcggcactgaagtccaatactcaggtctctgcgtcctgcatacctcatgtagctctcactactctgagctttttttccctttctcgggtaaaataataaaagaaaaactcagaaaagatatcaaaaggaattctcatgcatagtacattttactacctagagaggcacagcacgacagtggatggattcctcccacaaagcctaagctgtctcttggcttagcctgtttcatcttccccccgccccccatatactgagcgaccaccctaaataaacgcgacaaactgcggcacactagtaatggacgagcaaaggcaacaaaaatctttccaacaacaagaaaaataagcagtagctccgcattggtaattaacgattgcaaacccatttatgcaacactttctcttctaaaaattttctgtccactcgttaaaccttcgcgacaaccctgtcagatcatgaggcaggtgttttccacggtcacacggtataccattaaaacctggacgggaacgcggcaaataccatgagggcccaaattccctaactgctcctttgcccagcctcacctaaagacctaaggggcctaaaaacttttgcgtccctgctggccttcagctaacgcggccgggggtaggatgggaagccgtggggcaagggaggttgcaggaagcccatccttcccctcctgcggcaggtacggtgaccctcctccagttttccagctctaatttaaaacgctgccacacagcgagcgacgctgccagctgcttcgcctacactaacccttgcgcctcacgaccagctgcattagaaaccaccaccccttttctcacgggagaaacaccggggccagataggtcaaatgacctcaccaaggtcacaatggctgtgaaaaagcgcagcgggtaccagccccgggccagctcactccgaagccagctgggttctcgagggtcccgcagcccacccggcttcggtggggccgtcgcaacccaccccggtccgtggtccgcccgccgccctccctcaggccgcagcggaagcgtgagagagtagatgcgggagaggcctgaagctgcaccacggcggagacacacagtcacgactaaatccgaggcagagagaaagcgggagggtgccgttgtgacaacccgcagtgtcggggtagggatgcaaaagggaccggactcacctcaacaccaacgtccttcctgactaaaggaaaaacgaaccgtgctgtagccgcgcgcaggcgcagaataagagtgcacagcgagaacgcggcgacggtagccgaaggagttcaaaagacctctagtgcgcccaccgcaggtgacagccgaagttcatttcgtggtctgcttctttcctgtgtgaccttgcaaaacgggcttgacctccttatttatcgacctctttatcttcttagtaaattgaagatattagtcgtactcatacacagagtcccaaaccatgtgcacaaaccgacattttaattataaccaaccttacgcgaataaccgtttggcttgggtaaaagtgaaaaagctgacttctaggagctcacagcccagaagatgaaaaagacaaacagattaataccgatcccatgcagtgggcactaccacagagacgtggcccagctactgcagaagcaattctctacctggcaaagctgaggacgttttgatagaggggcggtatttttgtgggtttcttaagaaaacaaggattttgaaggaaggcaactggaagttcgtggaaagtggtgtagaagggtgaggctcttgtgccttaatgatgccaggctgtttgtattgaaataacctgaattttaaaagcattatttaagtcaacccatcaagccctgtggaaggtagctgggacacaacagatgcatgatattgagtcgatatatacactgagtacctactatgtgccagattctgctaaacaagaggacagatcttcggggagtctcattctgatcagggagtctttgtcctcaacctattaaccaacactctggagggtgaaacctggccacaaagaaaggtgctcaattgaggttcaaaagtaggtttggactttaccaacgtttttcaggcctcttatcaagggtctacccagctgaaaatctttgcatggaatttgtccagagagtaatttgtttctactctctttccatccccacccccagagaagaagtggtgaacttaagagttcacagggattagtgtatgtgaaaccatcagggaaagcttcagacaatacgtggaagagatggaagcagagctgagtttcagtctaatggaaagcctggaaaactggagaaattggagagaaaacattggctgggagaacatggcaaagacaggcacactcagggcacagagcctgacctgagtgaaatactgagtgtttgttctgtgcttccctagctatccagtgaaccatagtgaatgactgagggtgacacgtgaataaaacctgagcgatagatgaagagagacatgttacatataggttctgttctagagccgaacagacctggatttgagtcccagctcatcaacttgtagcggcaaatttcttcatctttctaagtctgctttctcctctaaaaatagtacccattttgttgggttgtgatgtaaattaaatgggataatgtatatgcagcttgagtatcccttatctgaaatatttgagaccagaagtgtttcagattttggattttttcagatttttgagtatttgcagaatacatgccagttgagcatcccaatctgaaaatctgaaatccaaaatgctccactgagcatttccttgagcatcacatcagtgctcaaaaagttttggattttggagcgttttggattttggattttcagattaagggtgttcaacctatacagtgcttgacaaacagacattctgaatatgcattcctccctgtgttcttttgcctgtcctgcattccttcaatctttcttttagtagcagtgcttaatcaatccttcatcacttctagccatgtgattctacaacagtcaaatcttattccagactgggtgtggtggctcacacctgtaatcccagcactttgggaggccaaggaaggcagattacttgagcccaggtgttggagaccaacctgagcaacatagaccaccatctccataaaaaactttaaaacttagccgggcatagtgtgatttatgcctatagtcccagctactcaggaggctgaggctggaggatcacttgagcccaagagttgcaggctgtagtgagctatgactgcaccactgtactccagccagacagagtgagaccctgtctttaaaaagaaaaagaaaaaacattattccagttgagcagatgacccaagagtagccaagcaatgtagcccatccccttggccacagtaatttgttgaggatgggcacaggattctggccaggccagtgaaactcaattctatgacttctgttgaaactactgggggaaaagatatctttttatagagagaggagtttgcattgggttgcagtaggggtcttgcagatctgtgagagtataaagccagagggtactgtgtgcctataatgtgccaagcacagcacatgacaaaatggcatgaaaagcctcatgaagctttcattctagtgggcttcgaggaaaaaaccaacaaaaataaaaaatatatctgaaggaggtaagtggaatggaaacaacagagtaggggtaaagaaagtctgtgtgaagaggtatctttttatattgaaaggttgatgaaacaacccatgaaacaagcccatggtcttcactaaactaaaagatgcctcagtggaaagactaggcttgttctgcatagccctaaggaataaagtaggatggatgggtggaagatactgggagttagatgtcagttaagtattccccatggctagaaatcagtccctttcaaggtcatcctcaaccagagacacatccacttgggggagacaaggatcccttaattggtaaagaggcataccaacagtcttgttcccactatatctctccattctggccttgacaatcaccaggtcagcatgttaccttaaaatgtgttgataagatgccactttttaaatacaaacttagggggaagtggggtccagggtagggaaacagctggttgcatggcaagagtgatgccgtcttgaagaaaaactgccatgatgaccgatgtttgactactgcataccaaggtgtttccatggcatggataaaccctcataaagatgtttatctaacctccccagtggtcacaagttttgctagaaagtctgaggcatgaccagctgcatgttttaccaaaaaagcttgctatatagaggatattttctggagcacagatgcggggatctaccatccctcagccaacagagagattgtttctgttcctaagtcccttttaaatgtttcttcctgagaaactggatttgtcagtctctctcttcagcctttgggggcaagtttgcatagacctgctcaccactgttccttgttaactgtgaatcctgtccttaggacaaaagacccttgaccattaatctttcccttaggcagatttatcagcctctttttcagcctttcagcttcctcagacttttgggggtaggtttgcctaggctgcctaccgcagcacacccaggaacatgctggctcctccatcactatcctgctctgaacatgcttttgagaaaacctgacctctcacctgtgctgcagcctttcctattgtggaaagtgtatacaacacctagaaaggcaaattacaatgccaagagctaaaaggaatgaaatggaccctgaaacaaattaggcagtagtcactcggaagagtggaaaactttcaatccttttgaccataaggtatatcactaatacagtatcagtgggaagggccagaaataattttatggattaagaaaatgtgaggggctcagaagttaaaaagcaacaacagaaacaagctctatctgaggtaaaatagcagcagctgcaatatttgacaaacctcagaggtagatctactgactcttacatataatttatttccactttcaaatttaacaaataatgagagtgttgagtcagagttagatcctagagttcagagacaacaggctgggcatggtggctcacacctgtaatcccagcactttggaggccaaggtgggaggataacttgaagccaggagttcaaggccagcctgggcaatatagtgagacccccatccctataaaaaaaaaaccaaaactttttttttttttaattagcctggtgtggtggctcatgcctgtagtctcaactactcaggaggctgaggcaggaggatcacttgatcccaggagttcaagactgcagttagtgagctacactgcactctagcctgggtgacagagtaagaccctgtctctaatggagagatagagaaagagagagagagagagagaggcatttttctctttactattcattattaccaagaaaatctaggatttcagagatgcagcccaataatgtaactagacttcctattctgccttcccactgattaataaataagaaatcaccagccagattcaacagggaaacttatctgaaagtggacaggaaaaaaggaggcatattctttcccctagaattatattctaagaattcagttgaggatatggaccatcacaaggcttgagtctggggtactttatttgacctgactatatccaacatgtaaataaggatccaagggaactcataagggctaataaaacaatactgtggtttcttctgtgatgttgttattgactaagaaaatgctgtgagtgatgatctgcaaatgatcccctgctcttaaagactgatgacatttaacatagttccaggtgaggtgaggtttgctggctctacatgcctccaaaaacggcagcctctaccagagagatccttcactgtcactgatgctgtttggcatggggcttgggaggcacaggaagaccggatgtggtttaagaaggcacctggaggagtgttccaagctcatcagcggtagcagtgtcccatatatagagttttcactgcagcttatgacaaacaacagggacagttcagaggaaacctgattcatttctcaaaatggtcccacacctcaccttaaataggagcggcatggtgaaagttcgtaataatttctttttttctttttcttttcttttcttttttttttttttttttttgagacagagcctcactctgtaaagtctcactgtcattcagagccagagtgcagtggcgcaatctcagctcactgcaaactccgcctcccaggttcaagtgattctcctgtctcagcctcctgagtagctgggattacaggtgtgtgccaccatgtccggttaatttttgtattttgggtagagatggggtttcaccatgttggccaagctggtctcgaactcctgaccgcaagtgatccacctgcctcagcctcccaaagtgctaggattacaggcgtgagccatcacgactggtcccaaataacttcttaaatcagttgtgtgatgaataagtatttccatgtaaaatcttacctaggccaggtgcggtggctcacgcctacaatcccaacactctggtaggccaaggcaggaggattgcttgaccccaggagttcaagatcagcctgggcaacacagtaagaccctgtctctaattttaaaaaataaaaataaataaaatgtgttagaacagtgctacccaatgtaattataaagctagccatgcggataatgttaaattttctagtagctacattaaaaaaagtaaaaagacacaaatgaaattagttttaataatatatttaacccaatataaccaaactattatttcaatatgaaattaacataaaaattattagatatttcacattcatttttcatactcaatctttaaattctagtgtgtatttttcacttacagtacagcaagcccttgaataacatcgtttggcttaacactgtttcattgtaactttgatttaaacaatcaattcctggctgaggccactctgtatgtgaagtttgcatgttctccccatgtctgcgtgggttttctctgggtactctggtttcctcccacatccaaaagatgtgcgtgttaggaggattagatgtctaaatggttccagtgtgagtaagtgtgtgtgtgtgtgtgtgtgtgtgtgtgtgtgtgacagggagagagagagagacagagagagagtgttcccttgggatggaatggtgtcctgtccaggattggttcctaccttgtgctctgagctagctccaacttccaatgaccctgaactgaaataattgggtaaataattatcttacttgtttatttttttttaatttattctttttttttttttgagacaagagtcttgctatgttgcccagacttgtctggaactcctggactcaagtgatcctcttgcctcaggctcccaaagtgttggaattacagcctgagccactatgcctggccttgttttcattaatctttccaagatttatgtatttattacattttgtattacatttatttcagtgtttaatattagaagtgttttggtccttatttaaaagttgatgaggtttttgtaaccagaaatatgccgatggaatttacctcttgtttatgtcaattagcccatggtaaaactggttttgttgtacatcgttttgcttaaagtcacagtttccaagaacctattaatgacattaagtgaggacttactgtacgtctcaattcaaattagtcacatttcaagttctaaatagccatatgtgactgtattggatagcacaatgagaacattttactcataagaaaatgctcatgagccattgctaaatgaaaaggcaagctgcaaaggtatgccacgtgatctaattttgtaacatgtgcatacacttatacatatgtactgtatatataagcaggaaataatactgaaagggtatataccaaaaacttgtaatttttacattttatttttatgcaatccaaattttatcatgtcttacttttatggttagaaaaaaataataataaatgtgattttttaaaaagaggtgtatttgcttcctattgttgctgtaacacactgccacaaatgtagtggcttagaaccacacacattcattatcttgcagttcggtagttcaaaagtctgacacaggtctcactagattcaacttaatgcatcagcaaggtcgcattccttccagaggctctagaagaggaagaatctgtgcccttttctagcttcaaggggctgcctgtacttcttggctcatagttcccttctttcattttcaaagccagctccatcacatctcttcctctgcctctccttttctccctccctcttccccattctcccttgtgattatattggccccacctggataatggagaccagtctccctattttggtgtcacctggttagcaagcttaattccacctgcaatcttatttccctttgctatgtaacatatcataatccagggatcagtacatagacatctttgaagggctgttatccttcctaccacaggaggtatggtcatgattagtactgtataactaatatttccattctcctttcagacacacagtagggttatacttccttgttcccttcaaagcagccacatgacttgctttggccaatgcaatatgagtggaagtggcatgtgtcctttccaggtagatgctttataagacagcatgtgatttactactttctctttgccctgcctttgataggatggaagtattgaaggagatggcacttatgtcatcacctatgtctcacctgggtctgtgagacactaggatgagcagagtcctcctaccaacctgtggtggccagatatggtgagggagaaataagtggtatgtcactccactgagcttcaggggttgtttggtcctacagacaaatagctcatcctgactggtacaggaggttaaaaaaaatacaagtatctaactggcaagagatggtatctcattgtggttttgacttgcatttctctaatgaccagtgatgatgagctttttttcatatgttttttggctgcataaatgtcttcttttgagaagtgtcttttcatatcctttgtccactttttgatgggattacattttttcttgtaaatttgtttaagttctttgtagattctggatattagccctttgtcagatggatagattgcaaaacttttctcccattctgtaggttacctgttcactctgatgatagtttcttttgctgtgcagaagctctttagtttaataagatcccatttgtcaattttggcttttgttgccattgcttttggtgttttagacatgaagtctttgcccatgcctatgtcctgaatggcattgtccaggttttcttctaggatttttacggttttaggtcttacgtttaagtctttaatccaccttgggttaatttttgtataaggtgtaaggaaggggtccagtttcatttttctgcatatggccagccagttttcccaacaccatttattagatagggaatcctttccccattgctagtttgtgtcaggtttgtcaaagatcagatggttgtagatgtgtggtgttatttctgaggcctctgttctgttccattggtctatatatctgtttttgtacgagtatcatgctgtttttgttactgtagccttatagtatagtttcaagtcaggtagcatgatgcctccagcattgttatttttgcttagggttgtcttggctatgcaggctcttttttggttccatatgaagtttaaagtagtttttcccaattctgtgaagaaagtcattggtagcttgatggggatagcattgaatctataaattactttgggctgtatggccattttcacgatattgattcttcctatccatgagcatggaatgtttttctatttatttgtgtcctatcttacttccttgagcagtggtctgtagttctccttgaagaggtccttcacatctcttgtaagttgtattcctaggtattttattctcttagtagcaattacgaatgggagttcactcatgatttggctctctgtttctctgttactggtgtgtagaaatgcttgtgatttttgcacattgatttttgtatcctgagaccttgctcaagttgcttatcagcttaaggagattttgggctgagatggtggcattttctaaatatacaatcatgtcatctgcaaacagagacaatttgacttcctctttttctatttgaatactctttatttatttatcttgcctgatagcctgatggccagaaactccaatactatgttgaataggagtagtgagagagggcatccttgtcttgtgatcattaaaaagtcaggaaacaacaaatgctggagaggatgtggagaaataggaacgcttttacactgttggtgggagtgtaaattagttcagtcattgtggaagacagtgtggtgattcctcaaggatctagaactagaaatactatttgaccaagcaatcccattactgggtatatacccaaaggattataaatcattctactataaagacacatgcacatgtatgtttattgcagcactattcacaatagcaaagacttggaaccaacccaaatgcccatcaatgatagattggattaagaaaatgtggcacatatacaccatggaatactatgcagccataaaaaaggatgagttcatgtcctttgcagggacatggatgaagctggaaaccatcattcttagcaaactaacacaagaacagaaaaccaaacactgcatgttctcactcataagtgggagttgagcaatgagaacacatggacacagggaaggcaacatcacacactggcccctgtcacagggtggggggctaggggagggatagcatttagagaaatacctaatgtaggtgaagagttgatgggtgcagcaaaccaccatggcacgtgtatacctatgtaacaaaactgcacgttccacacatttaccccagagcttaacatataattaaaaaaaagaaaagaaatcttgtgaaaggcaaaatgatggtggcaatctcattgtgctttaacctgaagtatataaattactctgataaattaaacacagagaaatttccttataaagccataaaacattagcattttcccagaaatcagatattgagtttttgctctccaactcccaaatcaaaatgttgcagtaaaatgtttgttttaatacatttttttctttgctgtaaaataaataaataaataaatacaagtatctgttttagttagggatgcatgtgtgtgaacgctgaggcagataaactgagtgacagagacggtgggaatgtaaaaaagtaatggggacattaagatgggcctggaaataagctatgttgatcactacaatttcttctaaattgaaaacaaaatggaatggtggagcccagcccttcaacattaggggcctccctgtgctcagccctgactaacctctagagaagctgtgaagagaccctgagttttgaaatagaatctgtcctctgcttaagagtcctgctttgctgctgacctaggggaacgctggatgtttgggtcccttcgggggttgagtgcctgaggcaccagcttcccaagacttctcatggagtactgaattctaggagactctgggctcccctgaagcttgtacgtggattggggacaatgttttctagcctctccaagggctgagttcctgcctcactctattcgtaagccctacgtagcccctagtcgtttgtaaaacatgttcacatatgttttcattttgtcctctcaataatcctgtgagataagcaggaattcctttattttattttattttatttatttatttagagacagagtctcactctgtcacctaggctggagtgcatggcacaatcacagctctctgcagcctcggactcctgggctcaagtgatcctcctgcctcagcctcctgagtagctggccacacccagctcattaaaaatttttttttgttattgagacaggggcttgctatgttccctaggctggtctcaaacccctgggctcaagtgatcctcccatctcagcctcccaaagtgtggggattaaaggcataaaacaccacatctgtctctggtttttagataaacaaactgagggtcatagtggtagaaaaacagaaacactgggactggaatctagagtgtgagaatccagagattgccttccacagcagggctgtagagagcacatccaaggaaacaaatccatctcagtggataacactcattagcctaggatggttcactgagcaccgatggtgtgccctgtgtggttgtccctaatggctgagaggatagtcccaagccactgaggacacttcctaaatcagtagatcattccagagccttcagtttcttttagttgaattgataaatcctcctggcccctacttagagaatcaaagaggttatttattcagatgatgaggtctgtgcaataactaagtaccagatatttgtgttcctttgggcatttcagaggcagtactaattaaaacaattttcccagaagcaggctgacgtcaatcacagaagctatacacagagatgacctggcctgataatggcctttatgaaatgaagctgttaaatgaaagagtcacgttaaactcagctgcattttgaatacagagacagcaaaaaatttaagtttactagatgagaaaaaaaaaaaaacaagaggagcgggaaatacctattttaacttctaagaggatacagcaaagtgtccagataggacacttgataatgacttttaaaatgattttttttaaaaaaggatgtcttagcagtttctttggaattccactttgaacttatgtttattttaatttatggatgtggtgaactagtcaaattcaacaaacatggatatctttagcttccacatgctcttctgagtaaacagtagctgtgttgacagcaggacacagtcgttagaatattgtatggtcaccctgacactgccacatttaaaatctggaggtgtagggcatagtggctcatgcctgtaatctcagcactttgagaggctcaggcagtagggtcacttgaggccaaaatttcaagaccagcctgggcaacatagcaagaccctgtctctacaaaataataaaaaatgagccaggcatggtggcatgcacctgtatccccagctactcaggaggctgagacgggaggatcgctcaagcccaggaggttgaggttagactgatccatgatcatgccactgcactccagcttgggtgtcagattgagacactgccacttaaaaaaaatagaaatacacattgaaatatttaccaatcaaatggtatgatgatgatttgcttcaaaataatacaagtggggtaggcaggtgggcagatgggagtggaaggtgttgatcataggcaaataaaacctaggtcaccaactttctcttttcttttcttttccttttttttttttttttaaatagaaacagggtcttgccatgttgtccaagctgatctcaggctcaagctcctgtcttggcctcccagagttctaggattacaggtgtaagccacaactttttttttttataaagggccagatagtagctgtgggctggggtctcaaactgtgttgcccactactcaactctgccattgtaatgtgaaagtagtcacagacaaaatataaagaaatgagtgtgactgtgttccaataaaactttatttacaaaagcattcagtgggctggatttggcttttgggccataattaaatcccctctggtaaaataatcactattttagctggatcatgagtacgtgggagtacatgagtactataaacttctgtccacttttgcatatacaagaagtttgatactttccatttaaaacaatagaatgttttgagcattatttgcaagcctcagaccaatcctcagccttcttggcattcttacaagtgagtattcttgctatatccaacttgggtcatatagctttcatttcctcttttgtatataggccttccttccttccttccttcctttccttccttcccttctttctttcttttctttctttctttctctttctttcttttttctttctttctttctttctctctctctttctttctttctctctctctttccttctttcttttctttctttctttctttctttctttctctctctctctctttctttctttcgagacaaagtcttgctgtgtcgcccaggcgacagtggcacaatcttggctcactgcaacctctgcctcccgggttcaagcgattcttctgcctcagcctcccgagtagctgggactacaggcacgtgccaccatacctggctaatttttgtatttttagtagagatggggtttcaccatattggccaggctggtctcgaactcctgaccttatgatccacccaccttggcctcccaaagtgctgtgattacaggcgtgagccaccgtgcccagccatatataggcttttcaaccaaactcactccctgagcaaccacattaattttgttttggtgttcctgttttcttccatgttgagattatccagaattatattttaattttcattttttcctttcattatattttcacttttaggtcttctcattcctcttaagccattccattttaagtggaatcagaccatatctagcttttctctaaataatttaagaaacacaaatattctgttttcttttagtctcaggtgcccattctacaaatgtttactgaggctactatatgccagactttgtggtagtttctgtggaagtaagtatgaacgtagctcagttccaaactctagagagctcccagagtcctacagagcccctgtttctcacctgaacaacaaacactgtcctccaagcttcctgtatctttaatatcatcagctattcccattattggtagcattaagctcagtggatcaattacctgtgctatccccctctgccttctagagagagagattgactcaagacaagtaaagatgggtgcacccccaggagagagttctagggtgcccgaagcctaacctagagttttgtaagcttcaattatttgcacatccctatactattatgtacttaatatttttctttagattgactcatttaaaaaaatatacagccatcaaaattttgggacactaacttgggatttcccaaagtttctatctccaccattcacctgagaggaagagctttctatgcatgcacactatgctcaagggtgatcaacttgttgaagtgatttaaaccacacagcaggcaaatagtcttcaaagccatgtcttttgatttatcttttttttttttttttttttttttttaagatggggcctcactatattgcccagcctggtctcaaactcctggactcaagtgaccctcccatctcggcctcccgaagtgctggattacaggcatgagccaccgacccaacctgatttatctttttgaggaaagagaaaatttttcttttctttttaaggaaagggaagcgtctatcagaaagcaggattataaaaacaggataagcaatatgtccaaaatatacatgattctctgctcaaagggaaataaaattagatgagaggagaaggagcagggaagaggtagctggagcttgatgcttcatcagtggcagagagggggttcaggccaattctcgcaagtgctgcagagcagtgcttcttaaacattaacgtcatgcagattctgactcagcaggtctggggtgaggcctgagagtctaaatttctatcaagttccaaagtgatactgatgttgctgatccacagaccacattttgaatagcaaggctatagaacagcctaaaagttcccatgttctcccccaggcagatgggttctgagattgagctgtggaccttacaaagccagaaggcaggtgagaagggaaaaaaatagacttcaggagccaatgctcaggcatagtatgaaggactcaggaaactgcaccctgtgaaggaacagaggagacctggcaccctgtttttccctgacaacagagtaagaatcagtcagtccagagagaagagaaggaggagggggcataattctaacaaggattctgatctgaccccagaaaagatccaattttaaatcaggattgactgaatttagtcatactttctgttgctgaagaagaaatagggcacaagaactaacctgagttcagttatagagaaataaaattacaacttttgcacatgggagcacattgtataaagttcatacctactaacatttttgtttgaaagatttattatatataaatgacatacaccaaattatacattttaaaataatttttaaaataaattttgtataaaatttatatcgtagcggaacttatgtcaggatcacttgaaaaccaaataatatttttctttttttgagacagtatcttactctgtcacccaggctgtagtgcagtggcatgatcttggctcactgcaatctctgcttaccagattcaggcgattctcccatctcagcatcccaagtagcttggaccacaggtgtgcaccatcacacccagctactcttttttgtattttttgtagagataaggtttcaccatgttgcccaggatgatctcaaactcctggactcaagcgatttacctgtctcagcctcccaaagtgctggaattacaggcatgagccactgtgccaggccaaaaaccaaataattttattaatatctagttgaaggctctgagctcgactttataaaaaaaaaagttaggccaggcatggtggctcacgcctgtaatcccagaactttgggaggctaagctgggaggatcggttgaacccaggagttcaagaccagcctgggcaacatattgaaaccctatctctacaaaaagaaaaagaaaattagccaggcgtggtggtgcacgcctgtggtcccaactactggggaggctgaggtgggaggatcacttgggcccaggtggctgaggctgcagtgagccgcaatctcaccactgcactccagcctggagttttgttgttgttgttttctcaaaaaacagttaaaaaaaaaattagagcctttccacttagtctagtctggtctagtcagattgattgaaagagtaccaaaaaggcattaactttttcattatatcattcaacatgttcaatttggaaaattgcaaatatgtgccaagttgacacactggtatgatgaaaggccccatcactcagcagcagcaacagtcaaaccatgaagcatcttgttttcatcccaatcccccagcccctcccctcactgatcactttgaagcaaatctcagatattacataatttcattggtaaatatttcgttatatattctaaaagatattgtctagtatatcattatcatacctgaaacaatgatatctcttggtgtcatcaaatatccaatgttcaaatttccaagtgtcttttttttaactgcttgaatcaggatccaaataagggccatgcattgtaattggttgatatgtcttctaatttactggttttccctctatctctttttttcctcttgcaatttttgtgatttaaaaaaatgcagtgcccatgtaccacttaaaatcatattgcagtgaaaggtgtcccacaccccagagaacactgactatccatagtaacacattgtgttatatataacatatgtatgtgttgtatataacacatatatatgttgaagaccagcctgggcaacatagtgagaccctatctctacaaaaataaaaagaaaattagccacacatatatatgtgttatatataacttgcatattatatattcatttattatatatacatatatattatatgtatgtgtgatacgtaacacatgcatataatctataatatatgtattatatgtacatacatataatatatatgcattatatatacataacacatacacataatatatgtattatacatataacacatatatatagtgatatatatatatatatatatatagtgttatatataacacatagtagcacattgtgttatgtataacacaatctgtccatagtaacacactgaagttcctggcactcataagtatttgttgaaggaaagaaagggaaaggaagaagggagggagggttgggaagaagcaagagcaagaatgaataatcccccacccacccgaggctgaaggcgggcacaccagtgactcctaggtcactcttcctgcacaactgtccattttctttccagaataagtttgtcaatgctatctcattgcctgtagggtcaagtcctgagtccccagaggctggcctggagccgggagcctatgtcctcaggggccgtcctgaggcttgggcctgtggaggcagaattagcctataaaatatatgtaaaatacataaaatatatataacatagcccaaggttctgctgggacatgcctaaactctgggttcaagggttcttttcttaagttttcttaaaaattgtggtaaaatatatataacataaaatttaccatctttcctattttcaagtgtacagttcaataaagtatatttgcatggatgtacaatcaatctccagacttttttatcttgcaaaacagaaagtctatacccattaaacaactccccagtcccccttctccatgaccctgggaactaccattctactttctgtctctatgaatcgactactttagtttcctcatacaggtagaatcataccatatctgtctctttgtgatgggcttatttcacttagcataatgtcctcaaggtcaaccatgctgtagcatgtgtcagaatttccttctattttaaggctgaataataatccattgcatgtgtcttagtccatattgtgttgttactacacatcagctcatctgctggtgctgcctcacaacatggtggaaggtcagaggggaaacagaaacacgtgagaggcaaaacctgaggtgcatcctggctttatgacaacccattcttgtaggaactaatccattccctcaagaacaagaacccattactgtgagaatgcatcaagccatctgtgagggattcatccccatcacccagactcctcccactaggccccacctcccaacacagccacattggggattgactttcaacatgagttttggtggggacaaaccatacccaaatgacagcagtatgtatataccacattttgcatatccatttatttgtcaataaatatgtccaaaaggaggctgcatccaccttttggctattgtgaatagcactgctgtaaatatgcatgtgcaaataactgtttgagttcctgctttgagtttcttcacagatatgcccagaaagggggtgatatggtttggctgtgtccccacccaaatctcatcttgaattgtagctcccataattcccttgggttgtgggagggacccagtgagagataattgaatcagggggatggtttcccccatactgttctcgtggtagtgaataaatctcacaagatttgatggttttataaggggtttccgctttctcttattcctcattctctcttgccactgccatgtaagaagtgccttttgccttctgccatgattgtgaggcctccccagccacgtggaactgtgagtccattaaacctatttttccttccagtcttgggtatgtatttatcgcagcatgaaaacaggctaatacagggggattgctggatcataaaataattctatgtttaatcttctgaggaaccagcatactgttttctgcatataatctttacatttaaatcaatgttgatgatatttatagtttatgtataaccataactcttctgcattttgctaatagcttaatttggtttgatttgattttccaataaaacttttgcattcctaaatagtttgattttaaaagctgaaaattaacaaagctgtcttatcgtgatttatttaaatatggtccaatttagacccaaattaagtattgtaaaatttctttccttgtatatgtggttctcctagttcttctgagttcctcctttttataggcatgaatttggtatatggttagtctaccatatcctcaatttttttttcatattcaccaacatatctattgtattgaatcacccttatcctttattcttccaaatctttcttctggagttctccctcctgggttctctccaggcctgtttccatggctgcacctcaggtattggtctgcattcacctgtgctggattcactttctaaggaactacagcacatggaaggtaaacatctgagtacttatatgtttgaaaatatctgtattctgactacacacatgtttaagagatctagagagttctacagtgaaatgtctttccctcagaagttggaaggcatttcttcacaggcttcttatgtctcttgctgatgggaaggctgctgctagcctcagaatttattcctttattgactacctgcttatttttctatatatttcatttgcattcttggtattctaaaatttcagaatgatgaatctgagaatggatctttatttactctgatggatacctagtgagtcctttcaatttgatgtctcacttccttcattatcttgtattatttccttaatcatttccctccacaaccacctctgttctttcctagaaatcctaataattatagattggacatcctcgatacatcctcttggtcttttccccatccttttttgttctactttgtgaggagtatattctaactcttctaatggatcttttattattttttctttttgagacagggtctcactctgttgcccagattggagtgcagtggtatgatcatactcacttcagcctcaacctccttggctcaggctatcctcccgcctcagtcccctgagtaggtgggactacaagtgcttgccagcatggctgcctaatttccttattttttgtagagacagagtctcactatattgcccaggctggtctggaactcctaggctcaagcaatcctcctgcctcagcctcccaaagtagtgggattacagcctccacatccagcctggtaatcctattttttattcccaaatgcaatttctttatctgagtctttccccatagcatcgtgtttttgttttctggtatatctttatagatctatatttatatagatatctgaggacactaattatacattttataaaattattttttccttgaatcaactatgtttcctagggagtagtttttgtttgcatatatctgggtctttttccttaatactccacacttttgtctatcatgcccacctacatttaagaataaggcaatataaaaactcattatcagttatatgtcatggtagggcttgccacctgacaggagtcacttcagatgagcagatagggagcagccattagtctttggatcttcaaaaacagaatgaggagagctgtgcactgaacagggcactaactcacacgctcactgtccagtctctcaccagacacttttttgatttattttgtaaatcaatagatcaatcaatctctccttctctctctcattctgtctctctctctgtctatacttaggaagagtgaggcattctctgctgagatatgtttgagttgaatgttctgcctacagactttccagtaactcctctgttttcagccccatgttttgctatctctgcaggacctggaatttctgaattctaagcctccccaggcttctgaggggcagctgtacagtttcctcagcaatagtatccatcataccttctttaaatgaggtttcctcctccctgcttcccccatacttactccattattcactttcagtctccagaaatttgttgaaatccttttactttttatttttactttttaaaatatattttttcccacccaacccctgtagatgttgaaatctcttaatcaactgatgtcttctatttatttttgtggatttataactttagactttacagtcgttttttggagttaggagggagaggagctaaacacatgtgcttaatccaccatattgaattacagtctgaaagtgtcatttagaaatcttgccgtttctagcactcttcttccttcctgcagatgcaggctgccatctgggatcatttctcttaaaccccgggaacttccttagtattttctgcagttcaggtctattgccaacagattctctcagcttttgtttgtctgaaaaatgtctatatttggccttcatttttctggtttttaaactttgtactttgaactaattttaagcttacagaaaaactgcaatagcaccaacaactctcaagtactcttttcagctggtaacatttaattgttaacatttggccacatttgcttaatcaatctctctgtctatgtatatgtaaatatacttagaccactacacacaccacatctttttttttttttttttttttctgtttttgagacagggtctcactctgtcacccaggctggagtgcagtagcatgatcttggatcatagcagtctcaacctcctgggctcaagcaatcctcctaccttagcctcccaagtagctgggaccacaggcatgcaccaccatgcttggctaattgttgtattctttgtagagatgaggttttgccatgtttcccaggctgatctcaaactcctgagctcaagcaatccgccctctttggcctcccaaagtgttgggatgacaggcatgagccaccacacctggtccataatttttttttttttttgagacagcatcttgctttgttgtccaggctggagtgcaatgttgcgatctcagctcactgcaacctcggcctcccgggttcaagcaattcccctgccttagcttcctgagtagctgtgactacaggcacgtgccaccaagcccagctaatttgttcgtatttttagtagagatggggtttcaccgtgttagccagggtggtctcgacttcctgacctcgtgacccgcctgcctcagcctcccaaagtgctgagattacaggcacgtgccaccatacctggcccctggcccataaccttttaaaaaaaattttcatagtgatgatgtctcactaagttgcccaggatggtttcaaactcctggcctcaagcaatcctcgaaccttggcctcccaaagtgctgggatcacaggcatgagtcaccacacacagtcagacccacagataatttttaaattgtttaaaaataagttgtagatataatgagcccgattcagggaatgcatactgatacaatattatcatctaatccacaggttccactcaaatttcactttgtcttgataatgttcttcatccccttccccagctttattaaggtgtaattgaaaaataaaaattgtacatatttacattgtacaacatgtttcaacatatcttttgtgaaataattaaatcaagctaattagctcacatactttttttgtggtgagaacatttaatatctacgcttagcagttttcaagtacaatacattattattaactataatcaccatgctgtacaatagatttccagaacttattcctcttgtctaattcaaactttgtgccctttgacctacatcttcccattccacccttccccagaccctggtaaccactattccactctttgtctacgagttcaactttttcagattccacatataagtgagattacatgatatttgtctttcttgtctgactcattttacttagtacaatgccctctgggtcagtccatgttgctgcaaatgacaatatttcttcttttttaaggctgactagtactccattgcatatatatgccacattttctttatccattcatctgttgatggacacaggttgattccatatctcggctattgtgaatatgctgtaatgaacgtggggatgtagatatctctcttggacatattaattttatttcctttggatgtatacccagagtaggattgctggatcatgtggtagttctatttttagttttttgaggaaactccattctatttttcataatggctgtactacccaagagtgatctttataagtctagcatctaacccgtgatgacacgtcacatttagttatcatatctctttaatttccttcaaactggatgaattccctttttttgtctttcatcacctgatatttttcaggaacacatgccaattactttgcagaatatcatttagtttggatttgtctgatatatcctcatcattcaagagaggttattctttttttgtgtaattttgttttgtttttggcaggaataccacagaaatgattctgtgttcttctcagtacatcatatcagcagacatgtgtactagtctgttttcacacagctataaagaaatacctaaaactggttatttataaaggaaagacgtctaattgactcacagttccacatggctggggaggcctcaggaaacttaacaattgaaggggaagcaaggagcttcttcacatgatgtcaggagagagaagagtggagagtaaaggggaaagagccccttataaaaccatcagatctcgggagagatcactatcactagaacagcataggggaaactgcccccacgatccaattacctccctccaggtctctccctagacacatgaggattatggggattacaattcaagatgagatttgggtggggacatagccaaaccatatcagcgtatacacagccaaaccatatcagcatgtaatatcaattgtcctcattacaggtgatgttaacttttattatttgattaaaataatatgggcccttggatagccaaaacaatcttaactaagaagaacaaagttggaggaattatatttcctgatttcaaaacttactacaaagctacagtaatcaaaacaatgtggtactggcatgaagaaatacatgcagaccaatggaatacaatagagagcccagaaataatctgtctatatgagcaaatgatttttaacaagggtgccaagatcattcaatggaaaaagaacagtcttcttaacaaaaggtgttgggaaaactggatatccacatgcaaaagactgacattgtacccttgccttacactgtacataaaaattaacttaaaatggatcaaagacttaaaggtggggtttcaccatgttgacaaggctggtctcgaactcctgacctcaagtgatccgccttccttggcctcccaaaatgctgtgattacaggcgtgagtcactgccccatatcatacaaaattagctgcacatggtggtgcacaccaggaggctagggcaggagaatcgcttgaacctgggaggcagacattgcagtgagctgagatcatgccatagcactccagccttggttgcagagtaagactctgtcaaaaaaaaaaaaaaaagcaactggactacatcaaaatataaaacttttatgcatgaaaagacaatcaataaagtgaaaggcaacttgcagaatggtagaaaaaatttgcaaatcatatatctgatattcaaaatatataaagaattccacaactcaacaacaacaacaacaacagctccaatttgcaaatgagcaaaggggtctggcatggtggtgcacatctgtagtcccagctgaaatgggaggattgcttgagcccaggagttcaaggctgcagtacactatgattgtagtgaaaagcctctccatcctgggcaacacagggagcactggtttcttaaaaaagaagaagaagaagaaggagaaggagaaggagaaggagaagaagcagcaaacaggcaaataacttgaatagacatttatccatgaaaatatacagatgccaataagcacaagaggttcaacatcactaatcattagggaaatgcaaatcaaaaccacaatgagatgccacttcacacccattaggatggctattataaaagacaaacaaacaaacaacaagacagaaaataagtgttaaggatgtggagaaatttgaaccctttgccctgctggggggaatataaaatggtgcagccactatggaaaatagtatggcagttcctcaaaaaattaaacagaattacaaacgatcctgcaattccatatatacctcaaagaattggaagcagagactcagttacttctacacccatgttcatagcagcctgttctcaatagtcaaaagatggaagcaacccaagtggccatcaatgtatgaatgataaacaaaatgtgatatatgcatatgacagaatattattcagcctttaaaaacaggacattctgcaacatggatgaaactggaggacataatgctaagtgaaataagtcacaaaaacacaaatacagtatgattctacttatatgaggtacctaaagtagtcaaactcataaagatagaaagtagaatggtagctctcagggtctgggggaaagtgagaatgggtagttgttgcttaatgggtacagaatttcagcttgggaagacaaaaagattttggagagagagagtcatgattgtttcacagcaatgtgagcgtacttaatgccactgaacatggttaaaatgaacatggtttaactgaaaatggttaaaatggtaaatttgggccaggcacagtggctctcacctgtattcccagcactttgggaaaccaaggcgggcagatcacgaggtcaagagatcgagaccatcctggtcaatatggtgaaaccccgcctccactaaaaatacaaaaaaaattagccgggcgtggtggcagtttcctgtaatcccagctactcgggaggctgaggcaggagaatggcttgaacccaggaggcagagcttgcagtgagcggagattgtgccactgcactccagctgggcaacagagcgagactccgtctcaaaaaaaaaaagaaggtaaattttaattatttagattttaccacaatttttagaaagatggcatgtgccttatttctccactgtaaagttaataaatatctgtacttattaacaatttgtaagtattttgtaggaagataatttgaaattatataatttcaaataattcacaccaatagttcgaataccaatccaacaccacaagatttattctagcatcctctgttaccatatttgtaatttctccaacactgaaaacctagctcctattatcctcaatatactttttggcaatacccatatgtaatcagtctcctaactatacaggccatcttcttaaacctgtctctgccaaaactgccagctaaattcttgactctgttcccactgattgtgccaacctaattcttggctctgacaaagaggaagaggaaggtgaagtgaaggccctcaattttgaagaatatttttactggatatagaattccaagtagacaaattcttttcttctttcatcactttatttatttatttattcatttattcatttattgagactgagtctcactctgttgcccaggctggagtgcagtggcatgatcccggttcactacgacctccacctcccaggttcaagagattctcatgcctcagcctcctgagtagctgggattacaggtgtccaccaccacaatcagctgatttttgaatttttagtagaggtggcatttcaccatgttggccaggctggtctcgaactcctgacctcagatgatccacccaccttggcctccaaaattgttgggattacaggtgtgagccactgcacccagcctcatcactttaaaggtgtcttttcattctagttttcattgtttcctataaaaaattagccatcatttttattgttgtaccttaaaatgtaatatgtatttttcctttggatgcagttaagattttctctttatctttggtttacagcactttgactacaatgaccctaggtgtcatcttcaaataatttatgtgcttggggttctctgaatttcttgcacatgtaggttgatatctttcataaaatgtggaaaaatcgagggcattttatcttcaaatattttttctaccccattctctctccattatacctgttagattattttatattatccctctgttctctataactctgtcctatttttctccttttattttctctctgtgctttaatttggataatttccattagcctgtctttaagtttactcatccctttttcagctgtgtccatctgctgggaagcccatccactggattcttcacttcagattaccatatttttccattttagaattttcatttgactttctttttagtttctctttttcttttcttttttttctggtttttttattttttttttcttgagatcaagtctcactctgttgcccaggctggagtgcagtggcatgatctcggctcactgcaacctctgccttatgggttcaagtgattctcctgcctcagcctcctgagtagctgggactacaggtgcatgctgccacgcctggctaatttgttttttgtgtagtagagtagtttcaccatgttgcccaggttgatcacaaactcctgagctcaggctatctgccccccttggcctcccaaagtgctgagattacagacgtgagccaccacacccagctgagtttctctttttctattgcaatttcatccatctcttttgccatttcttcaatcttttcctttacatattgtaatttattatctcacagtatctggtaggtcagaaatctgcgtgtggtttagctgtcttagctagatgactctgggccaagctcgctcataaggttacagtcaagttgccaggcagggctttggtctcatataaggttcaacaggagaaagatcttttacattttaaaacatttatgagtttaaagtccttctggttaattccaaaatcttggtcatctgtaagtctcttcggttgaccaccttttctcttaattatgggtcagtttttcctctgctgctttacatgttcagcaattttaaaaatcttatgctggacataaaaaaaatctggattttgttatcttcctctgaagagtgtcaaatatttttctgaaagaaagttaaattactggtagatcactttgattctgttgaggtttattttaggcctctgtggtgagtctatttccagttttccttagttctaggatttggctcttactcatatggcatggtccttactcctagggcatggtctttttggtgtctcaacatggtatctccactcttgagtggatcagaactccaatgtcttcatagctttgtgcaacttctgaaatctaggtttagttttcagctcctctagctgttttttgctggtatatcttacagaatcttgccaagcacatatgcagtttagcatttggccaagagcccgaaggaaactcctatgtagattcctggggctccttctttgtcactcttttctatctacataccctgtcctgtaatttccagtaacctctgcaggcccaaactccgatttatttatctactccaattctctgaaagtggtttggaaaattgccccccaaggttgaatgtaaaattctcattttgagcttcttttctctcaagcattatagtcatgcactgtgccttatcccatacccaaaagaaattgttctgtacattttgtttagtttaatagttgtttatggcaggagggaaggtctgatgctagttacttcatcatgtccagtacaagaagtccacaaatacttcttaagtttttatagaccaatcctattcttatatagtgaaaaattaaaggtaggccaacaaacctatatcatgtaatttccagcttagtcctctacatgataggaaacacacatgacccttatcgttgtgcttcctataagtttggtaatttttttttttttttttttttttggatacagagtttcactttgtcacccaggctagagtgcagtggcaggatcttggctcactgcaacctttgcctcccgggttcaagtgattcttatgccttggcctcccgagtagctgggattataggtgggagtcaccatgcccacagattttttttgggattgggtgttttaatagagatggagtttcaccattatggcaaagctggtcttgaacttctggcctcaagtgatccacccaccttggcctcccaaagtgctgggattataggcatgagccaccgtacctggctaagtttagtaatcttaacatgcactgaggatacagagaagatgatctgcgaattcttgaagataaaggtaaaacatcaagaatccatccaagaagtacccgggtgccattcaattattggaatatgaagacaatttagtaatcccattctcctttgaccactggctctaagactagactactgcaatttggaagctgctaagccctaataatcccttatgtagaagaggaagtgtacatactgaattagggacattttacattttgtatgaaactgtagctagtcacaacatagttgtagtttgtacctcttcacttttctgtccaagaagttgcctttccactgaggcagagacaatgctatgtgttcaccaaactccatttcattttcttatcttaggtacactagatttctatatttcccagcctcttgtgtaacgatgttaggggaatgtcactgaatcctggacaataggatgtggaataatatatactatttccaggcctgccataaaatgctcccttcccccttccaccactgtacaattgcctcaatttctttccccttccacagtgacccaaaggtcatggttttaggatggtgacctcacagaaggagcctagaaatttaagtcactgcctgaaggagagccatgaaagagagatgactgacccactaagactgtgataagaaacaaacaccttgtgattttttttttttttttttttttgagacagagtctccctctgttggccaggctggagcgcaatggtgtgatcttggcttactgcaacctccacctcccaggttcaagtgattctcctgcctcagcctccgaagtagctggaattacaggcacccgccaccaagcctggctaatttttgtatcttttagtagagatggggtatcaccacattggccaggctggtctcgaactcctgacttctggtgattcacctgcctcagcctctcaaagtgttggcattagaggcatgagccactgcgcccagcctccttgtgattttaaaccacttagatttcagggttaattacaatagtagagcttgacctatctggacgtaagtaccaatcatagcatgtaataagacttttttgtttgtttgagacggaatctcgctctgtcgccaagccagagtgcagtggcgcaatctcggctcactgcaacctctgcctcctgggtacaagtgattcttctgcctcagcctcctgagtagctgggactacaggcatgcaccaccatgcccagctaattttgtaccgtgttggccagggtgatcttgatctcttgacctcgtgatctgcccacctcggcctctcagagtgcttggattacaggtgtgagccaccatgctcggccaataagactattttttgaaaagtaaaaaggaagctacaaagtatccatattgttcatcacccatgaacaacaataccatgaggatatgtataagtatatttggatggcaaagttcagatgtgaaacccatcttaacacacatgcatgcatgcacacatacacaacatacatttaagttcccatgccattaaaaggggtctcagagatcattcaaaaaataacttccacatttaaaagattgactttctcacttcgtactttgagagttcaagtggctaatcaattcttatatgaccaataatacaaaattatacctataagcattgtcttatcaaataacattttaccagaggaaaaaaaatcttcaaagtcaatgtttttttaattattagagaaatgtaaattaaaaccacatgcctgtggtcccagctactcaggaggctgagctgatcctgggaggattgcttgagcccagaagtttgaggctgcagacagcaataattgcgccactatattccagcctgggtgacagagggagacactgtttccaaagaaaaaaagtaaaagaaaagaaaaaaaagaaaaaaaaaacaacagatattggcaaggatgtggagaaaaggaatgaagggaacgcttatacactgttggtgggaatgtaaattagtgcaacctttacggaaaacagtatggagatttctcaaagaactaaaaatagaattaccatttgatccagcaatcctactactgggtatgtatccaaaggggaaaaaaattatattaaaaagatacttgcactcgtattttatcacagaactattcacaatagcaaaaatgtggaatcagcctaagtgtcctcagtgaaggatcgagtaaagaaaatgtggtatatatccatggaataccataaaaagaatgaaatcatgccttttgcaggaatatgaatggaaccggaggctataatcctaaataaattaactcagaaacagaaagtcaaataccacatgttctcactcataagtgggcgctaaacaagtggtacacatggacatacagagtgaaatagcagacactggagactccaaaaggtaggagggtgggagcagggtgagggccgaaaaattacctattgggtaccatgtcactacttgggtgatgggtatactaaaagcttagacttcaccactatgaaatatgtgcatgtacgaaagctgcacttgtaccccctaaatctacaaaaataaaaatttactttaatttaaaaacaaagtcactatttttttcaggccacatactagagtccaaaaccaaagtaaagcatcacattttagaaaaaccaaatacttctaaagagattattctatctatctgtcacagaaatatgagatctgcacttactacttaatagtctattttatttctaggaaataagcaatgttattattaatgtcaaatgagaaggctaatttgcttaatatgagactagaacttcaattctcctctcacactaaatctaagtgttgtaatgattcaaatttgagttggcctttgatgggattaaaagggaattgatgatgaaaggcattgtgctttttcgttttgttttgttttttagagatggggtttcactatgttgttcaggctggtctcaaagtcctaggctcaagcaatcctcctgccttggcctcccaaagtggtgggattacaggcatgagccactgcacccagccaggcattgtgctttaatggtataagctgtagcagtataacaatggacaagttactaaacctctttgtgccccagttatttcatctataaaataataatttttattgatggttctggttgttgtgaggaatgcatagaacaacctggtacataaaaactgcttaataaatgttaacaatcatcataatcatcatcaatatagtaaggaaattcagatgttattagtactgaccataactttgtcattcacttcgtataagaatgtgaaagagtgtaaacaatgcattttatcattttgggactttcttcctaccccctttagtaaaataggaatattataaaggcatacatgttaaagtatctgaaaattgtgatagatgtttttaaagtagaagccagggaatacatttctaaattagatttatctatatttcaaaagaaattttcaattaaatgttgaaaaattagagcatgtcatcttggaaaagacattataaaattataaggagctctccctctccccctccccctccccctccccctccctctccctctccccacggtctcactctccctctccctctccctctttccaaggtctccctctgatgccgagcggaagctggactgtactgctgccatctctgctcactgcaacctccctgcctgattctcctgcctcagcctgctgagtgcctgtgattgcaggcgcgcgccgccacgcctgactggttttcgtatttttttggtggacatggggtttcgctgtgttggccgggctggtctccagctcctaaccgcgagtgatctgccagcctcagcctcccgaggtgccgggattgcagatggagtcttgttcactcagtgctcaatgttgcccaggctggagtgcagtggcgtgatctctgctcgctacaacctccacctcccagccgcctgccttggcctcccaaagtgcgagattgcagcctctgcccggccgccaccccgtctgggaagtgaggagcgactctgcctggccgcccatcgtctgggatgtgaggagcccctctgcccggccgcccagtctgggaagtgaggagcgcctcttcccggccaccatcccgtctaggaagtgaggagcgtctctgcccggccacccatcttctgagatgtggggagcgcctctgccccgccaccctgtctgggatgtgaggagcgcctctgcccggcccgtgaccccgtctgggaggtgaggagcgtctctgcccggcagccgccccgtctgagaagtgaggagcccctccgcccggcagccgccccatctgggaagtgaggagcgtctccgccgggcagccgccccgtccgggaggtggggggcagcccccgcccggccagccgccccgcccgggaggtggggggcgcctctgcccggccgccccttctgggaagtgaggagcccctctgcccggccgccaccccgtctgggaggtgtacccaaaagctcattgaggatgggccatgatgacgatggcggttttgtcgagtaaaagggggggagatgtggggaaaagatagagaaatcagattgttgctgtgtctgtgtagagggaagtggacataggagactccattttgttctgtgctaagagagattcttctgccttgggatgctgttgatctatgaccttacccccaacccggtgctctctgaaacacgtgctgtgtccactcagggttaaatggattaagggcggtgcaagatgtgctttgttaaacagatgcttgaaggcagcatgctcgttaagagtcatcaccactccctaatctcaagtacccagggacacaaacactgtggaaggccccagggtcctctgcctaggaaaaccagagacctttgttcacttgtttatctgctgaccttccctccactattgtcctatgaccctgccaaatccccctctgcgagaaacacccaagaatgatcaattaaaaaaaaaaaaattataaggaaaacagtcttaagtaagcacatacaggtttttccccctgtactttaaaaaattgttgttttggaactaacttgtcattcctttgtgtttgcatacacacacattagacagaacacagggactacactaactcaaacactgccgatcagagctcaacgtaaatgcattataaattatcttttcactagctaatcttagatccttgggttcttgggagtatggcagaatcacacttatcagaaggtctcaagggacacataaaactttcaaatacatgaggatttggataagaagggaacctggcaaatagggctttgaacttggcagtgcagattgcaccatctacagcacaaattgacaaagcatcctttccatctctcttggtttatagacagccaactaatgtagccaagtcagcataccaaacaaaagtgttatgttccaggctcaatgaattttgagtttcaagagtggttggtctttcttttcatcactttgctagggttagagaaatctaagagtcgaaaacttaactataatctcacattcaaaaaaaatgctcaactattataaagccacccaactacttttccaaaagttttaaacctactaaacaagccctacatgctgctaaaaaaatatggaattcacatgtagttacatttttacaagactgcatacaggtaaagtgagcttcgaatcaaccaaaaatatatggtcccttctggatctgctacagatttggtaggcaaataaacaattttaggtttattccactccaactaaaatatgatagatgcaccatagcactgattaaaatgtattgagaagttggttatagacatagcttctataagcataaagctgcaaatctaagcttggctgcctgcatagagtttccaggcaggccaaagacctatggaactgaaatttgtcccttaaattagtattgcttaatacagtcataagggatttacaaaacccatagaattgcccattttttaaaagctggagtgctgttagctgaagtattacttgggactttaaaaaatcttaaaatggcctgtttttactttattgttttgcttgaaaaaaaatctaattgggaaaaagtaaatctcatatttctgttgcattgaaaggtttgagcttaatgattagtagtattggcaacagtgtaaacagtcctccttaaatgcattttgattaaatgcatttaagattccacttaagatgcattttgccatgttcaatatgatactagacatgggtggaaaaacagcagatatttttccaagcaggaggcatgatattgctaaaatactcagcttccatcacagtattaattagtgtgtttcacgaaccaagactgtaagacttgtaaatgaaattctagaaggggcatcaagctagaacaggatatggaagccaaatggaaaacatgaaccaataaaagaaaaaagctaaactagctagaagtttaagtctagtctttgaagtcagttcaggtcctgcatggtttaattctgatgtaatcttaaaatggtggatacaaacaagaactcagaaacagcttttgtaacttttggaccaactgcacatgaatcagtttgttgatggctataatgattacacagtggtctttgctgaattacatctgaattaaaacagtcattttctcttaggctaaaatgtaataatgaagacttatcaacaagaatagccattctccaaacacatacacccacacacacacttataaaactttttacacagtatgttacattttgttgatatatcaaattatttgtcttaacagcagtaatgcataagctcttgcacgctagcacattcttcctgtatgacaatgtgtttgttccttgtttgttctgtcatttgtctcatttcacattctagttaatgacatgattgctcttctgtgtgcaagaattttttctgagaagagataattgtctcgatttgaaaaaatatatatttctggcaggatgggaacttcaaacacatatggcgtaaaaggactatgcccataatagtcttaatggacaaaaaaaatccttcaattaaaatcacaatccattaagtgcattctccttttctgccaacaagccttaaaatgaatagtacacacaacgaaaaatgtacactgattttttgttaacaattcatttaaaatcctcagatgaaataagtgttaccactatgttataaagtgtttttcttatgagccaaattaattattcttttaaagaaatttaagctattttcttctgatgatgataaacagagaagttcagtaaataggtactactttaacttagaaagataaataaaagctgaaacagatttgattgaaaatacataatctcagtataacttgtgatgagaattgaatatgtgggttaatatttctttgtaagatgtatatgtaaataacaagtaaggagattcaactaagaactattcagttggtgccattacctttaatggcaagactacgattacttttgcaccaacctaatacaatgataaggaatagagtatcccacatctatagtacagggtgattcaatggcagcagtactgtgtttaaaccctagaaaacagtccacagaagaagaaacagccattgccacgattttctggtaaataattataaaatttcagtctcattaaattattcagtgtccaataagtgctaaggatataagtaagacatgtaaacaaaaagtgcaatactgttgtttagtacaaaagcagatatatgtgtgccatggcaagacaaaagagaaaaagatgaactcagttggagaagaaaagggaaggggtcagggacagctttacaaaggaaacaattttcaagttggacttttgaaaaaatggataggagctctgcaggttaaagagggaaggaattcccagacagatgaaccagttatgaaactgccataacccacttgtgagctgtaagtaatttattttataatagtacagtggttctcaaagtatggcctgtaaacctcttattcaggggttcaatgagatcaaaactattttctttttttttttttaagtcacgattttgccatgtggcccaagctggtcttgaactcctaggctcaagcccagactattctcaagctcagcctattccagctattgtcaaactcttccaaaaaactgaagatgggggaacagttccaaactcttttatgaggccatcattatctgataccaaaaccagacaaaggcacggcaagaatagaaaacaataggccaatatccttaatgaatatagatgcaaaaattatcaaaaatactagcaaatcacgtttaatttaacagcatattaaaataatcctataccatgatcaagtgggatttatccctgggatataaggatccacctgcctcaggctctcagcactggaattacaggcgtgagccaccatgtccagccaaaactattttgataataatactaaaatattactaacagggtcttgcactgtcacccagtctggagtgtagtggcacgatcatagctcactataaccttgaactcctaggctgaagtgatcctcctacctcagccttctaaatagttgggactacaagtgtgtgtcaccacacattgtgaattttttattttttagtgatggggtcttgctatgttgcccaggctgatctcagactcctggcctaaagcaatcctcccaccttggactctcaaagtgctgggattacaggtatgagccactatggccatccccagtgcacaagtctttagcctgcttgattggttttattcctaaatattttattatttttgatgctattttttgttaatgggattattttcttaatttcctttgtggacagttttttgtcagcatatagaggggcaattgatttttgtgtgttgattttgtatctcgtaactttgtcaaactcatttattagctctaatagtttttgattgtttgttttgctgtgtgaagtgttcagggttttctacatagaagatcatgctggatgccttttatttctttttcttgcctaattgttctggctagatcttccaatattatgttgaatggaagtggtggagaatgggcatccttgccttcttcctgatcttagaaggaaagctttcagtttttccctgtgaagtataatgttagttgtgggtttgtcatatttgatctttattatattgaggtactttccttctgtacctagtttattgcatattttttacatgaaagggtgtcaaattgtgtcaagtgttttttctgcatctattaagatgctcatgtgatttttagccttcattctattaatgtggtatatcacatttattgatttgtgtatgttgaactatccttacatcccagggataaatcccacttgatcatggtgtaggattattttaatatgctgtcaaatctggtttgctagtattttgttgagaatttttgcatctatgttcattaaggatattggcctatcattttctattcttgtggtgcctctgtctggctttggtatcaggataatgatggcctcataaaagagtttggaagtgttcccccaatttcagttttttggatgagtctgacaatagctggaattaattcttatttaaatacctggtagaatcaccagtgaaggcataaggtcccaggctttttttgctactgttaggaggttttgattatggattcagtctccttgttattagtctgttcaggttttctatttcttcctgattcagtcttgttggattgtgtgtttctaacttcaggaggctgaggtgggtggattgcttgagctcaggagttcaagacctgcctgggcagtatggtgaaaccctatctctacaaaaatatatatatatataaaaattagctgggtatggtggcacgtgcctgtagtcccagctacttgggaggctgaggtgggaggattgcttgagcctgggaggtggaggttgcagtgagccttgattgtgccactccagcctgggtaagacagcaagaatctatttcaaaaaaaagtttaaaaaaaagtgtgtttttaggaatttatccatttcttctaggttgtacaatttgttggtgtataattattcatactagtacttataatcctttttatttctgtggcattagttgtaatgtctcctaaaattcatatggaacaacaaaagacctagagtagtcaaaggaatcttgagagagaagaacaaagctagaggcatatttcctgatttcaaaatatattacaaaatatattataaaataatttaaaaagtatgctactggcataaagacagacatttagaccaatggaacataatagagagcccaaaaagaaacacacacatatatggtcaataggactttgacaaaggtgccaagaacacacactgggaaaagaacagtttcttcaataaatggtgttggcaaaaatggatatcccaatgtaaaagaatgaatcagacccctatcttacaccatacacaaaaatcaacccaaaatggactgaattaaattgatttaaatttctttaaaagaataattaatttggcttctgagaattttatagtttcagtttaagtttacagtttttagtttacaatttcaggtcttatatttaaatattaaacataagaaactgaagccgtaaaattcctagaagaaaacatagggggaatatttattgatgatggttttggctgttatttcttggatatgacgccaaaagcacaggcaacaaaggcaaaaacagacaagtgaaactacatcaaactaaaacacttttacaccacaaaggaaataatcaacagaacaaaaaggctacctatagaatgggagaaaatatttgcaagccatatatcttgtaatgagctaacattcaaaacatgtaagaaattcctgcaacttggccaggtgtggtggctcaggcctgtgatcccggcactttgggaggccgaggcgggcggatcatgaggtcaggagattgagaccatcctgccaacgtggtgaaaccccgcctctactaaaaataaaaattcagaaaaaaactcaaaaattagctgggcatggtggcacttgcctataatcccagctactcagaaggctgaggcaggaggatcgcttgagccagggagttggaggttgcagtaaacccagatcgcgccactgcactccagcctggagacagagcgagactctgtcaaaaaaaaaaaaaaaagaaaagaaaagaaaaaagaaaaacagaaacttcaacaactcaaaagaaaatgtgaaactcaaactgattttaaaatgggcaaagggctcgaatagacatttttctaaagaaggcatatcaatggtcaacagttatcttaaaaaggtgctcagtatcactaatcaccagggaaatgcaaataaaaactataatgagatatcattttatacctgttgaggatggctattataaaaaaaaaccacaaaagataataagcattggcgaagatgtggagaaattggaacccttgttcactacttgtgggaatgtaaaatggtatacattacggaaaacaatatggaggttcctcaaaaaattaaaaatggaactgccatatgatccagcaatcctacttgtgggcatatatctaaaataattgaaaccaatatcttcaagagatacctgcattcccgtgttcattgtagcattactcacaatagctaagatatgaaaacaactcaaatgttcatcaacaggtgaacggataaagaaaaggaggccgggctgggcgcagtggctcacgcctgtaatcccagcactttagaggctgaggtgggcggatcacgacgtcaggagatcgagaccatcctggctaacatggtgaaaccctgtctctactaaaaatacaaaaacaaacaagcaaacaaaaaattagctgggcgtggtggcgggctacctgtagtcccagctacttgggaggctgaggcgggagaatggcgtgaacccaggaggcagagcttgcagtgagccaagattatgccactgcactccagcctgggcgacagagggagactcagtctcaacaaagaaaaaaagaaaaaaaaaaaaaaacccgaaaagaaaagaaaaaaaaggaggccagccacagtggctcatgactgtgatcccagcactttgggaggccaaggcaggaagatcatgagtccaggagtttgagactatcctgggcaagaaagagagaccccatctctacaaaaaacacaacaattagccaggtgtggtggtatacacctgtagtccaagctattcagtcggctgaggcaggaggactgcttgagcccaggagtttgaggctgggtgagctatgattgtgccgttgcgctcctgcctgggcaacagagagagaccctatctcaaaaaaaaagaaaagaaaagaaagaaagaagaaagaaagaaagaagaaagaaagaaagaaagagagagagagaaagaaaggaagaaaggaagaaagaaagaaaatgtggcttatttagacaatggaatattatttggccttaaaatagaagaaaatcctgccatgtatgacaacatggatgaacctggaggacattctgctaagtgaaatagccaatcacaggacaagtactgcatgattctatttatatgtggtatctaaaacagtcaaactcatgggagcagagactagagtggtggtttcctggggccagggggagggataaatggagagttgttcaatgggtataaagttttagttatgcgagatgagtaagttctagggatttactgcacaatatagtacctctagttaacagtattgcacacttaaaattttaagaaggtagatctcatattatatatatataaaagaaaccaggatacatttagaggtggtggctataattttattgtgatgatagttttatgggtgtgcgcatacatcctaactcatgaaattgcgtacattaaatatgtacagtttttttgtttatgttataccccaataaagctcgtttttaagaagagtcctcatttgtataatgacgagcaatagataaagatgtttttaaagcaagaaaaaaaaaaaagcaaaaaagacctcagatttgaggtctgccagtttcacttgataatgtccaaaaaatttaactttattaaatgttgacccttgaagacttatctttttaatattctgtgtggtgaaatggaagtacacagaaagtatgtctgccacataccaaagtacaatggttatctccagaaaaagcacttgtacaattgtttgagttgccagctggcctagccatttgtctcatggaacaccattttcactttaaggacttacatatgaattatagttattcagacttgggtatttggcagacactttctaaaaatgtacaaagtgagactatcacttcaggaaaaacaacagacagtatttttcccagtgataaaatacaagcttataagtgaaaatcagaattttggaaaacatatctaccattgtgaatctgatagcttcccaatactcaaagatttttctgataatattggtggtgatattaactaatgattttttgatagtgtacaatgaaacatcaacatttggaatacctgcataactcaatgaaccttttattttccccaaaagaccaatgatgttacaaaatcacacatggataaaagatgcattcgaagagcaaaacagactaatggattttcatatggcagcgtatggaaattactaattatggtttcagtttccacattgcaactaacctttaaaaatctacctctttttcaagtgttggtataaagaatgtccattattatatgagaaggctattaagatattcctcttttttccaactacatttgtgtgaggtcagattttcttcatacagtgtgaccaaaacaagatgtcataagattgaaagtagaagcaggtcatctttgttgaccaaacattgaagagatttgcaaaaaggtatagcacatacaattatgtacagtacataacacttgataatgataataaacaactatgttattggcttatgtatttactatacttttaatcattattttagagtatactcctacttatataaatattttaaagttacctgtgaaacagcctcaggcaggtccttcaggaggtattccagaaaaagacattgttatagaagatgacagctccatgcatattgctgcccgttaagacctttcagtagaacaagatgtgaaggtggacaggggcgatactgatgatcctgaccctgtgtagaattaggtaatgtgcgtgtatgacttggtttttaacaataacgttttaaaagctatatatatttttttctatatatatatatacccatatatatagaaaaaagcttacagaataaggatataaagaagatatttttgtatagcttatgatatgtttggattttaagctaagtgttattacagaagagtcaaaaagtttttaaaaaattaaaagtttataacgtaaaaaacttacactaaggctgagtgcagtggcccatgccttcaatcacagcaactcgagaggctgaggtgggggaattgcttgaggacaggagttcaagcctgcagtgagacatgatcacaccactgcactctagccctggtgaccgggtgagacaccaactcaaaaaaaaaaaaaaaaagctacagtaagctaaagatactttactattgaagaaactttttttgtaaatttagtatagcctaagtgtacagtgtttataaaatgtacagtaatgtacagtaatatcctaggccttcacattcactcaccactcactgactcacacccagagcaacttccagtcctgcaagctccactcatggtaagtgtcctacataggtgtaccattttatattttttatgccatatctgtaccatttctggtttagatccacaaataccactgtgttacaactgcctacagtattcagtacagtaacacgttgtacaggtttgtagcctagagcaataggctataccatataccctaggcatgtggtaggctataccttctcggtttgcataagtacattttgtgatgtttgcacaatgacaaaatcacctaaggattcattctcagaatatatctctattgttaagcgacacaagactgtatttgcctgtcttctttcacttagcataatgttttttgaggttcacatatgttgtatcatgtatcaggagcttgtcatttttattgcagaatggtattctcttctatacatgtgcaacattttatctattcaccagttgattgatatttgtgtagtatacatgttttaactattaagaataatgcttttataaacatcaacatataaatctttgtctttcattttaaaaaatgaaaatatgttttcattttttttgggtagattcctaggagtggaattgctaagtagtatggtaaatatatatttaacttataaaaaaactgccaacttttccaaatggctgttatattcccactataaatatatgggagttccagtttctccacatccttgccaacacttgttatcatcttttccattatagccattctagtgagtgtgaggaggtatttcattgtagttttcatttgcatttccctaatgactaatgatgttgagtatctttccatgtagttactggctattcatgtatattgtttagtgaaacatttagtcaaatattttcctcatttttaaatgtttttttcttattgaattgtaaaagttctttatatagtctagatacaagttatttgggagatatataatttgcccatatgttctccaagtctgtggcttgtcctttcatctacttaatgaaaacaaattgtcttttaaagcacaaaaaattttaaattttataaagtataattttatccatttatttttattgatattttagttgatttggtatcaagaaaaatttgtcttccccaaggtcacaaagatttttctcctgcattctttcaaaatttttatctcttacatttaggtgtatgatctattctggggaaaattttgtgtttgatgtaagataatttcctcactgaattgccttggtgcccttgttgaaaaatcagttgacagtaaacatatggacttacttataaactcttaattttttcatattgatctgtatatctgtttgatgtcaataccacactgtcttgattaccaatatattttgaaattgagaagtgtaagtcctccaactttgttcttatcaaaattattttgccatgtatcctttgcttttcctaagctaaattttaggatcagcttgtcaatttctacaaaaaacctagggaattttgatagggatcatgttgaatccattgatgtatttcaggagaattgacagcttaacaatattcagtctttcagttcatgatatcaaatgtatttccatttatttaggtcttctttaatatttatcagcaatgttttgcagttttcagtgtgcaagtcttgcacttcctttgttaaatttactcttaagtaattcaatttcatgctatcgtgaatagaattgtattcaatgtggccatttttgtttctttattgctagtatatggaaatacaatattgattttttaatgctgatcaataattctgtgaccttcttgaatttattaggtctagcagtttttgtggattccttggaatttcctacatacagaaccatgtcatctttacatcatctgcaaataaagatagttttatttctttctttccaacctgtacgctttttcttttcttgcctgattgcactggctacaatctccagcacaatgataaacagaagtggcaagagggaatacccttgcactgatcccaatcttagggggaagcttttggtcttcccatcattaagtataaatgttagctgtggtttttttgtagaggccttttattaggttgaattatttcaaggtttattaataagcattagttttttttttttcaaatgcttctttgtctattgaaaggatcatgtgggttttgtcctttattagtatagtggtttacattaaatgatttttggatattaaactgaccttgtatccaatttgctttaaggttcttggatgtgactagtgttttactttaatttgggaatgtttttggccattatatcttcaaatatttttattgcacatttctttccctgcccccgtgctgtggctccttttgtgcaacacattctgtgcttgatggtgtcccttggttctctgaaggactgttcctttattttcattcttttttctttctgttattcagattgggtaatctctattcatctatctctaagttctttttgccagcccacatctgctgttgtacttatgtgatgaatttttcatttcagttatggtattttacaactccagaatttccatttaaaaaaatttctttttactgttatttgttgtttaatgaactcttgccaccacatgttttcttttatttaagtatgatttcctttagttatttaaacatatttataatagctgatttgaggtctataagatctaatatgagggcccccctgagagagtttctactgcctgcttttcttcctttgtatgggtcacactttcatatttatttgcatgtcttgtgtttatcttttgtttaaaactggacattttaagccaggtatggtggctcacacctgtaattccagcactttgggaggctgaggtgagaggatcacttgagccccagagttcaagacaagcctgggcaacacagggagaccccatctctacaaaaaaaattaaaaataaaaattagctgggggtggtggcatacacctgtggtcccagctactcaggaggctgaggtgggaagactgcttaagcctgggaggtcaaggttacaatgagctgtgattgcactgttgcactccaatctgggtgacagagcaaggctctatctcagaaaacaaacaaacaaacaaacaacaacaacaacaacaaactggacatttaagataatatgttatagcatttctgggttctgattcacctccaatcctgggtagttattgtagttttgtcatttatttcagtgacttgcctagactaattctatagtctgtcttccctacattgtgtagcaacttatgtctttgctcagttgtttttttcattttttaatgtttaagtcttgtttcctagggatcacctctgggttagcacagcttagtggtcaatgattagtcagaatttacacttaaacaccctgagctggagcttctggggcagtgaacacgtggaggtgctgcaagtctggcatatccagtgaggccatagaagctccccgtcccttcccacactccttgctagatccatctcttttagaatttaagaaatgagagaatctaacatgaatgattccatcttgtttctaacctcacaggctaaattggtttttggattattctagtgtgaagaccatgagagaaatttaaactttgaggcaaggaaaactgacttccctccttgttcagagactgaagccacattcataaaacaaggttagaattatggtaggatcctgaaatttgctaaagaataggcatagttaaacaataacctgccatggcttagcttgcttttctacaggttgcttactgccccagagtcatataactggaggtcacaagatctgtaacttccccaaatgctcctatagataacatcactattgtgaaacctaaagaactagtcttcgagatatttttcggatttagcatttgggcagaccaagagatgagtcctgagatcccttcttgggaactgactcagctgcacaaagacagtttagacactcctctaatttcatccccagccaatcaattgtttcagttccccagacccctgccgaccagagcacccttaaaaaccctagcctttgaattcttgggcaggcagatttgagaaatgtcttctgttccccttgcttggttggccctatgattattaaactctttctttgctgcaacgcttgctgttctcagtgaattggattcttttcagggaagcagacaagaataactcggctgtgacatgaggaaatgcaaaataacaagaaaattgtgaaacattcaatctcttggtattgttatctgtaataactgaaatgaaaagagagtgaacatatttgggttgatggaggacccatagctcactactgaacaatcatctatggctttatgtgatctagacacccaggaggttaatcatgagggagaagcctggctgctggattggataaaagctgctgtgaagtaggtctaccctttagggaggaggactgcccaattcccctgtaaatgccaagtagaacaccctagttgaaatagctgatattctcatatgaaagctatgtggcactggctttataatgaccaggatattcacctgctgaaaatgtccattactcaagtcatagtaaatgctataactaaggggctgcttttgcatggatagcctatgtgatcttactgctgcaaaactgagcaacagactaggaagccttattgaatttgctggctcagtttcccctcaatggtcttacagatgctaattaaaatattagattaattaacaaaagaatgagaaaaggcagaggcgaaagtcaaaggactcttctaacaaggtggaaaattttaaatggtttttaagaaacaagtgaatatagtaaacattgatgggtacaaaacaaagacgagaaagaaaggggagagccaagagacctgtccagtcagagtggaaatctttaagtggttgttacaatattgcatgaataaaatgaacattgatagggttaaaacaaaggtcttactacaacgttatggaaggttggtcaggctaaaggaatgtccggctggttccctaacattaaagagtctcaaagaagtccactctattatcacatatgaagaaattttaaaaggcagagggcaaagatgacaaggagaaacttgacccaaaatggcttagggcaatgcttaagcagataagtcaatatgaagacacaaagatcagggtctcctagctcaaacccctgctggggacccaaagccttttgcccatgagtgggaaaataggtcagggggtgaagaagagaagtttctgggactccttgatatgggagccccacatactatggtactgaaacccatttgtgaagccctaatacaagctacaattagattgagaggctggacaaccaaaatgagtgactgaggcataagtctcaaatcactgacgttcactgagccagcttgagggtgcacccgggaaattgtgagtcagacacatctgtggctcttttttccaaagaggttctcaggagctttagtatttatacattttccttaaaaatagtgccttgtaaatttacattttaggtaagttaaggtgaacatttgaagaaaaagagaggaagtagctgtctcagggaggagtaaaggattgagtaatctcatcttgtttttgttctgtacctggaaagataagctagaaatgaacattatctgtgtcaggcctctgagcccaagccaagccatcgcatcccctgtgacttgcacgtatacacccagatggcctgaagtaactgaagaatcacaaaagtgaaaaggacctgccccgccttaactgatgacattccaccattgtgatttgttcctgccccaccttaactgagtgattaaccctgtgaatttccttctcctggctcagaagctcccccactgagcaccttgtgacccccgcccctgcccaccagagaacaaccccctttgactgtaagtttccattaccttcccaaatcctataaaacagccccacctttatctcccttcgctgactctcttttcggactcagcccacctgcacccaggtgaaataaacagctttattgctcacacaaagcctgtttggtggtctcttcacacagacgcgcatgaaatttggtgctgtgactcggatcgggggacctcccttgggagatcaatcccctgtcctcctgttctttgctccgtgagaaagatccacctacgactcaggtcctcagaccgaccagcccaaggaacatctcaccaattttaaatcaggtaagcggcctcttcttactctctttctccaacctctctcactgtccctcaaccactttcttctttccactcttcattctctcccttctcttaatttcaattcctttcattttctgggagagacaaaggagacacgttttatctgtggacccaaaactccggcgccggtcacggactgggaaggcagccttcccttggtgtttaatcattgcagggacgcctctctgattattcacccacgtttcaaaggtgtcagaccacacagggacgcctgccttggtccttcacccttagcggcaagtcccgcttttctggggaaggggcaagtaccccaaccccttctctccttgtctctaccccttctctgcttttctgggggaggggcaagtacccctcaaccccttctccttcacccttaacagcaagtctcgcttttctagggggcaagaacccccaatcccttatttctgcgccccaacctcatatctctgcaccccaatcccttatttccatgccccaacctcttatctctgcaccccaatcccttatgccccctcatatctctgtgccccaatcccttatttccatgccccaacctctcatctctgtgccccaatcccttatgccccaacctcgtatctctgtgccccaatcccttatttccatgccccatcctcttatctctgtgccccaatcccttatttccacaccccaacctcttatctctgtgccccaatcccttatttccatgccccaaccccccttcctgcttttcgggagggtaagaacccccaaaccccttccctccatgtctctacgctctcttttctctgggtttgcctctttcactatgggcaaccttgcatcctccattcctccttcttctcccttagcctgtgttctcaaaaacgtaaaacctcttcaactcacacctgacctaaaacctaaatgccttattttcttctgcaatgctgcttgaccccaatacaaactcgacagtagttccaaatagccagaaaatggcactttgaatttttccatcctgcaagatctaagtaattcttgtcataaaataggcaaacggtctgaggtgcctgacatccaggcatccttttacacatcagtcccttcctagtctctgtgcccagtgcaactcatcccaaatcttccttctttccctcctgcctgtcccctcagtaccaacaccaagcgtcgctgagtctttctaatcttccttctctacagacccatctgacctctcccttcctccccaggctgctcctctccaggccgagctaggtcccaattcttcctcagcctccgctcctccaccctataatctttttattgcctcccctcctcacacctggtccggcttacagtttcgttccgtgactagccctcccccatctgcccagcaatttactcttaaaaaggtggctggagccaaaggcatagtcaaggttaatgctcctttttctttatcccaaatcagaagcgtttaggctctttttcgtcaaatataaaaatccagcccagctcatggctcgtttggcagcaaccctgagacgctttacagccctagaccctaaaaggtcaaaaggccgtcttattctcaatatacattttactacccaatctgctcccgacattaaataaaactccaaaaattggaatctggccctcaaaccccacaacaggacttaattaacctcaccttcaaggtgtacaataacagaaaaaagttgcaattccttgcctcctctgtgagacaaaccccagccacatctccagcacacaagaacttccaaacgcctgaaccacagcatccaggtgttcctccagaaccttctcccccaggagcttgctacacgtgccggaaatctggccactgggccaaggaatgcccgcagccccggattcctcctaagccgcgtcccatctgtgtgggaccccactgaaaatcggactgttcaactcacctggcagccactcccagagcccctggaactctggcccaaggctctctgactgactccttcccagatcttctcggcttagcggctgaagactgacactgcccgatcaccttggaagccccctagaccatcaaggacgccaagcttcaggtaactctcacagtggaaggtaagcccgtccccttcttaatcaatacggaggctacccactccacattaccttcttttcaagggcctgtttcccttgcctccataactgttgtgggtattgaaggccaggcttctaaacctcttaaaactccccaactctggtgccaacttagacaatactcttttaagcactccttttcagttatccccacctgcccagttcccttattaggctgagacactttaactaaattatctgcttccctgactattcctggactacagctatatctcattgccgcccttcttcccaatccaaagcctcctttgcgtcctcctcttgtatccccccaccttaacccacaaatatgagatacctctactccctccttggcgaccgatcatgcaccccttaccatctcattaaaacctaatcacccttaccccactcaacgccaagatcccatcccacgacacgctttaaaaagattaaagcctgttatcactcacctgctacagcatggccttttaaagcctataaactctccttacaattcccccattttacctgtcctaaaaccagacaagccttacgagttagttcaggatctgcgccttgtcaaccaaattattttgcctatccaccccatggtgccaaacccatatactctcctatcctcaatacctgcctctacaacccattattctgttctagatctcaaacatgcattctttactattcctttgcacccttaatcccagcctctcttcgctttcacttggactgaccctgacacccatcaagctcagcaaattacctaggctgtactgccgcaaagcttcacaggcagctcccattacttcaatcaagcccaaatttcttcctcatctgttacctatcttggcataattctcataaaaacacacgtgctctccctgccaatcgtggccaactgatctctcaaaccccagcaccttctacaaaacaacaactcctttccttcctaggcatggttagtgcggtcagaattcttacacaagagccaggaccgcaccctgtagcctttctgtccaaacaacttgaccttactgttttagcctagccctcatgtctgcgtgcagcggctgccgctgctttggtactgttagaggccctaaaaatcacaaactatgctcaactcactctctacatttctcataacttccaaaatctattttcttcctcatacctgacacatatactttctgctccccggctccttcagctgtattcactctttaagtcccacaattacccttgttcctggccaggacttcaatctggcctctcacattattcctgataccacacctgacccccatgactgtatctctctgatccacctgatattcaccccatttccccatatttccttctttcctgttcctcaccctgatcacgcttgatttattgatggcggttccaccaggcctaatcgccacacaccagcaacggcaggttatgctatagtacaagccactagcccgcctctcagaacctctcatttcctttccatcgtggaaatctatcctcaaggaaataacttctcagtgttccatctgctattctactactcctcagggattattcaggccccctcccttccctacacatcaagctcgaggatttgcccccacccaggactggcaaattagctttactcaacatgcccgagtcaggaaactaaaatacctcttagtctaaatagacactttcactgaataagtaaaggcctttcctacagggtctgagaaggccaccgcagtcatttcttcccttctgtcagacataattcctcagtttagccttcccacctctatacagtctgataacagaccagccttcattagtcaaatcagccaagcagtttttcaggctcttagtattcagtgaaacctttatatcccttacggtcctccgtcttcaagaaaagtagaacggactaaaggtcttttaaaaacacacctcaccaagctcagccaccaacttaaaaaggactgaacaatacttttaccactttcacttctcagaattcaggcctgtcctcagaatgttacaaggtacagcccatttaagctctttaaaaagcatctttaaaaagatgctcatttttattagcccccagtctcattcgacaccagaccaacttagactgtgcccccaaaaaacttgtcatccctactatcttttgtctagtcatacatactcctattcacctttctcaactactcatacatgccctgctcttgtttacactgccagtttacactgtttctccaagccatcacagctgatatctcctggtgctatccccaaactgccactctaaactcttgaagtaaataaataatctttgctggcaggactatgccgaatctccttaggcactctaatcagatgtcctaggtcctcccaattcttagaccttttatacctgtttctctccttctcttattccatttttcaattcatacaaaaccgtatccaggccatcaccaatcattctatacgacaaatgtttcttctaacaaccccacaatatcaccccttaccacaagatcttccattcagcttaatctctcccactctaggttcccacgccgcccctaatcccgcttgaagcagccctgagaaacatcgcccattctctctccataccacccccaaaaatttttgccgccccaacacttcaacactattttgttttatttttcttattaatataagaaggcaggaatgtcaggcctctgagcccaagccaagccatcgcatcccgtgacttgcatgtatacgcccagatggcctgaagtaactgaagaatcacaaaagaagtgaaaaggccctgccccgccttaactgatgacattccaccattgtgatttgttcctgccccaccttaactgagtgattaaccctgtgaatttccttctcctggctcagaagctcccccactgagcaccttgtgaccccccgcccctgcccaccagagaacaaccccctttgactgtaattttccattaccttcccaaatcctataaaacggccccacccttatctcccttcgctgactctcttttcggactcagcccacctgcacccaggtgaaataaacagctttattgctcacacaaagcctgtttggtggtctcttcacactgacacgcatgaaaatcagtgtggattctgataaactaagtttagcctaaagctgcctccttgcatactttaagctcagcctaaagatttcttcgtacatagtaaactgaaaccttaactgcatgagtacacagactaacctactcttgcgccgaacactgagttttcactaattaatggtggccaactgttcaaaccatgttcaaataaggcaaaagctgagctgtaaccaatccagtggtttctgtacctcacttatgttttcagtaggtcacctgcctttttctgtcaattcatcttccatcatgtggctgtttctctgagcctacttggattcgggaggctgcctgattcgtgaatcattctttgcacaattaaactccgttaaatttaatttgtctacggtttttcttttaaccagtcttttgaaaggtttgatttctgtctagcccttaggaaagaaggtggttagcaagagaagggatagaattaggtgtgtctgtgaactcaacttccaagatttctctgaggttcctgtggccaggaagaggtccattcagtcagttaggggcttagaattgtatttctcatgatgtagaatcataagggttgataggattcaggtgcaagtttggatgaaaattggaatgtttaaacaggttttatgtaaggaagttgtctcctgtacctgaatgttatatgaaaatgggtattatgtcatactggggagcagttcctctacctagtattgcaaatccaaaacctgctgaagttccaatgaaggctatggttaggaacgaaagggttgatgagctgaaggtgaaagtttggagaaaaactagtatatctgaacaggctttatgtgaagttattgcaagagtggatttctgataggatgagtttgaaccccttttctctctctggcatatgttctctcaccatgtgatgccttccgccaatgttatgatgcagcaaaaagacccctccaagatgaagccccttagtcttggacttcccactctgcagaatcatgagccaaataaatctgtgttcattataagttaccccgtctgtggtatttcattataccagcacaagatcaactaagacagaggatattgacataaatcagaggagaaaatagaaacaatatgatgctttggaaaagaatgagtaggcaacaaacacagtaatcacaattcatcttctgggtaggaagtgtgaagacacgatgttagatactgaatctactccatgggaaaaactccctgtccctagtcctctgaggcccttggctttaccttcagggaaaatttttatctattattctctaagccaagtttgaggttggcattggagagtgggcctctttggggactgtacaaatttcattacttgctttttgatgatgcaaatttggggaccttgtgattattttagagactgaaaaattacagatacttttatgccaggtttgtggttttgctgggaatacaattctatcaaaattttagtaagcttcaagtctatttactaccagtcagttccatgtcaaaatctcttctggtcatagttcttaagcctgtgaagtctcttattttatttattcatgtttgtgtttagctcagttccctctctattatttaatggtggctattttaaggtcatctaaaacaataggctagattaggatggcaacacctttactttgacctttattactgggctaccattgtccagatgaaaggtcttactgagaaaattttgtaaagggcaatgaccaaaggctcagctttacagggaatagttgcaattgactttcccaactttgaggcttctaattattagattttacatcagttttaactgcaagccacagttagagaatgtgcctcccttagttgagttgtattctcttccatttctacttgtaaactagttaatgcttgactgatttaccttcatgatatcttgctaaaagcagaaaggggcaaccaacacacaaacacacaccaacattcttttttttaacctcttcctttacaaagctatgggcttagtagtcacatggtctgccttccaaattatcacaagttaatagttttgccaaatattttgtcatagtattacaaaagtcaccaccttcacctttttttaatttttatttttagagataggatctcactttgtcacccaggctagagtgcagtgacacaaccacaattcactacagcctcaacctcccaggctcaagcaatcctcccacctcagccacccaaagtagctgggattacaggtggtgcgctaccatgcctggctagtttttttttattttttgtagacacaggtctcactatgttgtccaggctggtcttgaattcctaggctcaagcaatcctcctgcctcagcctcccaaagtgctgggattaaaggcatgagccatgacaccccgtctggtcaccacctttctagcttgcaattatctgttgccttgctgcccactgactgactgcttaatcaatgccacatattttaggtttttgttatggtagttccctactcctggaggcaatttttgcatagttaaggtataggataagctgctaaaacaaaaggcacacaaataaagtgactcagacaagagagggatttgtttttatctcacatagcagtccagtgcaaggcagctctctttcatgaggccttccagagacccaggctccataattccataggtgctccatctactccatctacacagtgaaaggttgccagccagcatcgtaactatgacccagcttacagaaagggaaaagagagaatatggttggcgagcattttcatttacttaagtcttgaacagatatcacacacttctcttcacaaccccttagcctgaacttggtcacatggctgtatctacctgtgaggtagattgggaaatgatagttaactccagttaggtcaccttgggcacaactaaaacttgggattccattactaaaaggagtaagggtagaatatatgtttggaaacacattttctgtcactgttacaatgggggtaaggagggagagtaccacttactattatcatgtactgttgaattttttttttttctagaacaataactattttagggccaggcaacaccctaagtatttgactctgtaaaaggaaatagtttagaagttgaattcttctttttttttttttgagacagagtcttgctctgtcgccaggctggagtacagtggcgcaatctcggctcactgcaacctatgcctcccgggttcaagcgattctcctgcctcagcctcctgagtagctgggactacaggcacgtaccatcttgcctggctaatttttgtatttttagtagagacggggtttcaccatgctggccaggatggtttcgatctcctgacctcgtgatctgccctccttggcctcccaaagtgctgggattacaggcgtgagccaccgcgcccaaccaaattattcttctcagaaaaatttgatctaaggctctaattcaaaatataaaaataagtgctcattgaaaaatagacccaaactctatagacagttatacattaaaaagctttaacgttataaactcatagaatcacataatattagagctaaaaaaggaccctgagttctttataaaaaaaataaaataaactgtggctgaaaggggttaaataaatggccccaaatcagaaaggcagcaacagatctaggaccagaatcaagttcttcttttcttttgtcttttttctcttcttttcttttttcttttctgagacagggtcttgctctgtcatccaggccggcgtgcagtggcgtgatcatagctcactgtaaccctgaactcctgggcttaagtgatcctcccacctcagcctccagagtagctaagacttgaggtactcaacactgctcttagctaatttttaaattttttgtagagacactgtctcactatgatgcctaggctagtctcaaactcctgggctcaagcgatcctcccacctgggcctcccaaagtgctgggattagaggtgtgagccatggtgcctggttcaaaaccaaattctactgaatcattggatatatagcatctattttttgaggcagaaatttcactgtaattttaaagagtatgccaatttaaaaagaaaatgcaatttttccagattatgtactattaagtaattttcaattatatgacaaatgatgaacatattcatttaagaaatataacataaatcggtcaggaatggtggctcacgcctgtaatcccagcactttgggaggccgaggtgggcagatcatgaggtcagaagattgaaaccatcctggctaacacggtgaaaccccatctctactaaaaatacaaaaaattagcctgacatggtggcatgcacctgtaatcccagctacttgggaggctgaggcaggagaatcgcttgaacccaggaggcggaggttgcagtgagccaagttgatgccactgccctccagcctggggaacagagtgagactccatctcaaaagaaaaaaagaaaaagaaatgtaacataaattaatttatgccttcaatactaaatttgcttattttaaaaaattatacacaagctgaatctgatccaactggccacattacttttggattatttcactattgtatttatttcaaaatatacttatttcactgatgtttggttggtttaaaaacttttaaaaatatacttatttacttcaaataataatgtaaacatacaaagtatgagctcaatttaccctgttttgaagagtataagttgatacagtataccagtactttctgggttgttttgttgttgttgttgttgttgttttgatagggcttccaggctggagtgcagtggcatgatcatggctcactgtaacctcgaccccccatgctcaagcaatcctctcactgcagcctcctgagtaactgggactacaggcatatgtcaccatgccaggtaactttttgcattttttctagagaaggggtttcaccatgtttccccggttggtctcaaactcctgggctcaagcaatccacccgccttagcttcccaaagtgctgagattacagatgtgggccactgcacccagccttgtttgtttttaaatcctaggaatattccaaaagggagctgtctttcttcaagagaattcataatatcaagcagctcatcatatgcaaaaatatggcactattataatttatttacttatttctttatacacacccaaatcagatttaagggcacttttaagattacctaaaatatagtttatgttacaataagcgtaaatagaaaacttattttaagttttattaattcaacaaacattggctgagcatctctgttaggcattatgttttcaaatatgatgtaaaagtaaataaattattcaagtggctttagtacagatactcactaaaacaaatgagtcatcactgatttagaagacactgttggtagttttatagagctagcaggtatgatacctttaaaagcatatgctatagaattagaatttaaaggttccattgtcatcagagatttcaaaaaatacaacataaaaatgcccaaaagtccaaagcagtggttttcaactagggatgatgtagcaaaatatctaaatatattttgagttgccacatctgaagaggtgctactgacataaagggtaagagatcagggacattgttaaacatcctacaatgcacagcacagccctccacaataaatagttatctggccaaaaatgtcactagtgctgagattgagaaatgccagcctaaagtgatttaatgtgacttaataagcttaatttattatctgagagacatgacaaacacataggtatattttcacagatatgaaaaatgtagataggacaaaagttttacagttcacataaaattccacattactatatatttataattacaaagactactaatggcacatttttatgaatagcattgcactgaactttcttagatgagcagtgatttttaccttgctggaattttatagtggagctatttccttcatctttttcaatatttaacatacatctatttttaaaatgttctatataaggtgatggaatggaaagccaaataacaactgtattagggtatacacacatataatttaaaaattacaatcattgtgacgaacacactatattacagaacagtgaacaagacagtgatagaacagaagaggataacttctgtagttatttggggcatctgtagtaagggaaggataccaaagacagcttcccagaagaacaaatgcctgatctgaatgtttgtctcagaagacagtgtgtccggaattggttccttctggtgggttcttggtcttgctgacttcaagaatgaagccgcagaccctcatggtgttacagttcttaaagatggtatgtctggagtttgttccttcagatgttcatacgtgtccagagtttcttccttctgatgggttcgtggtcttgctgacttcaggaatgaagctatagacccttgtggtgagtgttacacctcataaaggtagtgaggacccaaagagtgagcagcagtaagatttattgtgaagagcaaaagaacaaaccgtccacggcattgaaggggacccaacagggttgccgctgctggctcagttggccagcttatattcccttatttggccccgcccacatcctgctgattggtccattttacagagagctgattggtccatttcacagagtgctggttggtgtgtttacaatcctttagctagacacagagcactgattggtgcgtttttacagagtgctgattggtgcattgacaatcctttagctagacacagagtgctgattggtacatttttacagagtgctgattggtgcatttacaatccttcagctagacagaaaagttctccaagtccccacttgacccaggaagtccagctggcttcacctctcaataggggggccttatatgtatatcttgccaaagaaagaacttctattttactaataacaggtttaccaatcatctcaatgaagtatttagagaagagaatttcttaaggtttacattttagaaagatcactcaggatggttgtaaagtggccaggcaggagaaagagatactaattagaacccatatccaaggtgataaggctctggaataagacagtcatccaataatgaaggggaaaaaggaggagatgcattgaagaaatgttaagaaaaactggtagaactacagatgatacttcatgggcacattaatataaggaaattgcctctggtggcaaaaactaggatgagcccatgctgtgggatgctttcagggcaggctaaaaaggaatatgtaaatatttataatacaaaattaccattagtttaatatccatatataacacaaaacttttaattactaaattaacctttttttcttttttttggagacagggtcttgctctgtcacccaggctggtgggcagtggcatgatcgtagttcactgtaacctcaaactcctgggctcaagtgagtctcctgcctcagcctctcaagtagctgggactacacacatgcaccaccacacccagctaatatttttatttttttgtagatataggttctcactatgttgttcaggctggtcttaaactcctagcttcaggcactcctcctgtcttagtgccacaaagcactgggactataggcatgagccacaatgcctggcctcttaattttatcttaagcacaaaactgactataaaatactttaaaaatagaggtatcaaacttcagggcccaagtaaacaatgtggaggtcatcattaccatcctcacaacaagaaaaataccgaacaaaccgaaaatcaacaactcttcttggaaccatcaaagaattatggtaatagagcaaactgcagccactaaaactggagagatagacatgcagatacagacaatcacagcttagtgggagcagaagcctgaagctgcagccactatctggaggaatacttgaaactgtaattaacaaacttctggaggcttagtgtcaactaacttgagaattaaatactctgagggggtccagtcttaggggcgcacccacactttcttgagttttacctacaggaggcccatcaggttctcctgtgaagaccagagaaaaatccccagctgctctggtagagggaggagtaaagtcaccattttgaaacacaccaagggttttctattcttaacaaggcctgcctcaagggaaactattttaccagaacctatcagaagagggttttaccaaagccctaacaaccttggggaagggaaataaatacccaacttagtttcaataaaacactgagaacctaatcatgggactataaaatgctttcccctcctcccgccctacccaccacatcaataggtctgttgtataataacagagattttagctaagagaacttcaagtctcaggcactgtatcaaggagtctctatgaaaagcccaaaacaacaggggagagaaaaacaaagacatagaggaaatttcagcctctaatgccacagctacagcaaacagtaaatacagcctaactcccagccagaaaaacatgaaattttacactaaagacctattgacctcatttccatttatctaatacaacatgttttgcttccaagaagaaattacaaggcatgcaaaaaggcaaaaaacagttggaagagacaaagcaagcatcagaaccagactcagataagacagagatattggaattatcagatcagaaagttaaaatgactatgattaatatgctataagctctaatttaaaaattagataacatacaagaacagatgcgcagtgtaagcacagagagggaaagtctaagaaaaaaatcaaatggaaacactagaagtaaaaaacactgtaatggaaatgaagaatgctatcaatggggtcatcaacagactacatacagctgaggaaagaatcactgcacttgaagagagatcaatagaaacttccagaactgaaatgcaaagagaaaacagaatgaagaagacagaacagaatatccaagaactgtaggacaaaaaaagggggtaaatatatataataggaataccagaaggaaaagaaaaagagaaaggaagagaagaaatatctgaagtaataatgactaaggattttccaaaattaatgatagacatcaaaccatagatccaggaagttttgaggacaccaagcaggataatgccaaaaaaactatacctaggaatagcatatttgtgtctgcagaaaatcaaagacaaagagaaaatctttaaagaagcgagagggtagcagtggaaacaattacctatagaggagcaaagataagaattacatctgattcatcttcagaaaccatgcaagcaagagaagagtagagtgaaatattttaagtgttgaaaggaaaaaaaaacccactaacctagaattctatattctgtgaaattatcatttaaaagtaaaggagaaataaagacttttaaggcaaacaaaatcaaaggaatttgtttccagtagacctgtcttgcaaggcatgttaaaagtagttcttcagagagaaggaaaattatataggtcagaaacgcagacctataaaaagaaagaaaaagcatccgagaaggaataaaggaaaaaggtaaaatatgttttatttttttcattcttaactgatctaacagataacagtttgttcaaaatagtagtagcaacaatgtattcagtgagtatagcttatggataagagaaatgaatgacaacattgtgataagggagaggagggagggattgggaacactctgttataaggtacttgcactactcatgaagcactattgtgtcatttgaaggtggacttttattagtagtaaatatatattgcaaactctagggcaatgaataagaaaaatgtaaaaagtataattgatatgctaagagaggagaaaaaatggaatcatataaaatgctcaattaaaaccagagaaggcagcacaagagtagaagtcagaagaaaaggaaacttcatggccactacactacagggtatgtggcactgtaggagcacaggaaactacagggttcccatgatcagaaaaaaaaaaaaaaaaaaaaattttgaaaacccactgctttagaagaaaaaatgatctctgaagtagatctcctaatagtttacccatttaaaatatctaactcttcagagaatctggagaggcagtttctactttgaaactgggattatacaaaactggaagtccagtgcttccaatctggtgatctaggtcatatcctcagagctcttgagtcatgaggcccccagatgattctcccaggtcatttcttacacactctccttttcctccaggaaaagtataggagggtatatgtctgggttctctttgccacaagtatagttccagttaataaggtggcttttaccttttgacactcttttcttgctaccctaacagtttatttcaaacagtggtttatggaacattgcatcagaatcacttcaggtgtctgttaaagagtgagattcctgggtccagcccaagaactactgaatgcgacactcagggagggggctcaggaatgtgcattgctagcaaatgtcacaagtgagtattaagcacactaaagtctgagaaccactgctttaatatatagttcctggcagggcatggtggctcatgcctgtaatcccagcacttcgggaggccaaggaaggcagatcccttgacatcaggagtttgaggccagcctggccaacatggcaaaaccctgtctctactaaaatacaaaaattagccaggcatggtggcacatgcctgtagtcccagctactcgggagactgaggcaggagaatcgcttgaacccagggggcagaggttgtggtgagccaagatcgtgctaatgtactccagcctgggcgacggagtgagactccatctcaaataataataataataataataataataataataataataataataataatatagttcctttagagttggggatggggtagggaaaactcttccttttatgttttgggacaatttaccacttggaatatttgtcccctaatcgcctgctgaatacatctgttaaccaaatacagtacatgctcaaggaatatttgttgaaagatgacttgaggaacatagcatcatacttccttaatgactgtgataagcaaaacattttggttcttcaaacctagatagtagttgttttattctaaataagttaaacagttcttatagtcttgtatgtcatgtgtacagaatagctataattttaaaactgcgagagtaagacaagccaaattttctttatttatttcccacctggaaaatccagaatcaaactttatttagatgttaggcttgctctgatacagaccttcaaaaaaacaaatcactggagcttctcatgtcagcagaatctggtttaaagaattcctgcaaaggaaacataaatggatgaaaatataaacatctatagaaaatataaatacaaatataaatgcaaaacaacaaaaaacttatatagaattgttgatatggtttggctgtgtccccacccaaatctcatcttgtagttcccataattcccacatgtcatgggagggacccagtgggaggcaactgaagcatgggggtggttaccctcaggctgttctcatgatagtgagtgagttctcatgagatctgatggttttataaggggcttttcccccttttgcttggcacttctctctcctgctgtctcttgaagaaggacatgtttgcttccccttcagccatgattgtaagtttcctgaggcttccctagccacatggaactgtgagtcaattaaacctctttcctttataaattacccaatcttgggtatttcttcataggagcatgagaacggactaatacagttgtcataaggatcaaaatgtgagcaggagtgtcagcaaatgttagggagactatgaggctggcctgaggggtggagaaatgggcaaaagagtatagaggctagggtaaactagaagagaaaaaaatgagtgggctaagaacattaaggcctactcatcaaacctcccaagaaccagaaaactaaggatgttaagaaaccaaaaagctaatctacaagcaaaatataaaagaaacaggacttttaactgggttcttcaagtattaggtcaatgaattacacattatactacattactagactactttgtaaggctttgttaaactctaacactagtatccaatcaaaactgtataatcacctcagaatctgtgtgagagaagggccctcaatttttagttctttttttttttaattttaagttccttctaatattcccagcttagaaaatcttgggaaaactgagccatagcccattcttccatacatgttctttgcagaagaaaacagacaaggagtaaataaaagcaatacatgatcactctccagaggccttacttcttaggagactgtgccattcaaaagggaggcaaggctctcctccccatcgacttattagtgggacatgttatatgtgtggtatgctgtgtgtgtgcatgcgtgcatgtacatgaatgagtgtattacgaggacatgtgtgggaccaaccaacattcagactatgacgtaccttgaacctatcagcagcaggatgtaaacattcacaagaatgctgtcactctggaaaagacatgaagttttatgtatatatttagtctttcctccttagcagaggagaggaacagagacagagagaagcaggactcacacacacggagaaattctcctaagttggggggcagaatagggtggaggggtcggtcctcaccccttcctccctgtacattctgaatggccaggtgagaggcaaaactccatcaaaaagaaagaaacaactgaagatagactacactggaaactcactctggctgctgtgggcagacatattctttttcaaagacatagttgaagagctagccttaaaatttgtgagaggttgcaagcctgcacaaaaataaaagagataagaaaaacagtaaagtaaatattggcaaagtcttctaaaattaatctgtgataaaagataaaaaagtaaacttgtaggcagaaggcaaaaattacctgcaaacaactttttttctagttcttcttggatcttaagaagaattctctcctgttctaaggcttctatatactttgagtagcaccaggttggctaaaaaaagcaattttcaaagttaattctgaaatgtttgctttaggaaataaactgaagataagatgtcttctatcagcctcttcatttaaatttttattaaagtataacacacataaagaaaagtgcacatcacaagtttataatgatatgaatttttaccaactgaatgtacccaggtcaccttttaactgggtaccacaaattattatcaacctaccttagtccattttcataaaaatatttatgataaagtaagtatattttcttccatagccttgacaaaatgtttaaattccctggtttgcagggaggaggtgaggtgggaacgtgagggtggtgatattctgtttctcagtgaatcaatgtcaacaaaagctttacagatatattgacagctattcagtcatctttatatattcaatttgattgtaaatttagtgcttaggaaagatctttatatattcaatttgactgtaaatcaagttttagggggagagtaactttgcatttggattcattataattcttcaatgtgcaaaatctatctaaaacaaattcatatacagttaaccctttacatccacaggttctgcatctgcagattcaacccaattgcagatcaaaaatatttttaaaaatcaacaaaaaataatacaaataaaatatacagtataactatttacatagcatttacttctgctatagtatacttaggtaatatatgtaatctagagatgattcgaagtatatgagaggatgtggataggttatatgcaaataccatgttgttttatatcagggacttgagcatcttcagattttggtatctgcaggaagtcttggaaccaccccacagtggacactgaggaacaactgtatagggcatctacatttacaaaatgtcagtgtattattactttacaaattgctaaagtaattcaacatgtatactttaaacagaaatcattataagctacatttatatttataaaatatctttggtttctaaaagttttttagtttcctacaaaaatcttgaatatgacaagatagcatcgtcatcaccaccatcatcatcatcatccctttctctctctctctctttttaaccgataaggtaagaggctcaaaggaaattatgtgattatatccaggtttcaagataatactgacttgtgataaaaaaagattagaagcctgttacctcacacctgtaatcctagcactttggaaggctaaggtgggagaattgcgcaagcccaggagtttgagagcagcctgggcaacatggcgaaacctcatctctataaaaaatacaaaaaattagccaggcatggtggtgtgcgcctgtagtcccagctacttgggaggctgaagtgggaggattccttgagcctaggaagttgaggctgcaaagagcccttgcaccctttaacctgcaaagagttatcgtaccagtgcactccagcctgggtgacagagcaagaccctgtctcaaaaaaaaaaaaaaaaaaaaaagcagcagcctgatatctctaactggaccctgatatctctaactggacatttccccctttcacactgtgtttctaaaatttaatgctagtcatttgctaatgaatggtattatttgctaggtatcatatgcttttagatatctctttcagtatacagttccataaaattggatatttctcttctctcaataatagcttcatagttagccagttatcttagctgggtaactgaacttatttgacattcctaaatgccaaaaagattgtttcttgagttagtattactctaaggtacaaatgctttcaataccagtcatcaaaaatagacataagttaaacatacgacatttcagggaagtaacagtaatgtactagttataaatgtacatgtaaacacagaaaccataatgtattggtggatggtcatgtatggttaattttatgactacttcaaaaaactaaaaatttgagactaagcatttgacattcttctgtcattttttaacccaagaatacaacatcctatatatattccatcttgttctattgtactgtatctgtcttattttcttttccaacaagatgatcacttcaacttctgcaatttgtcttcctcatgtatctcaagaagttatttttctttattaaactatctgggattggctgaaattttaatgaaggctcaaagaaactcccttcaatctctcctactattataattgtaggcttattttcaaacaaacacatttctagtactgtacaatgactgagttactgcattccactatccaatgctccagcggggaaatgaggtctgcaccatcttgcatgcttacctgtcggccatatggttggaggcctaggaaggaatcactgagtaaagcagttttgatagcaggcactgaagtatttgcatattgtttgattccatcctgtaattatattaaattaaattattacccagaaaagataatgatatgttaatataaacttatggctaaggagttataacatcatatgacataatatttcatagtgagtgctgcacttaaggtttcatcaagtcaatatcactaatgtgacagagtctcctgctttgatctttaatcttatttcatactaatataaaaatactttaaaataaatgagagaaatgattaagttgaatgtaaaaatcattcccaaattctggaatccaagaaaaaccactataaacattttcatgaacatccatccatatttctcactagggaaaatgcatagattcacaattttaatctttatattttattatataaattttatacaaatagaatctaactacgtttgctctttttaaatctgccttttcatgtagaatatgttgtgaaaatgtgaataaatataaagctggaatgtattctgggcctttgtattttttaccattgtttatctgctgtagaacagtgtctgccacatagtatgcactcaaatatttgttgaatgatgaaattaataaattacatcaccattttcagtggatgaatgatcttatgcactaaaaggtttgctgaatgataaaatgaataaatgttatcatcacttttgacagataatattttagaaaaaggatgtatcatagataatttaattaacaacactcattagaaatttaggtcattttcttactcagcaacagaaagtcaaaaaccacatgttctcacttataagtgggagctaaatgatgggtacacacagacatatagagtagagtaacagacactggtgactccaaaagttgggagggtgggaggcaagtgaacgatgaaatacaacctgttgggtacaacatacactatttgggtgatgagtatacttcaaagcccagactttaccacacacaacatacccatgtaacacaactgcacttgtactcctaaatctatacaaataaaaaattaattaaatttccttaaaaaaagaaaaaaaaacttacccaaacttaagaggaaaacacatttgaagtaattataacaaaaaagaaccatgtataattgtatttcaattaatacaaatctttaagaaaaacaaataagccaacagatgagtaaagaagagacacaacagaaacttccccaaagaggaaatgctatgcttaacagaaatggacaattttttcaatatccctactaattaaagccatgaaagtaagaacatttcatgcctttcaaattagtctttaaaaatgataaaatgagagtttcaatgtatgaattttgaggaacacaaacatgtagtccataccaactacttttcatttctagaacttcattatccaaaacagaagctctgttcccattaaataataactccttactgccttctatccccagcccctggcaacctctattctttctgtttctatgaatttgactattataggtacctcatctggcaagatggctgaataggaacagctcccgtctgcagctcccagcaagaccaacacagaaggagggtgatttctgcattttctcctgaggtacttgttcatctcattgggaccagttagacagtgagtacagcccacagagcatgagcagaagcagggtggggtgttgcctcacgcaggaagtgcaaggggtcggggaactccctcccctagccaagggaagccatgagggactgtgctgtgaggaatgatgcactccaacccagatactatgctcttcccacggtcttcacaacctgcaggctaggagattccctcgggtgcctatgccaccagtgccctgggtttcaagcacaaaactgggcagctgtttgggcagacaccgagctagctccgggagtttgttttttttttttgtaccccagtggagcctggaaccccagcgagacagaaccattcactcccctggaaagggggctgaagccatggagccaagtggtctcgctcagtgggtcccatctccaagtagcccagcaagctaagatccactggcttgaaattctcactgccagcacaaaagtctgaagtcaacctgggacactcgagcttggtagggggaggggcgtctgccattactgagacttgagtaggcagttctcccctcacagtgttaagtaaaccgctgggaagtttgaatggtgtggaactcactgcagtgcagcaaagcagctgtggccagactgcctctctagattcctcctcactgggcagggcatctctgaaagaaagccagcagccccagtcaggggcttatagatcaaactcccaactccctgggacagagcacctgggggacggggtggctgtgggcgcagcttcagcagacttaaacattcctgcctgccagctctgaagagagcaaaagatctcccagcacagttctcgagctctgctaagggacagactgccttctcaagtgggtccctgaccccagtgcttcctgactgcagacacctcccagcaggggtcgacagacacttcacacaggatagatccaagtggcatcaggcaagtgcccctctgggacaaagcttccagaagaaggagcaggcagcaatctttttgttctgcagcctctgccggtgataacccaggcaaacaggatctggagtggacctccagcaaactccagcagacctgcagaagaggggcctgactgttgaagtaaaactaacaaacagaaagcaataacatcacatcaacaaaaagggcacccacagaaaaactccatcaaaaggccatcagcatcaaagatgaaaagtagataaatccatgaagatgaggaaaaaccagcacaaaaaggctgaaaattccaaaaaccagaatgcctcttctcctccaaaggattgcagctcctctacagcaagggcacaaaacgggatgaagaatgagtttgacgaattgacagaaataggcttcagaaggtgggtaataacaaactcttctgagctaaaggaggatcttctaacccaatgcaaggaagctaagaacattgacaaaaggttacaggaactgctaactagaataccagtttaaagaagaacatgaatgacctaatggagctgaaaaacacagcacaagaacttcatgaagcatacaccaatatcaatagctagactgatcaagcggaagaaaggatatcagagattgaagatcaacttaatgaaaactcgtgaagacaagattagagaaaaagaatgaaaaggaatgaacaaagcctccaagaaatatgggactatgtgaaaagaccaaacctacaattgtttggtgtacctgaaagtgatggggagaatggaaccaagttggaaaacacacttcaggatattatccaggagaacttccccaacctagcaagataggccaacattcaagttcaggaaatacagagaatgccactaagatactcctcgagaagagcaaccccaagatacataatcatcagattctccaaggttgaaatgaaggaaaaaatattaggggcagccagagacaaccctttataggtcaggttacctataaagggaagaccatcagactgacagcggatctctcggcagaaaccccatagggtaagccaggaaagagttggggccaatattcaacaaccttaaagaaaataattttcaactcagaatttcatatccaaccaaactaagcttcataagtgaaggagaaataatcctttatacacaagcaaatgctgagggattgtgtcaccaccaggcttgccttacaagagctcctgaaggaagcactaaatatggaaaggaaaaactggtaacagccactgcaaaaacataccaaaatggaaagaccaatgacactatgaagaaactgcatcaagtaatgtgcaaaataatcagctagcatcatgatgacaggatcaaattcacacataacaatattaaccttatgtaaataggctaaatgccccaattaaaagacacaaactggcaaattggataaagagtcaagacccatcggtgtgctgtatcccggagacccatctcatatgcataggctcaaaataaacaaatggaggaatatttaccaagcaaatggaaagcaaaaaaaaagcaggggttgcaattctagtctctgatgaaacagactttcaaccaacaaagatcaaaaaagacaaagaagggcattacataatgttaaagggatcaatgcaacaagaagagctaactatcctaaatatcctaaatatatgtgcacccaatacaggagattcataaagcaagttcttagagacctacaaagagacttagactcccatacgataatactgggagactttaacaaccccctgtcaatattagacagatcaatgaaacagaaaattaacaaagatattcaggattgaactctgctctggaccaagtggacctaatagacatctacagaactctccaccccaaatcaacagaatatacattcttctcagcatcgggtagcacttattctaaaatcaacaacataattggaagtaaaacactcctcagcaaatgcaaaataacagaaatcataacaaacagtctcttggaccacagtgcaatcaaattagaactcaggattaagaaactcatttgaaactgcacaactatatggaaactgaacaacctgctcctgaatgactattgggtaaataagaaaattaaggcagagataaataagttctttgaaaccaatgagaacaaagacacaatgtaccagaatctcagggacacagctaaagcagtgttaagagggaaatttacagcactaaattcccacatcagaaaatgggaaagatctaaaattgataccctaacatcacaattaaaagaactagagaagaaagaacaaacaaattcaaaagctagcagaaaataagaaataactaagatcagagcaaaactaaaggagatacagacatgaaaaacccttcaaaaaatcaatgaatccaggagctggttttttgaaaagattaacaaaatggaacactacccagactaataaagaagaaaagagagaagaatcaaatagatgcaattaaaaatgataaaggggatatcagcacgaatcccacagaaatacaaactaccatcagataatactataaatacctctatgcaaataaactagaaattctagaagaaatggataaattcatggacacatacaccctcccaagactaaaccaggaagaagtcgaatccctgaatagaccaataacaagttctgaaattgaggcagtaattaatcacctactgactaaaaaaagcctaggaccagatggattcacagccaaattctaccagaggtacaaagaggaggtggtaccattccttctgaaactattccaaacaatagaaaaagaggggctcctccctaactcattttatgaggccagcatcatcctgataccacaactggcagagacacaacaaaaaagaaaatttcaggccaatatccctgatgaacatcgatgcaaaaatcctcaataaaacatttgcaaactgaatccagcagtacatcaaaaagcttatccaccacaatcaagttggcttcatccctgggatgcaaggctggttcaacatatgcaaatcaataaacataatccaccacataaacagaaccaatgacaaaaaccacatgattatctcaatagatgcagaaaaggcccttgataaaattcaacacctctttatgctaaaaacactcaataaactaggtattgatggaaatatctcaaaataataaggtcaatttatgaaaaacccatagccaatatcatactgaatgggcaaaagctgaaaggattccctttgaaaaccagcacaagacaaggatgccctctctcaccattcctattcaacatagtattggaagttctggcgagggcaatcaggcaagagaaagaaataaagggtattcaaataggaagagaggaagtcaaattgtctctgtttgcagatgacaggattgtatatttagaaaaccccattgtctcagccaaaaactccttaagctgataagcaacttcagcaaagtctcagaatacaaaatcaatgtacaaaaattccaagcattcccatacaccaataatagacaaacagagagccaaatcatgagtgaactcccattcacaattgctacaaagaaaataaaatacctaggaatacaacttacaagggacctgaaggacatcttcaaggagaactacaaaccactgctcaaggaaataagagaggacacaaacaaatggaaaaacattccatgctcatggataggaagaatcagtatcgtgggataggaagaatcaatatcatgaaaatggccatactgcccaaagtaatttatagattcaattctattcccatcaagctaccattgactttcttcacagagctagaaaaaactactttaaggttcctatggaaccaaaaaagagcccacatagccaagacaatcctaagcaaaaagaacaaagatggaggcatcacactacctgacttcaaactatactacatggctacaataataaaaacagcatggtactcttaccaaaacagatatatagaccaatggaacagaacagaggcctcagaaataacatcatacatctacaaccatctgatcttcgacaaacctgacaaaaacaagcaatagggaaaggattccctatttaataaatggtgttgggaaaactggctagccatatgcagaaaactgaaactggaccccttccttaaaccttatataaaaattaactcaagatggattaaagagtgaaacataaaacctaaaacaattaaaaaccctagaagaaaacctaggcaataccattcaggacataggcatgggcaaagacttcatgactaaaacaccaaaagcaactgcaacaaaagccaaaaacgacaaatggggtctaattaagctaaagagcttctgcacagcaaaagaaactaccatcagagggaacaggcaacctacagattgggagaaagtttatgcaatctatccatctgacagaggtctaatatccagaatctacaaggaacttaaacaaatttacagggaaaaaacaagcaatcccatcaaaaagtgggcaaaggatatgaacagacacttctcaaaagaagacatttatgtggccaacaaacatatgaaaaatagttaatcaacactggtcattagagaaataaaaatcaaaaccacaatgagataccatctcacaccagttagaatggtgatcatgaaaaagtcaggaaataagctgggcgtggtggctcacgcctgtaatcccagcactttgggaggctgagaagggtggatcaccaggtcaggagatcgagaccgaccaggctaacatggtgaaaccctgtctctactaaaaatacaaaaaaattagctgggtgtggtggtgggcgactgtagtcccagctactcgggaggctgaggcaggagaatggtgtgaactcgggaggcagagcttgactccatctcaaaaaaaaaaaaaaaaaaagtcaggaaacaatagatgctagagaggatgtggagaaataggaacacttttacactgttggtggaagtgtaaattagttcaaccattgtggaagacagtatggtgattcctcaaggatctcaaaccagaaataccatttgacccagcaatcccattactggggatatacccaaaggattataaatcattctactataaagacacatgcacaggtatgtttattgcagcactattcacaatagcaaagacttggaaccaacccaaatgcccatcaatgatagactggataaagaaaatgtggtgcatatataccatggaatactacacaggtataaaaaacaatgagttcatgtcttttgcagggacatgaatgaagctggaaaccaccattctcagcaaactaacacaggagcagaaaaccaaacaccacatgttctcactcataaatgggagttgaacaatgagaacacatggacacagggaggggaacatcacacaccagggcctgtcaggggatggtggcaaggggagggagagcattaggacaaatacctaatgcatgtggggcttaaaacctagatgacgtggccaggcaccgtggctcatgccttaatcccagcactttgggagactgaggcgggcaaatcactagctcaggagttcaagaccagcctggccaacatggtgaaaccccgtttctactaaaaatccaaaaaattagctgggtgtagtggcgggcgcctgtaatcccagctacttgggaggctgcggcaggagaatcgcttgaaccctggaggcagaggttgcagtgagtcgagattgtgccactgcactccagcccgggcgacagagtgagactccatctcaaaaaaaaaaaaaacaaaaaaaacccaaaaacccagatgatgggttgatgggtgcagcaaactaccatggcacatgtatacctatgtaacaaacccgcacgttacgcacatgtatcctagaaattaaagtataataaaaaaatgcatattaacaaaagtgtagcaaaatgggtattttctgccaatttagattgcagatcattttaaattggcatacacattttaatagaataatttgtatcttttctgatctctgaagctaagcagaatggagcctggttactacttgcatgagagagtaatttgtaaatgtgttgaataccttaaaatggttataccctttcagcagtcaattacacatttaaatgtatagtttcatgaagtaacccaaaagtttggtgatgggctggggttggggaggggtgattttatccaacaagaccaatattacaacagcataagcaacagtgagatagaaatgtttagatttaaatgtttggttaaataacccatggccataacccttccatggaacattttctagtcataaaatgctatgttcacaaagaatgtttaatgtagacaatgcttatgatacaatagtaatgagaaaaaaaagattaaaactgcatataacaaatggatataaggccgggtgcagtggctcatgcctgtaatcacagcactttgggaggccaaggtgggtggatcataaggtcaggagttcgagaccagcctggccaacatggtgaaaccccatctctactaaaaatacaaaaattagccaggtgtggcaacaggtgcctgtaatctcagctacttgggagtctgaggcaggagaattgcttgaacctgagaggcagaggttgcagtgagctgagatcatcccactgcactccagcctggatgacagagcaagactctgtcaaaaaaaaaaaaaatggatataattatgtaaaacaaaaataaaaccctatgcattaaaaaaagtcttaaaggcctggcacagtggctcacacctgtaatcccagcactttgggaggccaaggtgggcggattacttgaggtcaagagtttgagatacctggccaacatggtgaaaccccacctctacaaaaaatacaaaaattagccaggcgtggtggtatgcacctttaatcccagctactcaggagattgaggcagaagaatcgcttgatcatgggaggtggaagttgcagtgagccaagatcacgccatggcagtctagcctgggcgacagagtgagactccatctcaaaaaaaaaagccccaaagaaaagacattaaaatgtagtcactatgcatagatggtattaataaaataatagtaataatatattggtattagattagaaacttgtaatattaagattattctatattgttgaaccaacatctgataaatctgtttgcagtggtgacagaattttaaaagtacctattattttcttattactaataatccttaattaacctggtgatattatcaacaacacagttcactcttgctttaataatggaaatcctgtattttatttctcaatttcctgtgtagctggctagggttatgctatattctgtaaaggacaagatattttgctagtgtggcacaaatttgagaagacccaaggcctagcatttcataggatgaacttgtccttgactttttatatccagatgatagtgtgtattgccattaaaataattagatgaccaaaaaaaaaaaagaaatttgggtcactttcaactttttactattataagtgatgctgtgtatatacatctttgtgcatgtttatgattctcttatttatttatttatttattttaaaattatttgtagagatgaggtcttgctatgttgcccaggctggtctccaacccctgggctcaagcagtcctccttccctggcttgccaaagtgctgggattacaggtgggagctacctcacccagctgattctctcctttagaataaatttctagaagtgtatttgctgattaaaaagaatgaacatggccaggtgccgtggctcaaacctgtaatccaagcactttgggaggctgaggtgggcggatcactggaggtcaagagttcgcgaccagcatggccaacatggtgaaaccctgtctctactaaaaatacaaaaattagcctggcatggtggcatgtgcctgtagtcccagctactcaggaggctgaggcacaagaatcacttgaacctgggaagcagaggttgcaatgagctgagattgcaccactgcactccagcctgggtgacacagcgagactccatctcaagaaataaaataaaaaaaataaaaataaaaagaatgaacatgctttttatggcagactgaacagactaatacaatatgataccatttatgtaagttaaaaaacattaaaacagtactttgtattgtttatgaatgcatccacatgcatgaaacactgtcttttgtttgtttgtttgtttgtttgtttttgagacggagtcttgctctgttgcccaggctggagtgcagtggcgccatctcggctcactgcaagctccgcctcccgggttcacgccattctcctgcctcagcctcccaagtagctgggactacaggcacctgccaccacgcccggctaattttttgtatttttagtagagacggggtttcaccgtgttagccaggatggtctcgatttcctgactttgtgatccgcccgcctcggcctcccaaagtgctgggattacaggcgtgagccactgcgcccgactgaaccactgtctttaaaaagagctggacaaatatatcccaaacttaatgactgctcctagatatagggagggttatagaactcagggctgaggttactagatcttactctatttgcaatgttttatttctaatgggaaaaagaaaaataaggcaaaatgttaaaagtgtttattttggcctgcacaaataaatgtgagtgttcattatattacttttgtgtctttccgtgtcttttacatttatttttaaaaatgaaataggtataagcttataaataagatgaaacatgttatttgggagcaattaccccttcttaattaaaacagataaatataaagagagaaagagaccaatgaatgaatgaatgaacggacagatagtagacaaatagggaggctgcccaatttgtgacttgtttacacatttcacaatgtatcattctgtaatttttctttttttttagatggaatatcactctgtcacccaggccagagtgtagtggcataatcttggctcactgcaacctcttcctccagaattcaagcaattctcctgcctcagcctcccaagaagctaggactacaggcgcaagctgccacgcccggttaatttttttttttttttttttttttttgtatttcagtagagatggggtttcactgtgttgcccaggctggctgcgaactcctgagctcaggcaatccgcccgtctcggcctcccaaagtgctgggattacaggcgtgaggcaccgtgtctggcccattctgtaattttcatattgaaaatgttgcccctgccagtacatactatttgttcattcatttcctgatttattcaataaacaatattaataattaagcatgtgctggacactagtgtaaggacttataaaacaaggataaggcggatactatcattgaggatcttagtccaatgaagatgacagacgtaaaaacttaatcacaggactatataaagcatgttctacaaggtggaggaacgttattgcagcggatgcaagctgcttgcgttgccacagagagtcaaggaagtcttcacttagaagagatgacatttgaaatgaatttagaggaattccaaaagtctgaagcttctgactgaaggcttaaaatccactaatatctgtattccataacttctctctatatatccccagacaaaattattctataattcacacatatcacataacttttaaaagtctgataaaacccaaaatgagtcttgtctcacctttccagatttttcgtcttctaggactgccaatttttttttctgcttattatattcttgtcttctctctaaaacactcataatattttcatctgttaaattcttcctaaactcacagaactgaggccagaatttaaacagaaccccaaaaattgtcatctgtataaaaaaaagtctaagattacaattttatacaaaggtaccaatttaaactctattcaccataataacagattaactattatatctttaatatataccatgtttgctccaacttattgtctccagacatcttggtatagttttgctcagcacatgcttatcatcaatggtttttattaccaatgagaagtctttcttttaaaaaaaaatacattaaatacacttaaaagtcactttattctttatgtctccctaaccaattgattgtattaataaagaatccattaggtcttttaaaataagaaatttatgttttcttttaaaacatatactagttgatctgccatacactctgctgttttatgcaagtattccaaatgtccagttcatcaaggaaactccctcctccctcttttctttcttttagagaaaggaaataccattttgcctctggaaaagctcttaaacaaagctgcagatctaagaataaatcttgagtaaattttaaatgatataatctcttacttttatgtgagagcaagaaaagtaacatttaaaaagcagaacggtatcctggacaaatgctttctataaggacactttaagtgattaattgtgatatttatagagataagaatagttgctctaattctcatgccaagtttttccattagttccagaggcatacattacttccaagaaggtaggacttgccacataagatcaagtccaacatcttattgctaggaatggcctttacctaataccctggaaaaaaatgaaccatcccattaggctccaagccaactcataggggaaaagaggaatctttaaaaagtaaatgctgcagtgatcaacagagacctgaaatggcgtatttcattactcctcttttccatacatgaatgctattagtaatactaaaattattcactccttctaaaatacagttttgttattgaattctatagcctcttgggagtgtaaatgtaaaatctagagatactttatttgatgaaacgcaggcttttaagacattttcatttacatttacctgccatacatttaattaagtaatcccctgttccaatgttaagggatcatggcagtttttattatgaactgaagcttaaatactcctcctcctctattaatcatacttctcagttatctttctaaaacctgagtcagtcccagttcttgaatatatatatttccatttagaaggctttctaagtaaaagtcacccaattaagacacaatttttcaatagaaggcataaaactactctattgttagaagttgcaattgagattgtaggttaatatatattgttaattaaaattaccctgtacctctctaatcttaaaagataaccaaattgtggataagaaaatgttttaataaatatagagctactttactcactgccagtagataaataatggctttagtatgagcaaaaggggccagtgaaaatttggctgagtgatgcaaactttcaggctattgggagtgggagtgagggatagacagaggctacactgatacaatgctaaaactgtcagcagttttaaatttactattcagcccttctgctcaactttgctctcatatccaatttgatcttactcctttctgtcatgatatatttcttctcacatcattcatttatgtgtccaaaaaatgccttctctatgcctggcatttggactgcaaagataaataagaaccattccctgccctcaaagaggttacagtctaatgggaaagtcagacatgagaacaatcactttcaatttagtgtgataagtgttacaacagaggtaaaaacaagggagagaagacgatactgcaaaaagctcaggagagaaagcagtaagggccacttatgaaactacaattatttcaattagactagggcagagatggcagggagtggtaaaagatgtagctagagagatatctaggagtatggacttcattctgagggcagtgggaagtatctgaaatagttttaaaattattatttgtagagacaggatctcactatattgcccaggctggtcttgaactcctggcctcaagcaatcctcctgccttggccttccaaagtgctgggattacttacaggtgtgagccagtgtgctgcaccggaattgaaatattttaagcagagaagtgacatgatcagatatacattaaaaaaggattgctctgtctgccctgagttggatggtttggagagaacccagaggccaggagtttctgtaatacattatgagtcatgttgcagatctaaagtgaggtagttgagtggagatgtggatagaatgacagataacgaggagacaactaggtaagttttaggaacggattagatacagaggtaaggaaatgaaatagagggaagacatggagatggccaaccagatctgtggcttgtatcctggggtaggaggcaatgccattctctaaacttccttgggaaaacaggaataacaacagattcagtgtgatgtggcccctaaataaagattatttattttcagatgctctaacgtccatatttaagatatatctaggactcccttttagaaaatcaggtagaagtcataggctagaagactccaataaaattctttggttacagtccctgaagagtataccagaaccgaaaggtatcggcagctccagacatttaccgtcagactcaaggcctttggtatcgatgggtaagtcctggcctggttactagaaaacccaggctaggttaagctatctctaagatcttttcattaacagatattaccattctgacaccatgtttctctatagcacgtcctcaatcattcctctatatttctgcctattttaatgcataatttggattgtgagtccacttttagttccttagaggacttagaacacagctggctctcaaatgaatctaagaataatcgcctttttccatgctcaagggcaataataccctaagtctctgtttcatatcacttcattcatgacatggccttccctattacccctattataatttatttttcttaatcattttttagtaacaacatcactaaaaggctttttaaaatgcaaataaattatgttcaccaagtcactgttttctattatttatcttaaaaagaagtaacttgagcaggttaacaggcacaattttcctttcatgagtttgtatactttatgttggtagagttcttaaatctcttctcacttattttatgagctatgtgaatattccaatctttaaaaatacacaaatcttgggacacacatattttacacatttttgtggtagcagatattttaaaaggaattaccaatagtggaaaagaaaggaggaattagctggaggttaacaagttaaaaacaaaaatggtaaccatggaaagccaaaaggtaatatttaattttatttactgtatatgatcacgaaaaaaactgcatttaagttactagctttttatatttcagtcacatatgcaaagattatttaaattaaatagaataagtcccagtattgggaggactggaaccttgtcaaatatgaataacgtacaagctttaaaaggatatctatctttttaatttttatttacttttttttaggtttttttttttttttttttaagagacggggtttcactatgttgcccaggctggtctcaaactcctgagctcaaacaatctgcctgcctcagcctcccaaagtgctgggattacaggcgtgagccaccacgcctggcccaaaaggatatctatctttaaaaggattgtcaatctattttaaaatatgcttagccacatgccctgatctcttacctgtgcctctctaaatacatatggtcctaactccttccggtgttcaataatcttctgggcttgctctactggaatgtcaatttgtaaagctggtggaatactggaattaataaagcagttgataatagttgtaatcttcttctggatgacagactcatcacaatgagaatggcacaagtcctgaacagaaggaaagatagaatggtatataattaatgcattaccagaacacttaatagaactgtatcaatatgtgtttcaattaatatatgcatttcaactttaggtcaagaaggcagtgggatatttcaaggctgtctttaaaaaattacagattttctttctcttggatttgaggaacctaagactttgatacatctacattacataaatacagatttcatataatcctgatcacttattcctctaggcaaaggaatgacattagtatctactttgactcatttaacaaccgtataatgagggcctgttatataccagacactgagctgagcctcaagacacaggccctacccttttaaggttcaatctccactggaggagaagtgtgagaacatgttgctcctattttggatagttaataaatgttatgatagaggtatacatagtatcctaggagaacattgagaataggcacctaactccacctacaggtggatataaaagctttcccgtccagtcctgcttctacgccaaggtgatttaggctcaaaaaggtactgggcatgctggttgtcaacaggtgtgccattctatatcttttattatctatgttgtgtagttaccctattgtattatcctctttatagataacctaaaattaatgatcacacattaaaatgagccacttaaaaaattgtcaacatttattttagacacgggggtacatgtgcaagtttgttgtatgggaatattacgtgatgctgaggtttggggtacagatcctgtcacttaggtagagcgtagtacccaacaggtaggttttcaacccaccctcccctcactacctgttctagtagtcagcagtgtctattattcccatatttatgtccatgtgtgcccaatgttgagctcccacttataagtgagaacgtgtggattttggttttcttttcctgcattaattctcttaggataatggcctccagctccacccacactgctgcaaaggacatgatttcatttttttatggctatgtagtcttccacggtgtatatgtaccacattttctttatcaatctactactgatgggcacctgggttgattccatgtctttgctattgtgaatagtgcagtgatgaacatatgtgtacatttatctttttggcagaattatttattctccttggggtatacatccagtaatgggatggctgggtcaaatggtagctctgttttaatttctttgagaaatctccagactgctttccacagtggctggactaatttacattcccaccaatagtgtgcaagtgcccccttttctctgcagcctcaccaagcagctgttattttctgaccgtttaataatagccattctgattggtgtgagatggtatctcactgtggttttgatttgcatttctctgatgattagtgatgctgagcatttcttcatgtttcttggccatttatataccttttgagaagtatccgttcatgtcctttgcccaaaatgagctagttttaaagtcacaggtgtaggactatcattttttaaaataaagaggtagtttagctcaaattatggcatttctctgtcaaagtcattattttccaaatcatcagaaagcaaatttggaaacttctcactttaggcccagaaatgaaccaacatttattaagtacccagtatatgctgggcattgtaatagctctactatggatattacaaaagaaacaaaaattctgatgtctttcatgtaaaactttatatataatttggtataagttaagtgtgaaaaaagcttaatataatgttacattgtgacaattagcacttcatactcaatttagcatcaccttagaataaagcctatttaggccaggtgtggtggcttatgcctgtaatcccaacaatttgggaggccgaggtgggcagatggcttgagcccaggagtttgagaccatcctgggcaacatggtgaaactctgtctctacaaaaatatacaaaatattagctgggtgtggtggtgcatgcctgtagtcccagctactggggaggcttaggtgtgaggatcacctgagcccagggaggttgacgctgcagtgggccattatcacaccactgcactccagcctgggcaacagagtaagatggtgtctcaaaaaaagaaaagaaaagaaaaagcctattttatattattcaattagcctcctaactatggaatataaggcttgtgaaataaaacaaatttgtgaagtatacaattataattttgagtaaaaggacagcatttggtcagaattataactgattttttttttctaattgttctgccctgttgtgccattagcttagttaactcttgcctattattaaggtctgagtttaagcatactttcctctagtaagctttctgtgactctcagtccaggagagatgtccatctcaggtactcccatagcacactgtgcttcttcccttgttgcactaatcacactcttataattgccttgtctaccactcatttgtccttcttctgatactatatgctctaacagggtagactgttttgatcacagttgtatcctcaggatttggcctgccccttggtaggtgcctaataaatatttgttggataaataaatccttccagtctttacggacacacacacacacacacacacacacacacacacactttagattaaaccatactgatttttagtagctagtttttaaaaaagatcaatgagcagaacatcttttcccatcattgattattctcctggaacatttttaacggctagagaatcttctactatatagatatatcgtaatttagtaaccaacgtccttgttgtacaactgggttctttccaacttttcacaatcccgagtaatgtttgactaagattactccagccatctctttgtatattaccacaatcaatactgagaagcagcacagcttagtggttaagggcatgggctttagcaatagaatgacctgattcaaagtctagctctaccagttaattagctgtgtgatgtcgggaatttcttggcctttctgtgcattagtttcatctgtgaagtgatgagaatcacatccttgacctcatgggattcttgtgagaataaattcattattacatgaaaagcactaagacaatatctggcacatagtaaacacttaataagagtaagccctataagagttagctcggttagactttatcaaagtggaataaatgccttccaactggcaaactccctcatggcccaatgcaagtgtcatcactcttgctgagacctccctgacctattgtccccataccccatcattctctcctctgtgccaaaaccatacctagtcagaacatgcatcagaatcaacattatttcctaatatttgttctcatggatgtcttcctgcctgaaagagggcagtgtgttgtattcacctttttacgcctacaatttagcataataacatttgatacttaataaatgtttgttatatgaacaaatttactcctatagcatgctttttaatagctacctagtattgtaagtctgtcatgctatattgtagaaaagatattaaaatggagaccaagggcagccttaaaggagaaagtcataaaactaagggttcactgtgtataagtctatagttggtttttaaaatacctattttacaaagtttatctcattacctcttgtcctagcaaagttagacttgttcatattcatattagcttaaagatagttccacccacccatgataaaaaaattatctattgtggaaaacacactctacctcctttctaatctcaaaaaaattattttaatattgctcatgtgaaagattgtgaaaaaacttctctcaaattttttttttaccagcctgggcatcatagggagaccccatctctacaaaaaaattaaaaattagccaggcatggtggtgcatgcctgtactcccagctacttgggaggctgaggtgggaagatcgcttgagcccagcaggtcaaggctgcagtgagctgtcattgtgctactgtactccagcctgggcaacaaaatgagaccctgtctcaaaaaaaaattgttttttaatattatagtctcagctgagaatagtacaaaaactgttgataacagaaaagggtagaaaacaattttactgtatgttggaaaagcttggaaataaattttattgagcaactactaactgtatgttgagcaactgtattagtgtcatataatatatagttataggccatttgaaagcattatgctcctaaattgttaatttttattcctcatgtttacaatgggatggaatagactgcttgcaaggaaatgagcctgctacctctgggagcatttaagcaaagactgaaatacctttcagtatttctatacaacatttctttattcaagtctagacaacataacatggaaagtcccttcctcctcttcaatgcaaagattctgtatgattacattaaacacttaaccctgaaaataaactgtctttgtacctagccatttctcttttacttattttgttaagaatttggctattctttttcatctctaattctttctaattcttttctcttctctgttggtttatttatccataatccagtatctttgattactattactataaatatggctgggagggattcttacaaagagatcttggttgtatggatacaccaaatatagacattgttaggaaaaaaatatgtacagtacatttaagagataattgatgtgtagaaatatagttaaaactctctgcaggaaggttctcattaaatcttatgtatgttaatacctgaaaaaaaacctaatacaggttgagtatcccttatctgaaatgcttaggaccagaagtgttttagattttggattcttttttggttttggaatatttgtattatacctactggttgagcattccaaacccaaaaatccaaaacctgaaatactccaaggagcatttactttaagtatcatgttggcactcaaaaagtttcagattttggagcatttcaggtttcagattttcagacttggaatgcccaacctgtgttatcattccagggctcactcttactcttcactgtataataataaatgtatctagagattggacaataaacatctcaatatttatatactggtaggaagaagatagcaaaattgggatatcttatacaaatcttgtgcataaagttagttaaaaatctgacattttaatgcatttcctcctcaaaacaggtggttttctctagctcccaatacaataccttatatttttgtacttcttgccaaaagagtaaaccattttccaataaatctccttttagagccacaaaacgttgaaattgtcttgaagtaactggattcaataatgctttgcgaaaagcaatgattttacaagatgaagagatccacttactctccacaggctgtccaaagcagagaatataggaaattagctcattaattaggctaacaattaccaacttctatctcctaaaattttgcctgttgaaatgcctggcatggctataatagaatttcacaacattttcacctattcctttctcttttgtctcctttatatttttatggcttcatttttaggaggtagagtgaaaaagaaatgactagatgatttagaccgtatgactacaatgtttaaaaatgttaacagttattacagcttgagattatggtgaaaaactactttttagtgcattgtatgagttctgtgcttaaacagaacaaagtaatcataatgttatgattatatgttattacattatttattttattattacatgttatatattaatatataattctcctgccttttaaaaagtaaaagtagttaaacatttaatatttctcatttttaagaaaaaattatcaattgattctataagttaaataatttactatagagcttcactataattttatcctgaaaatattatatttttagatgagacatctttatgttatttttaataaattatgatttaaaataatgataacaaataatgattattaataaattattttaataaaattcctttgactgatggtttactttacataacataaaagctagaagcacccatggcattttagtaacacctaaaggtatttttatcaacatttattttatatctttacaatttggaaatataaaatatctactttttaaaattttgcccatttaaaatcacatattcaaccccatttagcctttcagattgaaaacataagaaatcgattttattgaattcactaaatagattttaatatttaagtttcccaaagctgatttttagcttacaaccatgcaaggaagtatcattccaaagacaatgatttagatggatttagcaacacataaaataaattccttgaaacaaatatgtgaccatcaatttaagtgtttagagagttatatttttaaaaagtgccatggtaacacaaaggaaggagtaactaattctgcctggaggagtaaaacctttacagagaagggccttgaggatgacatctgagttggaaactgaaaagtgaaggcaactccaggcagtctagatgaatggtggtgccattaacccggataaagtgaatagatgtccatcactattttagtgagacacatgtcatgttctgtggacaaaaagttaagacccccaccatatggtccatattaaaattatagccctacaaataggaacaactatgtattagactgggacgtttatttaaaacccactcagcaaataatattttaagatctgcttaagatactaaaacttagaaatttaaaacctgtaatttaaacaaaataataaaatatatgtaataattatataaaaataattccattctatgtaattttcaatcaaaattatagcaaaaaacaaacattaaaaaagtttctttcttttcaagaggaaaatacacaaaagagcatattaacagttacatacattcctccaatattcaaataaacatctatttttgttagttagcagagggtcacctaggtctagttggacattttattaggacctgcagaaggataaatacacataaaacttataagctcaaaaggaagactacgtttatcatgcttgttacaaagtaaaataggccatttctagccaggtattatattgtagtggttttaagtcaccaaaatgatagttatcttaattcttttaaagctaaaattctatctttttgcttttaatatttttatttctatttcaatttgatttgattttttatgtatgctcctgctcggcaaagtgcccttgtaaggatgcctgagagcagcgtacagttatgattaaaatgcagttctaaatagaagggataatgtgccaggtgtgttggctcacgcctgtaatcctagcagtttgggaggcctagacaggtggattgcctgagctcaggagttcaagaccagcctggggaacatggcaaaaccccatctacaccaaaattgcaaaaaataagccaggtgtggtggtgcgtgcctgtaatcccaactactggggagtttgaggcacgagacttgcttgaacctgggaggcagaggttgcagtgagttgagattgtcccactttattccagcctgagcgacagagcgagactctgtctctagatagatagacagacagatagatagatagatagatagatagatagatagatagatagatatagatagatagatagacagatagacagacagataaatgaaagtcataatgtaagacgatttaacctgctgattctgctgcatgctactcatttgttgagtaatttactctcaataataaactgtcatatgttggaatgcacagcttgtctcagtaaatccatgacatgcagaataaagaaaaatacatacttaaggcaatcacacacttctaaggttgagcaggtcaaggatttctttaagaatagagctccttattcaggaggcgaaggcaggaggatcactggagcccaggagttagatgtgataatgagctatgatcatactactgcacggtagcctgggcaacagagcaagaccctaataataaaaaataattttttaaaaaagaacagagttctgaattccaagggccgatgggaagcctctagcaggggactctggccttgcagaaggaccctgtttcccatttcttccccctgccttttcacccaataaaacccagctttattcaccctttaagccatctccaagcctaaattttcctggccgtgggatggacaagaacccagtctttagctgaacgaaggaaaagtcctgcaacattcttggcatgcaacgtgggggctcttgaagagatgtatcagaattccacaatgcatatggttcttgggcaagtcactgaaacgtgggtcagatgttgaaagctgctgtactatgatgtgaaaataaagcccaccgcagctcaacaaggcctactgcctctagactccatctctgtgggcagggcataactgaacaaaaggcagcagacaacttctgcagacttaaacgtctgaagagagcagtggttctcccagcacggcatttgagctctgagaacggacagactgcctcctcaagtgggtccctgacccccatgtagcctaactgggagacacctcccagtaggggctgacagacacctcatataggcagctacccctctgggacgaagcttccagaggaaggatcaggcagcaatatttgctgttctgcagcctccgctggtgatacccaggcaaagagggtctggagtggagctccaacaaactccaacagacctgcagctgaggaacctgactgttagaaggaaaactaacaaacagaaaggaacagcatcaacatcaacaaaaaggtcatctacaccaaaaccccatctgtaggttaccaacatcaaagaccaaaggtagataaaaccacaaagatggggagaaaccagagcagaaaagctgaaaattctaaaaatcacagcacctcttctcctccaaaggatcgcagctcctcaccagcaacggaataaagcaggatggacaatgactttgacaagctgacagaagtaggcttcagaaggttggtaataacaaatttctctgagctaaaggaggatgttggaacccatcgcaaggaagctaaaaaccttgaaaaaagattagatgaatggctaactagaataaacagtgtagagaagatcttaaatgacctgatggagctgaaaaccatggcacgagaacttcgcgacgcatgcacaagcttcaatagccaattcgatcaaatggaagaagggtatcagtgattaaagatcaaattaatgaaataaagcaagaagacaaggttagagaaaaaagagtaaaaagaaacgaacaaagcctccaagaaatatgggactatgtgaaaagaccaaatctacatttttgattggtgtacctgaaagtgatggggagaatggaaccaagttggaaaacactcttcaggatattatccaggagaacttccccaacccagtaaggcaggccaacattcaaattcaggaaatacagaatacaccagaaagatactcctcgagaagagcaaccccaagatataattgtcagattcacaaaagttgaaatgaaggaaaaagtgttaagggcagccagagagaaatgtcgagttacccacaaagggaggcccatcagactaacagcagatctcttggcagaaaccctacaagccataaaagagtgggggccaatattcaacatcctcagagaaaagaattttcaactcagaatttcatatccagccaaactaagcttcataagtgaaggagaaataaaatcctttacagacaagcaaatgctgagagattttgtcaccaccaagcctgcctgacaagagctcctgaagggagcactaaacatggaaagaaacaaccagtaccagccagcacaaaaacatgccaaaagtaaagaccattaatgctatgaagaaactggcatcaattaacaggcaaaataaccagtgaccatcataatgacaggatcaaattcatatctaacaatattaaccttaaatgtaaacaggctaaatgccgcaattaaaagacacaaactggcaaattggataaagagtcaagacccatcagtgtgctgtattcaggagacccatctcacatgcaaagacacacataggttaaaaataaagggatggatgaagatctatcaagcaaatgtaaagcaaaaaaaagcagggtttgcaatcctagtctctgataaaacagactttaaaccaacaaagatcaaaatagacaaagaaggccgttacataatgctaaagggatcaattcaacaagaagagctaactatcctaaatatatatgcacccaatacaggagcacccagattcataaagcaagtccttagagacctatgaagagacttagactcccacacaataataatgggagactttaacaccccgctatgaatattagagaggtcaatgagacagaaaattaacaaggatatccagacctgaactcagctctgcaacaagcagacctaatagatatctacagaactcttcactccaaatcaacagaatatacattcttctcagcaccacatcacatttattctaaaattaaccacataattggaagtaaagcactcctcagcaaatgtgaaagaacagaaatcacaacaaactgtctcttggaccacagtgcaatcaaattagaactcaggagtaagaaactcactcaaaaccacacaactacatggaaactgaacaacttgctcctgaatgactactgggtaaataacgaaatgaaggcagaaataaagatgatctttgaaaccaatgagaacaaagacacaatgtaccagaacctctgggacacatttaaagcagtgtgtagagggaaatttatagcactaaatgcccacaagagaaatcaggaaagatctaaaatcgacaccctaacatcacaattaaaagaactagagaagcaagagcaaacaaattcaaaagctagcagaaggcaagaaacaactaagatcagagcagaactgaaagagatagagacacaaaaaacccttcaaaaaaatcaatgaatccaggagctagtttgttgaaaagatcaacaaaattgatagactgctagcaagactaacaaagaaaagagagaagagtcaaatagatgaaataaaaaatgataaagtggatatcatcactgatcccacagaaatacaaaccaccatgagagaatactataaacaactctatgcagatgaactaggaaatctagaagaaatgaataagttcctggacacatacactctcccaagactaaaccaggaagaagttgaatctctgaatagaccaaaaacaggctctgaaattgaggcaataattaatagcctaccaaccaaaaaaagtccaggacaagatggattcacagccgaattctaccagaggtacaaagaggagttggtaccattccttccgaaactattccaatcaatagaaaaagagggaatccttcctaactcgttttatgaggccaacgtcatcctgataccaaagcctggcagacacacaacgaaaaaagagaattttagaccaatatccccgacaaacatcgatgcgaaaatcctcaacaaaatactggcaaatcaaatccagtagcacatcaaaaagcttatccaccacgatcaagtctgcttcatccctgggatgcaaggctggttcaacaaatgcaaatcaataaatgtaatccatcacataaacagaaacaatcacaaaaaccagatgattatctcaatagatgcagaaaaggccttcaacaaattcagcaacccttcatgctaaaaactctcaataaactaggtattgatggaacatatctcaaaataataagagctgtttatgacaaacccacagccaatatcatactgaatgggcaaaaactggaagcattccctttgaaaatcggcacaagacaaggatgccctctctcaccactcctattcaatgtagtgttggaagttctgaccagggcaatcaggcaagagaaagaaataaagggtattcaagtaggaaaagaggaagtcaaattgtccctgtttgcagatgacatgattgtatatttagaaaaccccgtcatctcagcccaaaatctccttaagctgataagcaacttcagcaaagtctcaggacacaaaatcaattgcaaaaatcacaagcattcctatgcaatattaacagacaaacagagcaccaaatcgtgagtgaattcccattcacaattgctacacagagaataaaatacctaggactccaactgacaagggatatgaaggacctcttcaaggagaaatacaaaccactgctcaacgaataaaagaggacacaaacaaatggaagaactttccatgctcatggataggaggaatcaatattgtgaaaatggccatactgcccaaagtaatttatagattcaatgccatccccatcaagctaccaatgactttcttcacagaattagaaaaaaaactactttaaagtgcatacggaaccaaaaaagagcctgcatttccaagacaatcctaagcaaaaagaacaaagctggaggcatcacgctacctgacttcaaactacattgcaagtctatagtaaccaaaacagcatggtactggtaccaaaatagagatatagaccaatggaacagaacagaggcctcagaaataacaccacacatctacaaccatctgatctttgacaaacctgacaaaaacaagaaatggggaaacgattccctatttaataaatggtgctgggaaaactggctagccatatgtagaaagctgaaactcaatcccttccttacaccttatacaaaaattaattcaagatggattaaagacttaaatgttagacctaaaaccataaaaaccctagaagaaaacctaggcaataccattcaggacataggcatgggcaaggacttcatgactaaaacaccaaaagcaatggcaacaaaagccaaaatagacaaacgggatctaattaaactaatgagtttctgcacagcaaaagaaactaccatcagagtgaacaggcaacctacaaaatgggagaaaatttttgcaatctatccatctgacaaagggttaatatccagaatctacgaagagctcaaacaaatttacaagaaaaaaacaaccccatcaaaaagtgggcgaaggatatgagcagacacttctcaaaacaagacatctatgcagccaacagacatgaaaatatgctcatcatcactggtcatcagagaaatgcaaatcaaaaccacaatgagataccatctcacgccagctggaatggcaattattaaaaagtcaggaaacaacagatgctggagaggatgtggagaaaaaggaatgcttttacaccgttggtgagagtgtaaattggttaaaccattgtggaagacagtgtggcgattcctcaaggatctagaactagaattaccatttgactcagcaatcccattactgggtatataccgaaagtattataaatcatgctgctataaagacacatgcacacgtatgtttattgcagcactattcacaatagcaaagacttggaactaacccaaatgtccataaatgatagactggattaagaaaatgtggcacatatacaccatggaatactatgcagccataaaaaaggatgagttcatgtccttcgcagggacatggatgaagctggaaaccatcattctcagcaaactatcacaaggacagaaaaccaaacactgcatgttatcactcataggtaggaattgaacaacgggatcacttggacacagggcggggaacaccacacactggggcctgttggggggtggggggctgggggaggggtaacattaggagaaataactaatgtaaatgatgagttgatgggtgcagcaaaccaacatggcacatgtatacctatgtatcaaacgtacacgttgtgcacatgtaccctagaacttaaagtatgtatataaaaaaagaacagagttctgatagagtcacattttcctccaaattccattcatcaattaaaaacagtatcagtgctcagttgtcagtttagaaaacagtgtgtcctcagtgaggatttttgaacaagaaagggaaagaaaaacaatactttgacagagcaaaacttacaagaggaagaatataacaaacattacttgccttccagaccccgattttcttttcagccttctgtagtaagagctcttctgctatgtctttcatctgtacctgaaagcaaaaccaattattttatcccagttattcagactaaaggcttgaaatcatttactaattaagtagctaaaaaaatgagataaaggttaacttggacaagagatagtgaagtttaggagaaagaggatcaaacttaaaaatggaagccctgtggtcaggtaccaaatttttctgaacactctaacctcatctgtaaaatagagataatactacccgattgttattgccccaaatgatgatagtttcacttgagctcacatgggaactgaagctggaaagacaattacgacttctcagactttttagctattttctagccatatactttcacaactaattttaaaagagtactaaaagttactcaacatggaaatacagtagatatttcttggggttattgcctattcatatcatttcccctttcttgggaaccgctcataacaaacctgtgctattgactctatctccctgtccatagcagatagatccagaagcagatctagagagataaggactagaatcactggggctaagtctttttgatagagccaggaggaaagatctgagaattcttgctgggttcctagggctgtcctggcctacatcttttctaaagctt

SEQ ID NO: 102 - protein, 205 aa, Homo sapiens
MCKGLAGLPASCLRSAKDMKHRLGFLLQKSDSCEHNSSHNKKDKVVICQRVSQEEVKKWAESLENLISHECGLAAFKAFLKSEYSEENIDFWISCEEYKKIKSPSKLSPKAKKIYNEFISVQATKEVNLDSCTREETSRNMLEPTITCFDEAQKKIFNLMEKDSYRRFLKSRFYLDLVNPSSCGAEKQKGAKSSADCASLVPQCA

SEQ ID NO: 103 - DNA, 1896 bp, Homo sapiens
gcagggccgcgcacgcactgacggctgaccgccatcttccctcccgaggcggcagttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaagtattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcagggtgtacaaatgaatgtggagacctttgtaccctgacatggaaagatttccgagacagatgcgtacatgaaaaccgggaagacacaggacagtatgtagaagaaccggcttttcctataagaaggatggaaaaaataggaatatatattcatattgcataaagaaacttggaagcatatacaagaaactcatgaaagtgaacactcgtgtctgaatatgccgaggaagctggggctggagcagaagtgctcttctgagtacactatttttatatcacttttaagttttggattaggtgaatgacttaatattttaaaattggttaagtaataaatgaattgccagcccaaaaaaaaaaaaaaaaaaaaaaaaaaaaaa

SEQ ID NO: 104 - protein, 1371 aa, Homo sapiens
AGCGGLARLSVPCWRIWPQRAAKIAGPGRKRRSPDPDAVADPGALWLSTKRLKMSGGASATGPRRGPPGLEDTTSKKKQKDRANQESKDGDPRKETGSRYVAQAGLEPLASGDPSASASHAAGITGSRHRTRLFFPSSSGSASTPQEEQTKEGACEDPHDLLATPTPELLLDWRQSAEEVIVKLRVGVGPLQLEDVDAAFTDTDCVVRFAGGQQWGGVFYAEIKSSCAKVQTRKGSLLHLTLPKKVPMLTWPSLLVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQASRIWQELEAEEEPVPEGSGPLGPWGPQDWVGPLPRGPTTPDEGCLRYFVLGTVAALVALVLNVFYPLVSQSRWR

SEQ ID NO: 105 - protein, 199 aa, Homo sapiens
MPNYKLTYFNMRGRAEIIRYIFAYLDIQYEDHRIEQADWPEIKSTLPFGKIPILEVDGLTLHQSLAIARYLTKNTDLAGNTEMEQCHVDAIVDTLDDFMSCFPWAEKKQDVKEQMFNELLTYNAPHLMQDLDTYLGGREWLIGNSVTWADFYWEICSTTLLVFKPDLLDNHPRLVTLRKKVQAIPAVANWIKRRPQTKL

SEQ ID NO: 106 - DNA, 85579 bp, Homo sapiens
aagcttccagaggaaggatcagacagcaatattttctgttccacaatatttgctgttctgcagcctccactggtgatacccaggcaaacagggtctggagtggacccctaacaaactccaacagacctgcagctgagggaactgactattaaaaggaaaactaacaaatggaaaggaatagcatcaacatcaacaaaaaggacatccacaccaaaaccccatctgtaggtcaccatcatcaaagagtaaaggtagataaaaccacaaagatggggagaaaccagagcagaaaacctgaaaattctaaaaaccagggtgcctcttctcctccacaggatcgcagctcctcaccagcaatggaacaaagctggatggagaatgactttgatgagttgacagaagtaggcttcagaaggtcgttaataacaaacttctctgaactaacccatctcagagaatgttctaaccgatcgcaaggaagttcaaaaccttgaaaaaaggttagacaaatggctaactaaaataaacagtgtagagaagtccttaaatgacctgatggagctgaaaacgagaacttcatgatgcatgaacaagcttcaatagctgattcgatcaagtggaagaaaggatatcagtgattgaagatcaaattaatgaattaaagcaagaagacaagattagagaaaaaagagtaaaaagaaaagaacaaagcctccaagaaatatgggactatgtgaacagaccaaatctacatttgattgatgtacgtgaaagtgatgaggagaatggaaacaagttagaaaacactcttcaggatattatctgggagaacttccccaacctagagaggcaggccaacattcaaattcaggaaatatagagaacaccacaaagacattacttgagaagagcgaccccaaggcacataattgtcagattcgtcaaagtagaaatgaagaaaaaaatgctaaaggcagctagagagaaaggtcgggttactcacaaaggaaagcccctcagactaacagcggatctcttagcagaaaccctacaagccagaagagagtgggggccaatattcaacactcttaaagaaaagaattttcaacccaggatttcatatccagccaaactaagcttcaaaagtgaaggagaaatataatcctttacagacaagcaaatgctgagaaattttgtcaccaccaggcttgccttatgagagctcctgaaggaagcactaaacatggaaagtaacaaccagtaacagccactgcaaaaacatgcaaattgtaaacaccatcgatgccatgaagaaactgcatcaattaatgggcaaaataaccagctaacatcataatgacaggatcaaattcacacataaaaatattaagcttaaatgtaaatgccccaattaaaagacacagactggcaaatcggttaaagagtcaagacccgtaagtgtgctgtattcaggagacccagctcacatgcagagacacacaaaggctcaaaataaagggatggaggaagatctaccaagcaaatggaaagcaaaaaaagcaggggttgcaatcttagtctctgataaaacatactttaaaccaacaaagatcaaaagagacaaagaacaccattacataatggtaaaggaatcaatacaaaaagaagaactaactatcctaaatatatatgcacccaatacaggagcacccagattcataaagcaagtccttagagacctacaaagaaacttacactcccacacaataataatgggagactttaacaccccactgtcaatattacacagatcaacgagacaggaggttaacaaggatatccaggatttgaactccgctctgcaccaagctgacctaatggaaatctacagaactctccgccccaaatcaacagaatatacattcttctcagcaccacatcacactttattctcaagttgaccacgtagttggaagtaaagcactcctcagcaaatgtaaaagaacagaaatcacaacaaacagtctctcagatcacagtgcaatcaaattagaactcaggattaagaaattctctcaaaaccacacaactacatggaaattgaacaacctgctcctgaatgaccagtgagtaaataatgaaatgaaggcagaaataaagatgctttttgaaaccaatgagaaaaaagatacaatgtaccagaatctctgggacacagttgaagcagtgtgtagagggcaatttataccactaaatgcccacaagagaaagcaggaaagatctaaaatcgacatcctaacatcacaacgaaaagaactagagaagcaagagcaaacaaattcaaaagctagcagaaggcaagaaataactaagataagagtagaactgaaggagatagagacagaaaaaacccttcaaaaaatcaatgaatccaggagctggttttttgaaaagatcaacaaaattgatagaccgctagcaagactaataaagaagaaaagagagaagaatcaaatagacgcaataaaaaatgatataggggatatcaccaccgatcccagagaaatacaaactaccatcacagagtactattaacacctctctgcaaataaactagaaaacctagaagaaatggataaattcctggacacaaacaccccccaagagtaaacctggaagatgctgaatctctgagtagaccaataacagtctctgaaattgaggcaataattaataacctaccaaccaaaaaaagtccatgaccacacagattcacagtggatttctactgcaggtacaaagaggagctggtaccattccttctgaaactattccaatcagtagaaaaaggggcaatcctccctaactcattttatgaggccagcatcatcctgataccaaagcctggcagagacacaacaaaaaaaaagaattttagaccaatatccctgatgaacatcaatgcgaaaatcctcaataaaatactggcacaccgaatccagcagcacatcaaaaagcttatccaccatgatcaagtgggcttcatccctgggatgtaaggctggttcaacatatgcaaatcaataaatgtaatccatcacgtaaacagaaccaacgacaaaaaccacatgattatctcaatagatgcagaaaaggcctttgacaaaattcaacaacccttcatgctaaaaactctcaataaactaggtattgatggaatgtatctcaaaataataagagctatttatgacaaacccacagccaagatcatactgaatgggcaaaaactggaagcattccctttcaaaactggcacgaaacagggatgccctttctcatcactcctattcaacattgtgttggaacttctggccagggcaagcaggcaagagaaagaaataaagggtatttgattaggaaaagaagaagtcaaattgtccctgtttgcagatgacatgattgtatatttagaaaaccccaaaatctccttaagctgataagcaacttcagcagtctcaggatacaaaatcaatgtgcaaaaatcataagcgttcttatagagcaataacagagaaacagagagccaaatcatgaatgtgctcccattcacaattacgataaagaaaataaaatacctaggaatccaacttacaaggaatttgaaggacctcttcaaggagaactacaaaccactgctcgatgaaataaaagaggacacaaacaaatggaagaatattctatgctcatagataggaagaatcaatcttgtgaaaatggccatactgcccaaggtaatttatagattcagtgccatcgccatcaagttaccaatgactttcttcacagtattggaaaaaacgtctttaaagttcatatggagccaaaaaagagcccacattgccaagacattcctaagcaaaaagaacaaagctggaggcatcatgctacctgacttcaaactatactacaaggctacagtaatcaaaacagcatggtactggtaccaaaatagatatatagaccaatggaacagaacagaggcctaagaaataacaccacacatctacaaccatctgatatttgataaacctgacaaaaacaagaaatggagaaagcattccctatttaataaatgatgctgggaaaactggctagccatatgtagaaagctcaaactggatcccttccttacaccttatacaaaaattaattcaagatggattaaagacttacatgttagacctaaaaccataaaaaccctagaagaaaacctaggcaatatcattgaggactaggcatgggcaaagacttcatgaccaaaactccaaaagcaatggcaacaaaagccaaaatagacaaatgggtctagttaatctaaagagcttctgcacagcaaaagaaactaccatcagagtggcaggcaacctatggaatgggagaaaatttttgcaatctactcatctgacaaagggctaatatccagaatctacaaagaacttaaacaaatttacaggaaaaaaacaaacaatcccatcaaaaagtggacaaaggatttgaaaagacacttctctaaagaagacatttatgcagccaagagacacatgaaaaaatgctcatcatcactggccatcagagaaatgcaaatcaaaaccacaatgagataccatctcacaccagttagaatggcaatcattaaaaagtcaggaaacaacagatgccggagaggatgtggagaaataggaatgtttttacactgttggtggcagtgtaaattagttcaaccattttgtagaagacagtgtggggattcctcaaggatctagaactaggaataccatttgacgcagccatcccattactgggtatatacccaaagggttataaatcatgctactataaagacacatgcacacgtatgtttactggggcaccattcacaatagcaaagacttggagccaacccaaatgtccatcaatgatagactggataaagaaaatgtggcacatatacaccatggaatactatgcagccatcaaaatgatgagttcaagtctttttcagggaaatggatgcggctggaaaccatcattctcagcaaactatcacaaggacggaaaaccaaacactgcgtgttctcactcataggtgggaattgaacaataagaacacatggacacagggtggggaacatcacacactggtgcctgcagcggggttgtggggagtgctgggggtatgggggagggatagcattaggagaaatacctaatgtaaatgacgagttgatggttgcagcaaaccaacatggcacatgtatacctatgtaacaaacctgcacgttgtgcacatgtaccctagaacttaaagtataataaaaaagaaaaaaaaggaaaatgtaagtcagatcatgtcactcctctactcagtacatttcagtggattctttttcactcagggtgaaaatgaaagcctttgcaaagtcctaaaaggtccttcagaatctgattgcttctcctattccccatcgcttcttgccctgggctgacctatctgctgctcctcaaaccttccaggtactgcctttgctctaactgctgcctctggaagggtcttcccccagatgtttgtttggctaacaccttccatttcttaaagtctgtgctcaaattttgtgctgagccccctttttaccaataagaaccaattgttaaatattcaagaattttgtaagctatttttcaaacctttggtagcttgaaattaaccagagcggaagtatttacaccacaggaaataaggcataccctgaaaatttcatttaaaattgtgatttttcacattctgcctctttaactcaattttttctgattccagtctactttttctttctctaatagcacatgccatctaataacttactgtttaatgtgcttatttattgcctttattatttattgactatctgcaagctctagagttcaaggttaactagggtaaggtttttgtttagtttactgatgtaactgaagatacaatatctaacacatggtaaggactcaataaatatgtatttattgaaaaataaaataaaaggtggttttattttttattgtactttaagttctgtgatacatgtgcagaacatgcaggtttgttacataggtatacatgtgccatggtggtttgctgcacccatcaacctgtcatctctgttttaagccctgcatgcattagctatttgttataatgctatccctccccttgcccccgacccctcgacaggccccagtgtgtgatgttcccctctctgtgtccatgtgttctcattgttcaactcacacttttgagtgagaacatgtggtgtttggttttctgttcctgggttagtttgcatagaatgatggtttgcagcttcatccatgtcgctgcaaaggaaatgaactcatcctttttgatggctgcatactattctatggtgtatacgtgccacatttcctttatccaatctatcattgataggcatttggtttggttccaagtctttgctattgtgaatagtgccacaataaacatacgtgtttattgttataatcctttgaatatatacacccagtaatgggattgctgggtcaaatggtatttctagttctagatccttgaggaattgccaaactctcttccacatggttgaactaatttacactcccatcaacagtataaatgtgtttctatttctccacatcctctccagcatctgttgttttctgactttttaatgattgccattctaactggcatgagatggtatttcattgtggttttgatttgtatttctctaatgaaaagtgatgatgagtttttttcatgtgtctgttggctgcataaatgtcttctttagagaagtgtctgttcatatcctttgcccactttttgatggggttgttggtttttttcttgtaaatttgaacaaggtgttttatcttcctgtgagataggaacaagtaaaacttataagtaactttcagtatttttatatcaatcactttaacttgttctttgaattgactaataatagactaaatggcaaagcaggggcagtgacttttcaaatttcaaataattttctctgaatgacaaaacaagttatctttagtaagaaatgtttaccaattgaatgtatatgaaagcagctgagaaatgttagagatggcttcataaaggagatattttgaataaaatttgatggatattttccattcttgcccaaatgctagacagcctacataacttaaatttcttttaagtgcttattccacaaacagaataatacacccagttcataaagcaatgatgcatggtgaagttaatttttgatagctatatgttatttttatatttacttttcaattaaggaaattgactttcaattgttagaaagcagttagctaccctgtctttgaccattccaaaattgtagagaatattagagttgaaataaagtaaattatttcatatttatatttttttttcattgctaagatttccataagcaaagattggactaaatttagtgttaactaccaacaatttcacttcgtggctactgaaaggaaaatgagtgtgtgtatacacatgtgtacacacacatatctggaaatcacatacttcattttaacaatctcttttttgaaattatatgtttaatttattgactgcccaaaacattcaccttcaatttgcctgggtattaccacttaacataggatttaggctgggcgtggtggctcacgcctatattgccagcactttgggaggctgaggtgggtggatcacctgaggtcaggcatttgagaccagcttggctcacatggcgaaaccccatctctactaaaaatagaaaattagccaggcgtggtggtgcacacctgtaatcctagctactcaggaggctgaggcagaagaatcgcttgaacctggaaggtggaggttgcagtgagccgagatcatgccactgcactccagcctgggcaacagagagaaacgctctctctcaaaaaaaaaaaaaaaaaaaaaaaaaaaaaaaaaaaaagtacgatttaattgacttctgactctcaatattcccaacaggtaagttagctttcaaatgacttcagcatgtaaacatgataaaaatatttgaaatttaatgagatggcaaaattcacacacgctaaaaaaagcggaccagaaacctccatatttattcaactgtttattgatcagatgttattaagatatcttatatactagtggaagtgtcttctctttgcaatgtgcttttaaatattgccttattggtttctcttgtacttgctagcaaaagtgtaaagtcattttcatgctgtgattcgagaaatgtcaaagcattaaattatagccacttaaaataattacatttctctagctacaaatgataaaataaacatctgaagtttggtgcatgtgctttgcttgtgttgacacactagtatcttctccaaggtgtggaaaccaataacagtttggaaattttaagcataatattaatattttccattataggaaacaatagtttatataaaccaaaagttttacacaaaagtaaatcaaatgggaagaagctcttttaaaaagacaaatctctacaaatgaaccttatacttatttccagtcactttaaaattcagtgaaatactagaggccttttaggaatcttaaatatgcttcccagaaaggtttcactttcttaacttttctaaatatagagaagctcccccagattgttatttccttggcttattacagttactatagagaaatattacagattaataaagtaaatcctggagtgtagaaggatttatacaaattagattgcacatgagaaataaatttgaaaatgtttttgtgataaagatactaaagctgtgaacgctcctataaatctaacatttacattttataatgattatgggacctcacttcaataagtctcatgcttacagaattctaacactccaagttctttttcaaattactcacagtcatttctgccaatgttaccatggactcatttcaaaattctaggtatttattgctctaaagtgtgtcataaaatgttaaatcaacctgctagcctgaggtctacaagatattttatgacttaaacagataccacacggttgcttgaagtcattgccctggcctttctttcctctgaatccaaaggcattgagtctagcacaaggcagtctaggtgacagagagcttgctggtacccagtagttgggtcagcaaaggtggtttgggagtttgtgatttttagtgtgataaatatatcaacaaaaattgtccagcaactgcacatattgtaggtcatgttttaaagcttttatcatttaaaatcatattctgctgcagatcaatgaaaacctatcatggatgaaaaattaagggttatttttcctttttttcccacctcataacatgaatgttgatgataggctgcccagggctgatgcaggtgctcaaccatagtgtcagagacccaagatctttttgcatcctttgtacactgccatgcttagtatattgtctttcactctcatccttgtcatttcttagtcacagcatggctgatgtagcaacaagcattatatctgcattccaggcaagaagaaagaaaaagaagcaaagatctacatgggccatatcttttctttttttttttaattgagaatgtaatgcctttctagaagctcactccagaagactttctgttatatcttttgggttaaaagtaactcacatgaccacttccagaccaataattgaccaaagacaattagataactacaatggtttataccaatggagctttgcttcctagcctatggtgagaactgaaagtctctgaaatcaaggtactgtaggcaccacctgaataatatctagcagcagggaaaggttattgaatgttgtgtaggcaatgaagagatattttcatatacaccattctgcctcattcctcttctctttttttttttttttttgacagtgctggcaattttatttaaaatctgatcaatttctttttttattttattattattatactttaagttttagggtccatgtgcacaatgtgcatgttagttacatatgtatacatgtgccatgctggtgtgctgcgcgcattaactcgtcatttagcattagatatatctcctaaagctatccctcccccctccccccaccccacaacagtccccagagtgtgatgttccccttcctgtgtccctgtgttctcattgttcaattcccatctatgagtgacaacatgtggtgtttggttttttgtccttggatagtttactgagaatgatgatttccaatttcatccatgtccctacaaaggacacgaactcatccttttttatggctgcatagtattccatggtgtatatgtgccatattttcttaatacagtctatcattgttggacatttgagttggttccaagtctttcctattgtgaatagtgccgcagtaaacatacgtgtgcatgtgtctttatagcagcatgatttataatcctttgggtatatacccagtaatgggattgctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactgttgtgagatggtatctcattgtggttttgatttgcatttctctgatggccagtgatggtgagcattttttcatgtgttctttggctacataaatgtcttcttcagagaagtgtctgttcatgtccttcgcccactttttgatggggttgtttgtttttttcttgtaaatttgtttgagttcattgtagattctggatattagccctttgtcagataagtaggttgcgaaaattttctcccattttgtaagttgcctgttcactctgatggtagtttcttttgctgtgcagaagctctttagtttaattagatcccgtttgtcaattttggcttttgttgccattgcttttggtgttttagacatgaagtccttgcccatacctatgtcctgaatggtaatgcctaggttttcttccagggtttttatggttttaggtctaacgtttaagtctttaatccaccttgaattaatttaattcttagctttagcaaatagcacacaaagccaaagtataaagtacagcagcaattgtctggcaacatgctttgactttcaccttcatttgctacctagtttttaggtataaatggttataaatgacatccagacttcttaatatgctgatttgtaagttagccttagtcccatgatataagtgaaggataatattcaagacttggctttgattcttagttttggcacttacaagctatgggactatttgagggatgttaactaaagttcaatattctaatttgtaaaataggagtactatcagttattgtggggatatatgccacagtgtggttgtacagattacaaagttgaattgcttagcatggagcgtgatattttccaagtgttcaataaatgtttgcagttaggattgttcattgtcattactattcctatgcccagggcttattgaaccactaaaaatgacctccacttatatttattgtgtagtatataaggtgggaggtgggggagaatccacagtgtgtccagtgcagaaattctagcctcaggataataactaaactttcagcatatatatataatagtttgtataaactatatgtatgtgtgtgtgtatatatatatatatatatatatatatataccctattttaataccctatttaccctattattcacatatcatgtgattacaaaccttagaatcaaaggaacacttctttctccaaaactggggacctcacaggaatcaagactgttccaggaatttttagaattcaagagagaagtgggttctgcttggatacttcatcaaggccattgcaatgtaatttcatttaaacttttaatgttaagccaaacttctacaaataaataagtttatatcagattctgagctattgtctattttaatattttaaattaattgtccaattttaataatagttttagacatccatgtttacatagagcagatctcaccctctgttcattaaaacaagtcacttattagattcatttttaactttactttgcaaaagttagcactgttgaccctgtcataaaatcaaatggcataaagtgacaatagatgtaaaatgtaaagaaatataaaattctttaaaaagcaaaagaaatcacattcgaagcacagagattcagagagccttgtagtgatttaaactgagtgacctaggatggtacaagcattactcatggctctgtcagtttctcttagcctctttttcaagtataataaaaataagcctcccagctgaacatgtctggtcatggggattttactcaataccaccaaaagatcactaagagggtagccttagacctccaaggccattatctaacaaactttattgaacacctactatgtaaacacagtgcaaaacttgttggaagtatttgattttgagtcttttttttttaagatagtattggaaattgctaagtaattgcctttttttctttgatgctaaaatgtaaaatctgttatagtttttctacaaattttccaagggattaaaaagggaaaacatttgaagctccagaatattctaagggtagaagatcgcttgctgggactttctctaaaacttgaaaaattaaattattacatgcggggaaatacatggaaatagtaggacagtgctctactatgttccttacttagcaaaaaatacacgtttatataaaatatgttcctctttctgttcactacagtgttcgtgtaatttctatgtcctctaactgaaaacctttcaatttaccatcgttctagatcagtttccagttcagaatccagttttttggtgtagttttagttgcatccattatgtcaagagaagttattgccactttattttctgtgtcatcgttcctcttcatccttagtttctctaaacccacaggttgcaaatcctttggggataaagagtgctgacaatttgggctaactctagtcaaaagttggtcttctaatccctcccatatccagcagttattgccttcccacccaataccctgagcaactccagtcaatctgtccacccatgcctgtccacaaccatgctttcttacctcctcttccattattgtgctgcaacattaaggttttttttctgatcagtgttaataaccaatgcctcaaatatctatcttttatgccaacatttggtagatttgagaacttgaagtcttaggggagcaggttggagaaagcttttcgtagcatcatgggctcttttctctttaggtaactcgagagcatatacagtggccctccaaagaccatttctacctttgccatccaacctggggaacaaataatccctatataatttgctaaattcttactgacctactcatcagctctagcttatttgttcttgtcttccatataaaaggttttataatttttttttctttttattgatttgctatagcttaagcaaaagttatccatacactagatacttagaaaatcattcagctataaaatagcagtaggataagtagtagcctggtagccaggttgtaatcccacttctaaaatctctaacaaaatagcaaagtcactatgcaagaaggatatgaattatctgtttcctagtcacattctaattgtgatcagctaccattattgcgttaatatacattgaataaagatattttataacatcagttctcacaaccagggctagactgacattgtaggcatcctaaattgattattgagggccacttcatgctgatttaaagtattaaactgtttaatttgatttatttaatttagtatttttggttttatttaatattttgattcaaatattttgaatatttccttaggagagtttaaggtaaaccaactttctattaattttgttctcataattggaaatataatacttggacagaatgcagtacaacattttaaattatttgagattgtatttattgcaaaaattttccattactgattatcatatagcatcagtcactcacacttactgaagatagagatcatgttttaatgttctttcccaccatcttgccacttctccaccccaaatttttttttttttttttgagacagagtctcgctctgtcacccaggctggagtgcagtggcataatctccgctcactgcaagctccacctcccaggttcacgtcattctcctgcctcagcctccccagtagctgggactacaggcacccaccaccatgcccagctaattttttgtatttttagtagagatggggtttcactgtgttagccaggatggtctcgatctcctgacctcatgatccgcccccatcggcctcccaaagtgctgggattacaggcatgaaccactgcacccaggctctccaccccaaatttcaacatattattccattttttgtcttcatttttttgtgtgtgattttcagaactaaataacttctttggataccaagtaaatggtttctatttatagatagaactttacatcacctgttctggtaatctgccctgtggctgccaacttcaggcaagtgtggctttgtaggtcccagggatcgagccctgcagttgcaccacataacctacacatgtctgtgacaaaacttttcaataaagtcaggctagtccagatgatgactgtgttttatttccactctggggtgctatctttttcagggaaatcagggctaattgaccttttgccagttatataaaaagtctcatgtggaaacctgagttagctggccccgttttccaatgatattttagtacattttacagttggcttccaaggcagcaacacagttagacttaccccacagacatagcatgattcagctcacaacaatcatagttatcaagttaacattccgaatagtacttccttctgaaggcaagaaaactccgctgtggcaactgccgagtgcagaagctatttgttaatgatgcccaagctaataggctatggtattatatctgtcatatactaatcagcagaggcttcacaatttcttagagccttgaaaaataagactatttcttttcagtctggtcagattttaatgaaaccagtcaataatccacatacttttttttcctatgtgaatagatgaatataaagaaagttttttttctacaaaaaatttttgtcggtgtagatgaacaggaaagacagagattccagtttctacttgaagcaaaattgttaatcatagtaaagggcaatgtgtaactcttccttttgaagattttcctacagtatcagtgtaaagtagttcgtacttagctcctgaagcactttcctgctttcccggtgagatgcttttctttgaaatgttcagttatctctaccatccacgttctgcttttacttactgctctgtggataaatgcgttttaatctaatgcatggcctttcctaacagtatttgtagttctccttgtaaagttaatgactttcctaatggtaaatacatgtttgctgtacgataaagcgggagatccatcagggcagagagctgaatggccctgatgatctagtgtaggaattgctttggcacacacagtcctatgtaacagtttatcagatgtgcctagcacattttcacagtaacctccaggggggacattgggtcagctaatcaaagtcccacatttgttccctgacctgtgaagtgagggctattatggtgggaaaaggcaagggggagccgctagaactgtgtctacctaggaagatagtaaactaagagcaatgccacattcctggggcattatagaaattggtaccaccatgaaggacttgaaagatgcagaggtggtgattccccctgcatcccctttcaattcacctctttggcctgtgcaaagcacaaatggatgttagagactgatagtaccatcagctcgaccaggtggtaactccaattgcagctgctgaaacatatggtttcattgcttgtggaaactgatacatcaatttatacctggtatgcagctattgatgtggcaaatgccttataagaataatcaggagttttcttctagctgaccagcaataaaccttcactgtcatacctcagggatatattaactctctagccctatgttataatttagattgtaggggttttgactgctttttccttctacatcacactggtccattatatttatgtaataacattatgctgattggaactagtgagaaatatataacaactactctacacttattggtaagaaatttgtgtgtcagagagtggcaaataaatttgacaaaaattcaagaggcagggaaattctgagggtccagtggtgtggggcatgtggagatatcccctctaaggtcaaggataatttgttcttatccttatcatatcctggccttatcttatcctggcctctcctgcaaccaaaaaggaggcacaatgcctagtggcccttttttgattttagaggaatatatttctcatttgggtgtgaaactctgacctatttacccaataacctcaatagctgctggttttgagctggggccagaacaagagaaggctctacagcaggtccaggttgctatgcaggctgctctgccacttgggctataagatccaacagatccaatggtactcacagtaccagtagcagacagggattttgtttggagtatttggaagacccctacaggttaattttcgtgcaggcccttaggattttgaagccgtgctcagccatcctctgcagataactacactccttttgagaaatagctcttggactgctactgggccttcgtacagactgaccacttaaccatggatcaccaagttaccatgtgccctacctgaacagctcattatgaactggatgttatctggcttgccaagccatcaagttgagtatgcacagcacacctcattatcaaacggaagtgatatttatatgattaggcttgagtagaccctgaaggcacagtaatttacaggaagaagtgattccaatgtccgtgttccccactcctactacactgtcttctcgctcagcttgcacccatggcctcaaggagcgtcctctgcaattgacagaggaagagagagtttgggcttagttaacagatggttctgcatgataggcaggcaccaacgaaaggcagttgcattacagcctcttactgggacatacttggaacataatgggggagtgaaattcttctagtgggcaaaacttcaagcagggaacctggttgtttactttgcttggaaggataaatgaccagacatatgattatatagcaattcataggctgtagccaatagccatgatgatcaggcaactggaaaaaacatggttagaaaattggtgacaaggaaattcggggaagagatatagataaacctctctgaatgggcaaaaactgtcaagatatttgtattccatgtgaatgcctaccaaagggtgacttcagccaagggagatttgaataatcaagggtacagaatgacttgttctatagataccagtcagcctctttccccagctactcttcttatcacccagtgggcttctgagcaaagtgaccatggtggtgagaatggaagttatgcatgagctcagcaaaatgggcttccactcttcaagggtgcctggccacctccactgttgaatgcccaatctgtcgtcagtggaggccaatgctgaattctctatgcaaccattttctggtggaaggttgattccactgagctacttccatcatagaaggggcagcattttattcttaccggaatagacgctctggacatagatttgccttcctgtcatgcagtgcttttggcaaaactctcttctgtggatttacagaatgccttgtgcagcaaagggcccatgctcgtgaaattcactggtcttaccaggtttattcttatcctgaagcaaatgcttgatagaaaagtggaacggcctttaggagactctcttacagtaacagttatgtggcaataccttgcagggctggaacaaggttctacataggattatacgttctgcatcaatgtccaatagaggagttatttctccatagccaggacttacaggtctaggaatcaagggtggaaatgggaatggcaccactcaaaattatccttagtgactgaccagcaaactttgtttctgtttcccttggtcttatgctctgctggcctagaggttttattcccaaaagaaagaatgcttccatcagaagacataataatgattccattgaactggaaattaagatggttacctgaccaatttgggattcttatgcttctgaatcaccaggaatgaagagaatcactttgctggctagggtgactaatcctgaatatcaagggaaagttggagtactactccacaatggaggtaagaacgagtatgtctggaatacaaaagaattcatagggagtctcttagtattaccaagccctgtgattaagatcgatgggaaactatagcaatccaggcagaagatttggatcacttcatcaggtaaagaattatgaccagctgagactcttgctgaaggcaagggaatgcagaatggatagtagaaggtagttataaacaccagctatgactacagaaccagttacagaaatgaggactgtaaatgtcataaatatttcctccttattttgttataaatatgcttagggcatgtgtgtgtatctatctatctatctatctgtctgtctgtctgtctgtctgtctatgtatctatctctatcaatacctcaaatatatttttcttccctctcttattcatttgtcatataacataagatacattgactttatatcatagtacagcaggttgtaaaatgaagtcattttgttaaacattgttttgttacaatgttaatgagaaaagaaataaaatcccagcaggggccactgtctgtgtggagttctcaagatttccccttgtctgcattgagttttctctggagactctggtttcctgccacatcccaaagatgtgcatattaggttaataggtgtgttcaaattgttccagtatgagtgagtgcgggtgtgtgtgtgagtgtaccttgtgatgaaatgacatcctgttcagtgttggttactgctttgttctttgagctgccagattaggctccagccacccacaaccctgaactggaatatgcaaattagaaagtgaatgaacacacgaatataaattattgtaaaataaacatttataatgtatatgataatcatactaatgcatgacaataaatgatgtggcacttaggcatgcagtgactttgccgtatttgctcttattggtttttaaactttatggtgggaggagatgctccttataattttcacttcatagacacttattccttcgtttaagccaccatcactatggccaccatcactcatggattcaccaaaaattggaaaaaataattatcttacttattttttaatattaatctttcttaaatgtatgatagctcacatttatttcagtgtttaagattaaaagtttttggggtcttagaaatttgatgatgtttttgtaatcagaaatttgccataggaacttaactcttgtttatattaatagcaattagcctatgtaaaactggttttattatacatcattttgcttactcacagtctccaagaacctatggacaatgtttagtgaggacatattatgtgttaactttacatcatagtatttaacatatgggatatgaaggagaagagtagacatcactcaagaactttacctcctctttaggggaagaggtagtgcttttttagtgatatgcagaatacttgtatcatgtcaggtggatatgggagattagatttgctttaaggagatgggtatagactctaaattgacaaggggtgtacttatgagggttaattttatgtgtctatttgactggaccatagggctcccagacatttggacaaacattattctggatgtgtctgtgagggtgtttttgggtaggagtaacatttcaatctatagatggagtaaaacagattgttttcctcaatgtggatgactgtcatccaaccagttgaaagtctgaatagaacaaaacagctgactgtcctaaagtaaggggattccaccctacatttgggctgggaaatcagtttttgttgttgttgtggttgttgtttgtttgtttcctgccttcagattcaaactggaacatcagtttttcctgggtctcaagcccactggcccttggactgtaactacaccttcaactttccgggttctcaggctttcggacatagactggcactgtaccatcaactctcctcagtctccagcttgccaactacagatcttagggctcctctgcctacataatcctttctgtttcaataaaatcagtagtaatgccccttctttcatttctgattttagttatttgggtcttttctctttttttcttagtcaatctaggtaaagttttgtgaattctgtcgatgtatttgaaaacccaactcttggtttcattgacgttctctgcttttctattctcgatttaattcatctctgctctaatctttgcaatttcctttcttctactagcttgggtttagtttgttcttaattttctaatgtcttaactagatgtgtaaacttaagttattgatttgagaccattctttcttttgaatgtgtttacagctatcaacttccgtcttagcactgttttcacagcatatcatgtgttttggtatgttgtgttttcattttttttttctctcaaagacattttccaattttccttgtgatttcttttttaagccattggttgtataagtgtattatttaatttccatatatttgtaaattttctagtttttcttctgctattgatttctagttttattctcttgtggccagaaaaggtacttgctacgatttcagtcttcttatattcactgagacttgttttgtgacctaacatatgatctatcctagagaatgttctaggtgtgcttgaaacaaatatatactctgctggcattgtatgcaatgttttttaccttcgtctatagtgttattcacatctacaatttctttgttgaatttccatctgattgttctaccattattgaaagtcatattaaagtctttaattattatcatattgctgcctatttctccctttattaccctcaatgtttgctttatatattttaggggctctggcgttgagtgtctgtatattggcaattgttatatctttctattgaattgacccttttatcattatataatatccttgtttgtttcttgtgacagtttttgacttatttttttctgatgtaagtatagccaccctgttccctttttattaccatttctatgaaacaccttttttatcctttcactttctacctaagtgtgtccttaaagctaaagcatgtttcttgtaaacagcatacagtttaatccttttgtgtaagaacatcaattctgacaatctgtctttttattgagaagtttaattatttacaaagtgattactgatagaaaagcatttacttttgccattttatcaattcttccaatactttttttgtgtttagttctctctctttttttttttttttttagtgaaaatatctgatcttttctcctttacttttcagtatattctataggtagtatccttgtggttactatagggattacacctaatatcttaagattatgataatcagttttatactgataccaatttaacttccagtgcatacaaagctctgttctttcacagcttaagaaactccttatttatgtaaatgataccaaaagttacattttcatattttattctcgtaagcatagaattaagttcattttctattcatttgtcttttaaatcctgttgaaaataaaagtggtttcaaaccaaaattacaataacaccgttttgtatattggtccatatatctacctttactggagaacttcatctttctctatggctttgatttatgatctagttccattttgtgtattcttgaatgactctctttaacattactcatagagcaggtttaatgataataaacacacttagcttgtttatctgtgaatgtctaaaaattttccacatttttgaaggacagttttgccagacatagaattctctttaaaaagttgtgggttttttttttcagcatttaaaatatgtcattccactatcttctggcttgcaatgtttctgccaaaagtctgctgagtcttattgagaatctcttgtacatgagggggtactgcttttctcttgatgctttcaagatttcctctttgtctttttctacggcttgattataatgtgtctcagtgtcagtctcttttccttcattctacttggagtatatggagcttcgtgagtttgtatatccatgcctttcctcaaatttggaagattttcagctaacatttcttaaattaactgattttgccctttctctacatctttcacttctatgactcccataatgtacatattgacccacttggtggtatcctgtaagtcctttcagctctgttcacttttcattgttttttctttttgcactttagacttaataatttgcaatggcctaccttcaagtatgttggtcattttctctgtccattcacgttttttgttgaaattgtctagtaaacttttattttgatgtggtatttttcagctccagaatttgtgtttgatttattacaataaattctatattttgttggcatcctcattttgttcaaaattttttttcttttccctgccacaatgatggattagaggcttttggcataccactgccacttaaaaatagcaagatagcacataaagatcaactctgtgaacttcaattcaagaaggaaaacatgactcagctggaattgtgagagacacccagatcctggtgaatagcacactagcaaaactgcgtgtgatggcatctagctgataaagatgagagaagccctgggacatgagagcagcagagagcttccctttgtgattcatctttccactgaataactgagaaaatagggccaagggaaaccactatgtttctcccaagtcctagagttaacttgggaagaggcttggagatgctgtgagaggaatacagtgggaaaaactgcagacattttcccagattggggactgagagcaggatgccacttttaatctgggtgcatacaaaatcagtcattcacctcttagggagggggagaaggagaaagcaaaaaaattattatagggaaagacagaagaaaaactactacccacatgaaagtaatacaaacattagaagtgccagcatctccagatgagagggaaccaacgcaggatttctggcaccattaaaaaatctgaatgtagtgatataaccaaaggatcacactatctctccagcaatggtccctaaccaaaatggaaactcagaaatgacagaaaaagaattcaaagtacaggtttcaaggaggctcagtgaaattcaagacgagattgaaaatcaacacaaagaagcatctaaagcaatccaggaaatgaaggaagagataagcatcttcaaaataaatcaatcagagcttctggaattgaaaaactcacttaagaaattttaaaatagaattgaaacgtttatcaatagactggacaaagcaaaaaaagaatttcagagcttgaagaccggtctttcaaaataatgcagtcagacaaaaataaagaaaaaagaatttaaaaaattaacagcgtctttgagaaacatgggattttgtaaagggaccaaacttatgaattactggcattcctgagagaaaagcagaaaaagttaacaacctagaaaccatatttgagggaataatttaaattctttttctaatcttggtagagaggtatgtttcgagatacaagaaatccggagaacatctacaagagcctatacaaaatgaacatcagcaagcatatcaccaccaggctgtccaaggtcaacactaaagaaaaatatcaagggcagctagagaaaaagctctgaccacaaataaaggagacctcatcaagttaacagcagacttctcagcaaaaaaaaccttacaagccaggagagactggggcctattttcagcactaaaaaaatttcaacctagaacttcatattctgctaaactaagcttcagaagtgaaggagaaataaaatcttctctgaattagcaaacattaagggaattggctaccaacagaccagccttataagagatccttaagagtgttaataaaatttaagaactatatctgctatatctacctgctactacaaaaatacactgaagtacatagaccaaagaccctataaagcaaccacataatagaaactacaaagcaagcatctagcaacttcaatataggatcaaaacctcacctatcaatgttaaccttgactctaaagaatttaaacacccccatttaaaatgtacagattggcaagttggataaaataaaaacaaaagaaaacaagcaagagaaagaagttaaaattatccaaataataaattaaagaaattaaaaagatccagataagaagatgataagttgaactatctctctttactgattatatgtttccatacctagaaaaccctaaggactctgtcaaaagcttctagaaatgataaacaacttcagcagtgtttcaggatacaaattaaatgtaccaatattagtagcattcaagatgggaaccaaatcaagaatgcaatctcatttacaatagccacaagaaaataaaataaaataaaatacatctaaccaagaagatgaaagatctctgcaaggagaaccacaaaacattgctgaaagaaatcacagatgacactaacaaatagaaaatcattacatgcccatgggttggaagaatcaatataattaaaatggtcatactgctcaatgtactctacaaattcagtgcagtattcctatcaaaataccaaggacttttttcatagaagtagaaaaaatattctaaaattcaaatggaaccataaaagaactagaattgtccaagcaatcctaagcaaaaagaaccaagtcagaggcatcacattacctgacttcaaactataccataaggccacagtaaccaaaacagcatagtactggtgcaaaacagacacatagaccagtgaaacataacagagaacccagaaataaagcttcactcctacagccatctgatcttccacaaagtcaacaaaaataagcaatggggaaagaacttcctattcaataaatggtgctgggatagctgactaaccatatgcagaagaatgaaactagacccctacctttgtcaccatatacaataactaattcaagatggattaaagatttaaatgtaagacctcaaactataagaatcctagaagaaagcctcagaaacatcattctgaacatagaccttgggaaaaaaattatccatgaaaagcaattgcaacaaaaacaaaaattgacaagtgggacctaattaaactgaagagcctttacacagcaaaagaaactatcaacagagtaaacagacaacctacagaatgggagaaaatattcacaaactgtaaatccagcaaaggtctaacatccagaatctacagaaactaaagcagctgaacaagcaaaaaacaagtgatcccatttttaaaaacaggccaaagatatgaacaaacacttctcaaaagaagacatacatgtggccaacaaacatgaaaaaaatgttccacatcactagttatcagttaaatgcaaatcataactacgatgagatgccatctcctaccagtcagaacggctattattaaaaagtcaaaaaaaacaagagctgcttagtgaggctgcagagatgagaatacttatacactgtaggtgggaatgtaaattatttcagccactgtggaaagcagctcagagatttctgttaataaaagaactttaggttctagataacttaataaacaaagttaccattcaaccctgccatcctattattaggtatatatccaaaagaaaacgagtcattctactgatagacacaaggactcgcatattcatcgcagcactatttattatacaataacaaagacgtggaatcaatctgggtgcccatcaaggtggattggataaagaaaatgtggtacagatacaccagggaatactatgcagacatacaaaaagtaaaaatatatcgtttgcatcaatgtggatgcagctggaggtcattatcctaagtcagttgggtgaggaacagaaaatcaaataccatatgttttcactttttttttttttttttgagacgaagtctcacccttcacccccaggctggagtgcaatggcacaatctcagctcactgcaacctccgcctcctgggttcaagtgattctcctacctcagcctcccgagtagctgggattacaggctcctgccaccatggccagctaatttttgtatttttagtagagacagggtttcaccatgttggccaggctagtcttgaactcctgatctcaagtgatccgcccgcctcggcctcccagagtactgggattacaggcatgagccactgtgcccagccatgttttcacttttaagtgggagctaaacattgggtacttatggacataaagatggcaacaatagaaactgtggactatggtaagggagagagggaaaggagagaaggttggaacactaattattcggcactatgcttaatacctgagtgatggaatcattcatactccaaacctcagaattacacaatatacccatgtaataaacctgcatatgtacccctgattttaaaatgaaaatttaaaaataaataaataaataatctgaaaatgatgtaaaattttaaaaaaaagaaaattattttatttctacctagcagccttgcatcacttatttcctctttgatccctttcatttcttatctagcatgcagatttactgctgaaaatgctttaaatcatatgaatttatatgaagtctttaatgtagcaaaacttttagctgggtcacctaaagaataggaatgaaaaaagagacccttaactaaatgacctttaaatgaaaatcatactctatgattacaatattgtctaaatcttaaattacatgtaaaatatcaaacaaaacacttaaatagccaaaaaatccacccaatttgttttactgattttctttagtccttgtccctgtttcatttatttgtttgtctctatttcttttagccttttaagcatatttaagacagatgtcttaaagtctttgtctaggaaccctgatgcatgtttctttggagactgtttctggagattgattttgttcctttacactggctatatttccctgtttctttgtatgacttgtgagtttttgttgactattggacatttcatcaaatagccgctttctccagtctttaaaattggcatggaagtcttttactgattaacaggaccctgaaccttgaggttagcccaaggtagtcttatcaggtctttggcagcatgcatttgtttgggtctatatgtgtgctttttaaaattttttcccctgaattctcctggctgcttttaagtgtcttaatttcccaaagagtcttaactccagcttcttcttggggccttagatgctctattatattcctttgcccataatcaatcatttgccccgggtgggtacaagtgtgtagtcttcctgcagttttcacatgtcattgtccatcactatcatccacggcttctagcctcagatctaaactatgctaccatttcctgtctgtgccgtgagacagataccagtccctgagcaacccacagacaggaccgaactactttgccaacaatttactctgctgtttctggcctgaggtagagaaccagacattgtgccataccgtagaccgaatgtttgtccctcttcaattcataccttgaagccttaaccctcgatgtcatagtattaggagttagggcatttggtagataattaggtttagatctggtcatcagatcaaagcccccatgatgtgattagtgcccctataagaagagaaataaatgccatagcttcctgtctccaccatgtgaggatacagcaagaaggcagatatttgcaatccaggaagatggccctcaccctaacctgcccatgctggagacttattctctgattttcctgcctccagtactgtgataaataaatgtcagttgcttatgtcacccaatttatgaaattttgttacagcggccaagtagattaagataggccgcttcctcctgatcccagtgcaaagagtgaggcaaagatggatgaaaaaaacttgaaatttcctaccatttgaatatggctttttctttattgggtatttacttggttaatgtagatctttaactagtttccagagtgtgcataaagttatttttatcagcatttcgttgttaacctggtatttctgtaagggaacaagatcctggggcaccctattccaccatcttgctgatggtactttcctttataatttagaatgtttactttaataaatggtgagtaatataccatgaatccaggtatgctgcatcaatgttagaatatttcctttacctaggagttttgaaagttggccaaggccagacgtggtggctcatgcctgtaatcccagcactttgggaggccgaggtggagttcaagaggtcaagaattcaagagcagcctggccaagatggtgaaaccccatctttactaaaaatagaaaaaaattagccaggtatggtagcgtgcacctgtaatcccagctacttgggaggctgaggcagagaattgcttgaacccgggaggcagaggttgcagtgagctgagattgtgccactgcactccagcctggcgacgtgtcgagcaagactccatctcaaaaaaaaaaaaaaagttggccaaatatttacttaacatatttaatatttcaatatcataatttgtatttgtataaaaatgcttagtttctagaaattcattaatatgattccatagttcactatgtgcactgtaaaatattctgaagtatacatgataaatagccaagtttcatgcctaagtacacacactgtacatatatacagagacattcctgagcaattacaaaatatggtttcataacaaacactgtgttttttcatatataacaaatgcattattttcttctgcccaaaatgcaaatttgcaaattgcatccaggaactcatcaaatctgctagatgaattatgtaattcaatttggcaaaatttttgcacacagcacaaatagtttactttggttttcttggattctgttctgagaaggaggtagctggaaaaaaagtgaaaaattacaggatatgattcataaaaatcccacatcttttttgtgtgcttgtacattcttttttgcgggaaaatgtttttgtcccacagtaatggctcctcatccttctcaatgagtactttttagtcagaaagatagccacacacaatatttccaagatactcaaaaaaaagtagtcataaggagaagacgcatgtcatttagcagctaaaagaaacatgtagcatgttcattaaatctctttttcaccagaaaggaatgtgaagactgaactttaacatggccacagtacgtacaaagaaatgaaacctcagctatgtatgttcctgccaagcattagctcaaatctttcactcttcaacatgtaacgagtatctgttttcctgtcatgttttgacagtgaagaaaatgaacctcatttctaaggttcagacaagtggcactcactactattcccttctctttttatttgatgcgaacaataagattaaacacataccaccaaagaaaggactaccagcacccattgtcagagacagttttcagtgggtgcattaaacatcaaatctctgcagatgatctatgtgtttctaatttgtaatttctctccggaagcagcctgcaaactttttaatcattttcagtttgtcaaaaactgttaaggcactggctgcccattatccacaatgaggagctctttcaagtaatggaatgactagcagtttcagaagctaaagtgtcaattttatacatatgaagaattcgcaaaataacagagctaaagagaaccctagagatgtcctttcatggctggagactgaggccacttccaattctcatcaatgtgaaagaccaggtaaactgcaacacccctgccataaggttcaagagatgctgagtggaatattcttttaaatgcatagctaaattcagtgctagaaataccaggaaggaagaaggcactgaaaaagaaagtggcacgtgggagagctgatggtgtcattggcttgggatggggttgtggagtataagttgccagtataagtaacccaagggtttatgttttaatacctgcataaagacagaagatgaactcttggacttcttgagacagataattgaaaatgagaagctcatcctatcacaggcattcacaattgatcaggaaccttgaaaggctgctcccaggtgggagagtagaatgaaaaaatgtcttcccactgatgacagaatgatgaggaagttggttgtttctttgtgcagactaggtgggtataaaaagtttcttctgagattgttaagcctggacatagatttttaaatttaaatttatattagtcatatggccaaataatccataagcaaaatagtagtaataagcattaaaggggtcctaggtagtaaaactactgaaatgcctgtcagaaggaaataaaaaactacctgagagggatatgtcttcaatccagataacatgtaattctcacagataaaagccctaccaaaaattagctcatgataaaatagttttagaggagtaaccaaattaatgtaagcaagtacttaagtatgagatcacagagaactctgatagagactataaactaaatgtgtagaaaattattaaaatataaagtaagaaatctaagcaataaagaaataagactagaatagtggaatatttaaaaattaagtacgtctttaaaaatgaataatgtttttgaaagttaaaatttatagtataaaaatgcataaaattagatctgcagttttagaggaaattattcaaagacagcataaagaaacaatgcagtggaaaatgtaaaagacaagttgaatgacataaagtatagaataaggcttatcagtatatatctaacaagagttctatctaacaagaattaggaaaaaatggaatagaagactaggggagctattatcaatcatagataacttagaattttccggaatacaggaaataatggaatttttacatttaggaaacacagtcagtcccttgcagcttacacacacatacacacacacacaatcacacttgctcacagagaggatcttaaaatgccaaaagaaaaaagattattttcaaaggaacaattattaagcaattacagacaccttggcagtgaaagtagaggcaagaatacaataaaatgatgttatcacagtgctgagaaaaagataattggcgatctagaattctatacccagccacgatcattcaagagtgaggccaaaaaataaaaaataaattcatctcagacaggcaagctagaagaaagttaatcactcccatcctgaaagaagaaagaaatgaagtgtgaggcataaccaaaattattgagcaaagatattagcaataattattgacaacctttgtattataactggatttatataaatagtcatacacatgtatcaataattgctctaaataaaatcaaggtttaaaaataaagtgaaactaaatgctaggcaataatgatatgtaggataaaatagaatatgtaggactcaatacagtttttggtccttgttttctgcaagtggagagtagacgtgtagttaagagaaatgacttttaagtcaattctgcatttgactagtttgagtaaaataatagacatataatgtatatttttaaataataaaagttggatgtataactttcaaatcattaaataggaaataataaagaaatgaaggctatgagaaggtaatgaacttgccaaatgtcacaagcagggttgttgcagaaatagggctggaaactaaaagtctggattcccaggccttcattctcttttctggaaatactctgggaatacatctactaaacttgaatattgttaagagtataaacaagatttgtacatttatctgcttttaaaattgtttcttttttttgagatggagtttctttttattatcattattattatactttaagttttagggtacatgtgcacaatgtgcaggttagttacatatgtatacatgtgccatgctggtgtgctgcacccattaactcgtcatttaacattaggtgtatctcctaatgctatccctcccccttcccccaccccacaacaggccccagagtgtgatgttccccttcctgtgtccatgtgttctcattgttcaattcccatctatgagtgacaacatgcggtgtttggttttttgtccttgcgatagtttactgagaatgatgatttccaatttcatccatgtccctacaaaggacaggaacccatcattttttatggctgcatagtattccatggtgtatatgtgccacattttcttaatccagtctatcattgttggacatttgagttggttccaagtctttgctattgtgaataatgccacaataaacatacgtgtgcacgtgcctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacgtgttgtttcctgactttttaatgatcgccagtctaactgatgtgagatggtatctcattgtggttttgatttgcatttctctgatggccagtgatgatgagcattttttcatgtgtcttttggctgcataaatgtcttcttttgagaagtgtctgttcatatccttcacccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtggtttagacatgaagtccttgcccatgcctatgtcctgaatggtaatgcctaggtttagagatggagtttcactcttgttgcccaggctcgagtgcaatggcatgatcttggctcactgcaacctctgcctcccggtttcaagcaattctcctgcctcagcctcccaaggagctgggattacaggcatgcaccaccacgcccggctaattttttgtatttttagtaaagatggggtttctccatattggtcaggctgttctcgaactcctgacctggtgatccacccaccttggcctcccaaagtgctgggattacaggtgcaagccactgtgcctggccaaaattgtttcttaaagttgtaaacatctgacttggtttgatctcaacaccaaggacactgattttttaacacagattattatatggggcaccatatacttttccatccactttccattgagcttaaaagaagtggtgacaagaaatgactactttatagcctgtagccatcctttataaatatgtactaattgcaaagcagtgtttttggttgtttgggacttctgagctaaatttaatagtctagtgggagaaagggcactctatgtaaccatgaaaaagaagtcagaatgtatctggttaaatacaggctggattttaaaataggaaaactaaaacttcaaaatggtagcacagcattaatggcccagagaacacctctaagtacaatctgcctgattgagggtgttacagtctgtcaggatttggggtccgatgaaacaattaaaaaaactgcttattaagatcagtgtttgaaaagtaaaagagtttggaaattatgctttattaaggggcaatggagtaaagccaaaatggttattaacaaatttgactgttggggacgtgtctctccagaaattataatcaactaatttttttaaaacaaaataatgggagaaaagcaaatgactggaatttagaaagcaatttctaaggtttttttttttttttaaggatttctacaaaattaatctcctgtctttatacatcttaacattacatgcttttaaattgaatgttgatctggtagaccttagggatgaaagggacttgaacagatactcttatcatatctactttcttgatagggctgtgcccaaatctttccatgaatataattatatgtaatttagaccacacatatttcttaaatctattgtatctctgcgtctatattataattctatgaagaaaaaagagaagtcatattttttagaaagtcttagtgtcacacaattctaaagccaaacctattttgtggtaatatttcttttgtagttatatcagatggagatttaatgaaattttcatttcctttatatgtattgccaattttcttgctatttttcatgctattctgagaacaagtactgaatacttgtgacatattgtaggccgtcagtgaatgttgattacattgtatgcactaattggttagcagtaaataagatgagctttgttctggtatttatattgtaatttactcatcattaaattacccctctcatgggtttgttgtgagatttaaataagagcacagggtaagtggtaaatagctattaatatttttatttttagaataaataagacaaccaaaacaaaacctgtttaacaaaggagaaaaaataaaaattgtgcactaaaaatacacattcttaaaagaaaccacctcattttacatggatgtaaagtcttcacatttggttaagaataaatcttcataaatacataatttattaaaagatttactttttagtataccattaaattgattcactttatcacatcttaagtttttaaaccttacttttttggaaaaaaatattttttaggaaaaaatatatatgggattatattatattttaaatgtataagctttcattatggagttaataccttttctagatacactaagacctttaaatttgatttgatctgaggtgaatgcaatcttttaaaaaatcctcttatttctccagtttttttttaaagattacagaaggaattcattcatcttttcatctattttcctgaatcttactttgcttttcgtaggacatttgaaagaacagctgtcagtcttttccaaagtaattattaggacatgtggggaattatctatttatggtcaacctggaagaccataggaatttgtatagcctattgatattacaaatttgaggggtaattacaatatttggaaatattttgggttcaataaccctaaagcaccacaaaagtgttaagtagtgaaagatattctttaggcttcctttttcaactacaaactactcttttaaaataacaatatgacattcattcttaatttttaaacataggctccactttttcaactgttcgctttttaccatggaaacttaaatgaaacaaagaaccacaaagtaacatttgccatttgacaaatctgattaaatcaaaggtgtttaccattgaaactcagtctacccacccactccatctcatttaccttttgttagacaaaatattactatcttttcccagaaggaacccaaaccattgtccattagaaacagttatattttagaatgttaaacattgcagggggttataaaatacaaaaataagtattggtcttggaatatttaaacagtttttggagtatgtgctctaaagatatcttagggttcttggctagattagagaaagttgttgatataggaatagaaacaaccatttttaaacttgtacttactgtacaaatctagccacaattaccagatcgatttaaataacttaataaaacttagcaaagactgagcatacagtctgttctgaaggttaatcatagttttttagtcaaagaatatctttagtatgccatctttgatgtgtcatatatacatttggagaggatagacttcaaagatagatacatgcagataagggtcaaatcccgtctgtcactgtaacagtgcgttaaccttttcagtgcttgatgttctcatctctaaatgagactaataacacctatgaggcagggttcgtgtgatggttaaatatcattcaggtacagtgttcagcagagtgacaggcacatggaaggtacttaatcagtggtagttattattgttctttattctaaccatcaagctacaatcaaatagcaactgtgttttaatttacttcttcttttgtgaattttcacattattttaagggagatttactcacaagtaaatctttttttttgaaaatggaatagtacattttgtggtaattcatatttcataatattgtatttatccaacaaatattcgtcaaatatctgctatccagagtctaatggtaggcaccaaggacatagaaaaataagaacacttttatttcaaatagctttttattcacataggactagaggaaaatctaattcagtagaaaacacaaaacaaaaggggttattttattctattcaaaggagagtcatgacattaacaacaccaacaataatttggaacacaccattgcattttcaaatacaaaaaaggaatcagaagaaggtggacattccatgagcatgttcaacaatggtattgttattagatattaatcctttattagattattatttttcacatctgggaaaataccactggcagcacaattttaagaaaagtttggcaacatgtatttttctcagcagctctggatgacagatcttggtgatgctagccaaaaaaaattaagggcaaaaccactggtgcacagaggacaacaaactgatcttattacagaaacggatatcagaccacaatagaaaagacatttttattttacactaagccaaaaattctaggctattggcatacatatcaacaagcctggtctagaatgtttaatcacaaaagtactaaatattggtttcctgcctgccctgctcaccttatttaaaaatatcaggatatttgctttcaaatgacacagattgctgaggctgtaacctacaaaatggtcactcatttttaacggcttgtttgttatacctagaaaccactgaaaggacaatttcctatatcatagttactgtggaggtagacactgacgttgcttccccagaaagaatttgagactattaaagtgtaggaagaacaaatcgggagttttatctaaaaacaacccttacatacccaaggaagtgccattccacttcagattttgcaattcttctctgttttttgtttttttttttaattactccatttctgttgaattttaagttaataaaaccaatagccaaatattgctgcaagatctctatgaattgtcacaaaatgccaactccaagaaggggcatcacaatgaaggattaaggacatgaccacaatgtcccaggaaacagtgaactctccctattatatttaatattgcaacatttgcttctattgtgcctaaggcccaaacaaaaaaataaaacgattccaatttgctttaaaaagtctggaaatctcttcctttcaaaacatactgatttaaagtttctccttttccagttttctttcaggtgagagttcatgcttgtgggtttgactcaaagacatctcccaaaggacaaggaaatgtatgtacaattttctttccacaataactagtacaacatgattaggtagtagccagatgatggcaaactatgtttgaaacaaaaagaataattctgcattagtaaaacaaactgccaagtccaaaattgtagaccaaaatacaataactaaatctatcttttaagaatatttgaaaaagtcaagtgactcttgaaaagagaagagataaaaaacaaaagacagagtatctatcaaaatgtttatataaaatggcatgaaagacagtaggcctagtggtatctcagaaaataagttgtcaaggtcatttctactaaggaaacagagatttcagaaacttttgattgcttagatattggcaatttcgtatagattgttaggcagaaaaagagaagagttgaaagaaaattatttgttagattgtaagtttacaccagattcaccatgtatttgctaaatgtttcagtttgagaattaagatgctttgagaaattgcaacaaccttattaccttatcattggatcaagtccaaacagccccaatcaaaagtctaaggtttcattgtctgacctagttatttccagcatagtaataacggacttaattgtatttaatgtattttacaaaaccattatacgaagccaggaatatcatagataaaacggactgcagttgatttggagaaactaagttatgtagtatgagtatagcatgtgtgagtataccacgttcacttacaaatgtcatcctctggtcacttgacaatcatgctctgcttcatgaagcgtttcatggagtaaaagcaagcaaggaggcaaggactgtgatttttgatgcaaatatgcccagaaaaagtcacatataggaacttacatatttaatggtggtgttgatgaaggtgacaagatacattataatactttattccaaaggcagcacatggtacaaaatcctgctggagactgtactacaatagtggcctttggaaacaagaaatttgatgatgatcatgaccatgttgatcagttctgaagacaacaaaatgccttcacttcttagcatagaccatctggttttcatttcttttgaaagtgaaaacgccatctttatgaaaatagttcaacaggtgtgttgttttttacttctatcttgttttccccttattttctcagcaggacaagtgatttcattcctgaagcaggaaaagaatgttaagatacatgccactagaaatgacaatgtcaaacactgacagagtcgtttcaagctcagaatgaatcacttttaagacagtacagtttggcttgtttcttttggggccataagacttttaatacttctttcattgagataagatgagagtaaacattcgacagagaaatagtaagaaatatttaaattaattcttctaaacataaatgctgggattaaaacaataagtttggccgggtgcagtggctcacacctgtaatttcagcactttgggaggccgaggcgggcggatcacctgaggtcgggagtttgagaccagcctgaccaacatggagaaaccccgtctctactaaaaatacaaaaattagccagacgtggtggcgcatgcccagctactcgtcaggagaattgcttgaacccgggaggcggaggttgcagtgagtcgagattgcgccattgcactccagcctgggcaccaagagcaaaactctgactcaaaaataaaaaagttttaaaatgctgattgaagaggaattttttcccaggagactttccaaatgatcattctattttacttccatatggagtctgtaaagaaacccagtaaatccacgaggctttataattgccctttggaaataaagcaggactaaactattaagagagaccagtcctgtaatttctgaagcctttgtgggaggagatccctgctttcaaggccatgatgttgtcagtgaaaggttagtgagagtgtcgtatagggctggagtaaaaactgaaggcaatatttccatccccaggattggtaatggaaatgtgatttgtagtagttttttcataaatatctctattttctccaaagctgacttctgtctccactattgatgttataaacttgttacaatatttaaagatagttcatctcacaatgttctttccatttactaagcaatggtaacatagcctctggttttatttgagtccattttggttactatttaataaaactgtctgtgttttttagtttaatatacagccccaaattatacaattgggaaaattaatttttaagccttctttttatacctacgtttgacagcttattaaattcctagtattatttactagtagatttatcaaaaatcatttttattcaccctgtatgagataccatgagaccatgagagagcgtatgtgattttccttcaaagtaagtatcacaaggagatgcaaaattgataatactcttctagcctctcattcagaacaactgcgagcaataaaatttaaacgggtaagtgaagaaaaactataccaagtgaaactaccctttcaaaaagtgctggtctatttcaaaagaagtgttgatattttcggaaagcctccattctgtccctcagggctatgctccatcttgtaatggtataatcaaaaagcaatggcattctgttcttacaactacatgctgtggataatcctctccacagttcatttgcttctccaggtattttaaagactctaagtgcaaccaattgggtatggtgtcatatgggagtatgtgtgattaactcattaatgtgtcaagttttaaatctaaataaccatggagatgtcctagtgatttggctttatcagattaatggcttggcataaacatgtggctaaactgttgtaggaaactttagtaaattagcatgtttgcattacactgttttattttcttattcaacaactaaaaaaatatctgggaggactaaaaagtaatgacagagatttataattatgaagttgattttaaaactacacaattatttttctaattaaaacatgagtttcctttttaaaatgggggagagtcttttgttaagcctttggctctactatttttttaagtaaatatcctcaagcaatcactgcaaaataacataagctagcaaatatgattggtatgaatttctcatgaaaataaaatttataaaaaattgattactactatgaatctagactgaatttgcccttacgcaatgaaagcaatttttacctaatactaagttacattccatttcagatttcctatttcaaagggtgtctcaaatttctaagaagttaaaccaagtattgagccatttttgtatatgtaataaaagtctttaaaattaaaatggtaatcctaaaaaaaccaaatgcatgaaaaatatggtctgactgtataacaaagggagttatataattctacttgagtgaaatctttcatctttgatttacaggttagagtcctctctaactaaaaccatattgttccatatctttcatatcatggccttccctaaaaccttgttttaattaaggtttctttcagatttctgaataaaagcatgacaatcttcacttatggctttaatatatcctttgagttagaaaaatatataaaaagaaacatcaactctttcaaaagcattgtcagatattaaatactgtgagatattctacctcaatatgtttaggtgtttgagttatatgttgaaatcgaattttaggaggtaggaggataacctacttatatttagtaagttactttttatctcagaaataaatgtcctttatttttaacttttgacactaaggaaacttgtttaaaggctgttttttgtttttgttttttttttttttcacaagaaggcacagcttctaggttaagtcagttcaaggtgactacaaataagcagtgccttcattaacacatttcaaacacatagaaatttagcaacgttgcttaagtgatattcatttcaacggcttcacagttaataaaatgcaatcagacaaaacaactgtgttaacctgtaaagtaaacaaaataaactaaatagtcaaggccctcaagtaataagaggagattatgggtaatcttcagtttttctaaaggaaggaatgaatgatgaaaggtaagaagaaatcaattgatagagggcagaaaaggaaaggtgagtgaataagtccttgatagatatgcaacaaattaagaccacctttgaaaagttacgtgcttttcaaagacactgaaaatgcttggtggaacatttgctcagacctactgtcatgagaacaaaggatgtgtgtgtggctgggaggtggggggacttcattctccaacacaattgcaacattgcaaattgcctgtgtgtgagaacacaaagatgttggggatgtttaaaaaaaagtgatataaaatattgcaccattacaaacagtgtgtgaggttcctttggcatttggacttcgagatactgaaaaaagcctcatgctagttcctccatcttgaacttttactaggaacagttgaactgtgtgttaaagttgagaaaaaaaccctaacaaaacaaaacaaacaaacaagaaacattacattctgggtggaattacgatccgttcatagctaaaagcaaatcttgtaaacaagttaagactgtttgaaaaacaaattaccccaaaaaaagctgatcagaatgtcaggaatgactatgtctcaggttttgcccaaaatttcactggctgtcatagcttctgaaattaacaatatctagtgctgtactgaatgtttctagttcaaacttggtgtctaggagtgggtcacccagcatattaaaagcatgctggaagcagtttcttccaatcgtggtttactgtaactctagaatcacagcggttacgtttaaggaatctttaatgccctttcaagtccatccaaagaacaagtgaagctgctgttcagaattttgtgcccagtgtttatgttccattgaatctgtgccacccaggcagcagacaagacatgtctgagggtactggggtggggggatacacaatgatgtcacacacaggaaatatcagagggggacttggcacttcacaaggctggctcctcttccataggctcaccagcagttctgtaaaaataaacaggcaatcagaatacggcataagagtacacaatgacattgtagattttcatgcataatcaaagctgatttttcagctctctctgatgtttatttgtgttattcagttatccataaatagaatttctttcctaggaagtataaacaaatgtcaaggggaaaaacattttcgatccaagcaatcactggaaatgttcctgtttatattaaaacatgtcagaatattttataactctagattccaaaatgtacatgtttggtgtctagtacagttcaataatttattgaaaaaattaactatgatattttattttaggagcaactgcagtgatttcctatggaaccagtttgctaatgagagcaaaggacccagctagcttctggaggagactcactagggctctggtttttgcttctgttctttcataactggattggctgcctgccggaggcatttcaaatcaaattctgaatttgattagcaaattgttgctacagacccaatatttttacaagaaatgcactatggtagtgtgtaaatagtttttattcggcatcatctgcagggtattctgcgcaggcaaaaccaaaactaattgcttgaaaatttatacttgagatttaaccttaatttagtaaccctttcagggtgctttaaggcaaacttttagaatgacttttaatttactcaaaagaataaattgtaggaggaatccaaatacatgaggtagttggattgtcatgggaagattactgggatatgagatgccgggtgaattgagtttgcgtctgagctctgccatttgttaattttgcaactgctgatttaaatacgcttttgtgaagctctggtttcaggtgtaaaccatgaacaaaatgatgttccttataaaattagcaaaggttaaaaaataaaggaggtaaaattgacctgtaaataataaacactatgagacattacttaatactttagatttgtccctttgctgtctaacatgcataaactcatgttgccacacaaatgcagagttatgcctttgctaccagaaggaaaaaatatttggatgatgcttctctctaggtagcggaataatagaggggtggttttcattttcttcttcataatgtttacctacttgccaggattctataatgaattactttcatattaggaaaacatgctatgtttaaaccagagctgtttatgcaaacaaatgaaatgtttggccatgttattttacagatttataagaaaaaaagccaagatttcaatgcatctctaaaggtgctgacaaataaagtagtagcttagcatttgtataacaaatctaaaacattaaaagaaagattttaaccataggagggtaatcaaaaatttttaaagcatccttttaaaaataaagaatgataatcattaagtcttcattatttattgttaccaaaaaagaaaattctaaaagagtctgtgtggaatatttaaaaagttgcttcttaagaagttatagcctgtcctagagtgtctgggataaggaggttgtgagagagagtttagaggtggtacataagataaatgagtcatacttcagaaaagtcttttctatcaaaaataatcagcattcaaagaagaaagattttaaattaaggaagacatttaagttttgaaactaattcatacataaatatatagccttatttacatctgagaatatgtgaataatacagttatagaactcaaactggatattctaatggagaccgatttttccaatttctaactcaagctgcagcaggataatcttttcccccgaatccaggattcagtgtggctggaattccagagacagtcacgtgtgggaaatgtctcagaggtcacagatgtaaggaatccacatgtctctgtggtggaggatctgtgaattctccacatgtccaacctaggcttaaaggatgtgagtaggctgtctacactgcaacccactcactgccaaaaattaagcctctttggttgaaacagggcaacttgcaggtacaatagaaagctttccatcagatgcttctctgccttttcctctctttgaaatcattttatattgacctcttttttttggaataaaccacttatagctgcccaccttctattgaaccatctacacatatgcataattaaccaattctctctctcgctctttcatttatttatgtatttttgagacagggtctcactctgttgcccaggctggagtgcagtggcatagtcacagctaactgcagcctcaacctcccgggctcaagccattctcctacctcagtatcccgaatagctgagactacaggcatgtgccaccatgctgggctaattaaaaaaaaaataattatagatggggtcttgctatgttgcccaggctggttttgaactcctgggctcaagagatcctcctgctttagccttccaaaatgctgggactacaggggtacgccaccatgtctagcctcaattctccccagcgtcttgcagcatagaagtgttagtagcatagtaagttggaaaatatcctggatttcaaggtagatgttctgggttcaagtcccagctgttttactttcgaaaatttgactttgaatcagtcagtcagtgtctctagattgtcaattttatctttaaaatagaaataataatcccttacttgccctcacggttatgagaattgaaacgagttaatgtaagaaaacatgatttatacactgtgaagtgtgaaacaattgtaaaataactggattatttatatctgccattgggacaatttatagtatctctcttctcatagccctagctctcagtagaggtggcattatcttcatataatcaaaaaatatgtctacatttttaaaaaagatgatttctttatggaacatttagaaagatatctggtgagtgatgaccctttaatggctgtgtttggaggaatgagaagcagtgctctgaaaatctgggggcttcccacttcagccatccctagatacatgtctacttcaccttgattaacaaagacacaagctgggggaaggaaagacatgcagggagctgaagacagtaagttcggagataactataaaatcaacccagcaaagataaattttagtataatggtttaacgaattgaaagacataagcttccctccagcaagtcaatgtcacagtgaacactgatagttttctgtcattgataatcaaagatttcatatcctaaagaaggatcaattcactccaacagccataagataatttacaaaagtaaaaaaaaaaggaagtaatttcacttgagacaagatgtagtattaaattaaattcttgtattctctcttaaatcttatttcttgtggttttaaaaatagcatttgtttaatttatattaacactgttacgtagtaaaacattttctcattttactgatttaatttaattcttatttcttacttctactcctcttcctcctgaaaggcaagcaatacaatgcctgttacattattttgtttgcaagtgttctttaaagctgtgtattattgttttgtgggtatatatttttattttatgtaaattttaactttatacacatgtgcataattttctcactcagtactgtatttactagatctgtcatgcacttatatttatctagtttgaagctggtaacttctacgtggcatctccatacagtgcatccaccacattttaactattcattctcccaataatggacactgggcttgactccaactctctattcaccatgaataaagctgtagtgaacttcctagtatacgtactctaaagacttatgctgagaatgtctttggtatacattcccaagagcaaaattaccaggtcatatattttgtgtatataaaatggtactaaattagtatgcagcatggctgccatagtttatcttcccaaagcagtgaggctctaaagccccacatctccacccatgctagcaatacttagtttactcatatttttcattgattctagaaaaagttgctgactgtgtactgtgtgccctggttctgttctaggcactaggaacatagcaatgaacaaaatagacaaacatccctgctctcatagaactcacattctccattgaccttatattctaattgaatgtttaccatctaatatatgtaaaacaataccttcttgttattcaaatttgcatttatttgataactaatcagtttggacaaagatttgaattttagtaagccacaaaagctaaagtaaaagacagagaatcaaatgactttcataagtatgtgtcataagtaagtctgtttatctcactgatgacttcttttttttttttttcttttgagacggagtctctcactgtcacccaggctggagtgcaatggcaccatctccgctcactgcaagctccgcctcctgagttaacaccattctcctgcttcagcctcctgagcagctgggactacaggtgcctgccaccacacctggctaattttttgtatttttagtagagacagggtttcaccgtgttagccaggatggtcttgatctgacctcgtgatctgcccgcctcggcctcccaaagcactgggattacaggcatgagccactgtgcccagcctgatgacttctttatctttccagtattcacaaactgattttatatataactaattcatatattagttcgtattttgtgaattttgttttatgttctttcatttcctcattcatttttctttttcatctcccccctccaatgttataccattttgtatacatactagacatcccataaatactttttgaaatgtttatatacatatgttggaatgatttcagtgctctttacaagtatgataatttaaatcaagaacaaaataagaatttgcaacaaaagaataaagatcgagaggagccaagatggccgaataggaacagctccggtctacagctcccagcatgggcaacgcagaagacgggtgatttctgcatttccatctgaggtaccgggttcatctcactagggagtgccagacagtgggcgcaggtcagtgggtgcgcgctccatgcgcgagcccaagcagggcgagacattgcctcacttgggaagcacaaggggccagggagttctctttcctagtcaaaggggtgacagacggcacctggaaaatcaggtcactcccacccaaatactgcgcttttcctacgggcttaaaaaacggcgcaccaggagattatatcccgcacatggctcggagggtcctacgcccacagaatctcgctgactgctagctcagcagtctgagatcaaactgcaaggcggcagccaggctgggggaggggcgcccgccattgcccagccttgcttaggtaaacaaagcagcctggaagctcaaactgggtggagcccaccacagctcaaggaggcctgcctgcctctataggctccacctctgggggcagggcacagacaaacaaaaagacagcagtaacctctgcagacttaaatgtccctgtctgacagcattgaagagagcagtggctctcccagcacgcagctggagatctgaaaacgggcagactgcctcctcaagtgggtccctgacccctgacccacgagcagcctaactgggaggcacccctcagcaggggcacactgacacctcacatggccaggtactccaacagacctgcagctgagggtcctgtctgtctgtcctaacaaacagaaaggacatccacaccagaaacccatctgtacatcaccatcatcaaagaccaaaagtagataaaaccacaaagatggggaaaaaacagagcagaaaaactggaaactctaaaacgcagagtgcctctcctcctccaaaggaactcagttcctcaccagcaatggaacaaagctggacggagaatgactttgatgagctgagagaagaaggcttcagacgatcaaattactctgagctacgggaggacattcaaacgaaaggcaaagaagttgaaaactttgaaaaaaatttagaagaatgtataactagaataaccaacacagagaagtgcttaaaggagctgatggagctgaaaaccaaggctcaagaactacgtgaagaatgcagaagcctcaggagccgatgcgatcaactggaagaaagggtatcagcaatggaagatgaaatcaatgaaatgaagcgagaagggaagtttagagaaaaaagcataagaagaaatgagcaaagcctccaagaaatatgggactatgtgaaaagaccaaatctacgtctgattggtgtacctgaaagtgacagggagaatggaatcaagttggaaaacactctgcaggatattatccaggagaacttccccaatctagcaaggcaggccaacattcagattcaggaaatacagagaacgccacaaagatactcctcaagaagagcaactccaagacacataattgtcagattcaccaaagttgaaatgaaggaaaaaatgttaagggcagccagagagaaaggtcgggttaccctcaaagggaagcccatcagactaagagcggatctcttggcagaaactctacaagccagaagacagtgggggtcaatattaaagaaaagaattttcaacccagaatttcatatccagccaaactaagcttcataagtgaaggagaaattaaatactttacagacaagcaaatgctgagagattttgtcaccaccaggcctgccctaaaagagctcctgaaggaagtgctaaacatggaaaggaacaaccggtaccagccactgcaaaatcatgccaaaatgtaaagaccatcgagactaggaagaaactgcatcaacgaacgagcaaaatcaccagctaacatcataatgacaggatcaaattcacacataacaatattaactttaaatgtaaatggactaaatgctccaattaaaagacacagactggcaaattggatagagagtcaagacccatcagtgtgccgtattcaggaaacccatctcacgtgcagagacacacataggctcaaaataaaaggatggaggaagatctaccaagcaaatggaaaacaaaaaaaggcaggggttgcaatcctagtctctgataaaagagactttaaaccaacaaagatcaaaagagacaaagaaggccattacataatggtaaaggggtcaattcaacaagaagagctaactatcctaaatatatatgcacccaatacaggggcacccagattcataaagcaagtcctgagtgacctacaaagagacttagactcccacacattaataatgggagactttaacaccccactgtcaacattagacagatcaatgagacagaaagtaaacaaggatactcaggaattgaactcagctctgcaccaagcggacctgatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaagctcactcaaaaccgctcaactacatggaaactgaacaacctgctcctgaatgactactgggtacataacgaaatgaaggcagaaataaagatgttctttgaaaccaacgagaacaaagacacaacatacccgaatctctgggaagcattcaaagcagtatgtagaggaaaatttacagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaatagagacacaaaaaacccttcaaaaaattaatgaatccaggagctggttttttgaaaggatcaacaaaattgctagaccgctagcaagactaataaagaagaaaagggagaagaatcaaatagatgcgataaaaaatgataaagaggatatcaccaccgatcccacagaaatacaaactaccatcagagaatactacaaacacctctacgccaataaactagaaaatctagaagaaatggataaattcctggacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactatgccaatcaatagaaaaagagggaatcctccctaactcattttatgaggccagcatcatcctgataccaaagcctggcagagacacaaccaaaaaagagaattttagaccaatagccttgatgaacattgatgcaaaaatcctcaataaaatactggcaaaccaaatccagcagcacatcaaaaagcttatccaccatgatcaagtgggcttcattcctgggatgcaaggctggttcaatatatgcaaatcaataaatgtaatccagcatataaacagaaccaaagacaaaagccacatgataatctcaatagatgcagaaaaggcctctgacaaaattcaacaaccttcatgctaaaaactcccaataaattaggtattgatgggacgtattccaaattaataagagctatctatgacaaacccacagccaatatcatactgaatgggcaaaaactggaagcattccctttgaacactggcacaagccagggatgccctctctcaccactcctcttcaacatagtgttggaagttctggccagggcaattaggcaggagaaggaaataaagggtattcaattaggaaaagaggaagtcaaattgtccctgtttgcagatgacatgattgtatatctagaaaaccccattctctcagcccaaaatctccttaagctgataagcaacttcagcaaagtctcaggatacaaaatcaatgtacaaaaatcacaagcattcttatacaccaacaacagacaaacagccaaatcatgagtgaactcccattcacagttgcttcaaagagaataaaatacctaggaatccaacttacaagggatgtgaaggacctcttcaaggagaactacaaaccactgctcaaggaaataaaagaggatacaaacaaatgggagaatattccatgctcatgggtaggaagaatcaatcttctgaaaatggccatactgcccaaggtaatttacagattcaatgccatccccatcaagctaccaatgactttcttcacagaattggaaaaaaatactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggtgatcactaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctctaaagacacacgcacacgtacgtttattgcggcactattcacaataggaaagacttggaaccaacccaaatgtccaacaatgatagactggattaagaaaatgtggcacatatgcaccatggaataccatgcagccataaaaaatgatgagttcatgtcctttgtatggacatggatgaaattggaaaacatcattctcagtaaactatcgcaagaacaaaaaaccaaacaccgcatattctcactcataggtgggaattgaacaatgagaacacatggacacaggaaggggaacatcgcactctggggtctgttgtggggttgggggggtagggatagcattgggagatatacctaatgctagatgacgaattagtgggtgcagcgcaccagcatggcacatgtatacatatgtaactaacctgcacattgtgcacatgtaccctaaaacttaaagtataataataataaataaatagaaaaagaattaaaaaaaaataaagatccagaaatattctcagtacagacttcctgtgtaacaattctacacctaaatgtgtgattgggaatatattccctcatatcacaaggctgtgcagaaataaaagcccaacaaaagcaaacatatgtatacacacacacacaaactcacacctaccataacaatacaactggcagcaagtttttgtggggaattgacatagattttctaacagtaccattactcaaccctagtttgccttattgcttccttttgtccatgttcgcctcttaattctacaatacatagtcaccttcaaccaacgtcttccttttttctctctcagctaatggcattatcatccagactattaatttggacttctttctctcccatttcattgatatttcatgaattgccaactactcactatttctcaacaatttatctacactaggttttcttcctctccatttcctctaccatgattaattggcttctttaccacaattaccataagggtttcttggctgtccctttagtagtatgctggcccctcctccatgacactctctgttcaatgtatagacctaagttatctctctctctctctgtgaaagcttaatactgaaaacaggattaactcaaattcgaatggtaataaatattttaattcccttccattaaattttgtgccatgatccctttctacccagccagcttactcaactctgtggcacccccaactgccccgagagtcctttcctttcccaaagtttgcactcatatactctctgaacttttgctcgtcttttactaccaaaatggatcttgagtacctaatttgtgtcaggtaatatactgctattaaaaaaataatgctaagccaaagggatgcagattctattcataaggagcttacaggagaaaacataaaggaatcaaataagcacacaaatgtatctaattttcacttatgtcctgtggagtaatgcagaagtgtaagggagacatgagaaagcatggaggacctgatctaatttgggggttagtggtcggtgaatatttttcaagaagaagaagtgatatttgatctgaaatctacaggatatgatgaaaagaatgggaaggccaataaagggttggtggaagaaggtagaggacaggataaacattccaaacagaagagaaggcatgtgccaaggaagccctgatgtggacatgagtatggctttttggaggaaaactgaatccacaatgaaatatcactccacacccacaataaaaggctaaaattataaagactgattttaccaagtgtaggtgaggctatgatgcaattggaactgtcattcattgctagtgggaatgaaaaatggtacagccactttggaaaacagtttggaagatttttatgaagtaaaacatatgacttccctacaacccagcaattctaattttagctatcttagctatctatccaaaaaaactgagtgctgtgaccacaaaaagaaaacttgtatgaaaatttcatagagatttagattcctcaagaaattaaaaataaaatttccatatgatccagaaatatcacttctgggtatatatcatccaaaaaaactgaaaataggaacttaaagagttatttgcacatccatgttcacagcagcattcattcacaatagtcaagaggtggaagcaatccaagaatctatcagtgggtgagtggataaagaaaatgtggcatatacatgcaatggaatattattcagccttaaaaaagaaggaaatgttttcatatgttaccacatggagaaaccttaaggacattacactaagtgaagtaagccagtagaaaaagacaaaagttgcatggttccaattatatgaagtatctaaagtagtcaaactctgaaacagaaagcagaatgatggttgataggggctggaaggatgaggcgggaagatgaaggagctggtcaatggctacaaggtttccattttgcaagatcaagttccagaaacctgttgcacaacaatacacatataaacactgctgtactgaacacttaacatggttaagacggtaagttttacatgtgtttttaaaccacaataataattaattgatcagctttattcataatagccctcaaagtgtaagcaagccaaacatccatccgtaggtatacggataaacaaattagggtgtattaatacactggagtaatgtacaataataaaaatgaagaaactccggattgtcaatggcataaatagatctcaaaaacatgcttaatgaggtgaaataagtcagattaagaaatacagtacacacgcatgattccatttaaatgaaattcaagagcaggcaaacataattgacggtgttaaaagtaaaacggtagttacctctggagggagtggcaccgactgggaagtggcagaagcaaactttttggaggtaataaaaatgttcttgaacttgttctgggtggtgtttatatgagggtggcattggtaaaaatcttagaacgtgtgcatgttattatatgtaagatatacctccattaaaaattaattaaggtcattgttggaaaccacatcagaaaagaaagaggaagaatgttagaagtaaggcaggaattataggtatgagtctactaatacagaccttatggagcctattgaagatgatgatctttatgttaatggaaatggaaaagtattgaagggtttcaagcagaggcatgaccagatatgctttccagttgttttgttttgtttttgattgaggtgtataaaatggattagaaagaaggtaaaactggatatgaaaaccagtaaggaaactactgtaaaagtttggatgagagatgatgatactttggactgagtgtcagcagtagaagttaaaaatatatatattgtctcaagttattgtcttgtaaagtaagggcttcttaaattgtcttgtcaaagtaaagacatcttgaatgccttttgtcctatttactgtgtgaaatctacacattcttccaccctgattctcttctccctggttctgtgatttgctccccagtccttggcctataaggcgttttgttttgctttttttttcattttgcaggaccctatttcaatcttatcaaagacttgtcatttattatagttgattgttcatgtttgtttctgtggtaggaagaataatagtccccaaagctatccacttcctaatccttggaacgtgtgaatatgttaccttacatggcaaaagtgattttgtagttgtgattaaagttaggggtgataaggtggagaaattaatcctaaattatcctggtgagtctaatctaattatatgagcccttaatagcagaaaccctttctcagctgaaggcagagagagatatgatgactgaagaaaggtcagatagatgtgaagttgctggctttaaagatggaagaaggggtcatgagccaaggaatgcaggcaacctccagaagatggaaaaggcaaggaaaccaatttttccccagagcctccacaaatgaaggcagccttgccaatacattgcttttagctcagtgagacctgggttagttagatttctgactgacaaactttgtgtgttttaagccattaaatttgcagtattctactgctgctgtaaaaaggtatgtgaacgttttgaggagtacaaggcagctttgtgatcctggcccctaacactttatctggctcctagaaataatcagaaagtgttgaaagagtgaatgaacttgatattttcacatgttcttcttcctcattctgctggttggaggatagtcctgattgatttaacctatgaacagctaaaggtatagatgcccaagtataggctctatattcttatattatagattactgaatgatggccaatatattaaaagaagaaacaggccgggcacggtggctcacacctgtaattccagcactttgggaggcagaagtgggctgatcatgaggtcaggagattgagaccatctgactaacacggtaaaaccccatctctactaaaaatacaaaaaaaattagctggccatggtggcacgtgcctgtagtcccagatactcgagaggctgaggcaagagaattgcttgaacccgggaggtggaggttgcagtgagctgagatcacaccactgcattctagcctgggtgacagagtgagactccatctcaaaaaaaaaagaagaagaaggagacggaggagaaggaagaaggaagaaggaagaagaagaagaggaagaagaagaagaagaaggaagaagaagaaggaagaagaagaagaagaaggaagaagaagaggaagaaggaagaagaaggaagaagaacaagaagaacaagaacaagaagaacaagaaaaagtgtaacaaatcgaggaagaagaaaagtgatagaaaaataataaaaataataaacctttatcaagttttatcaagtatttactacatgccaggtattgttttaagttcttgtgatgtgttgtttcatttgattctcacaactctatgaaatttttctctcattttaaagatgaggaaaattaaactcagagagattaagtaacttgcccttgagcaaacaactgtgaagtgtggagactctagaggcaagctctactcttcctctgtagtggtaagaggataggattgaaggagtgaagaaaaagatgagatgggaagctaaattatgcatcttattttatatacgtttctattcaattttgtttcttttttcaaagtaaacactgttttgtaaataatacagaactgaaccccaaaatacataactgggcattggaggattagaacatccctaatgttctaagtcagacttcacatgcacctcaagaccacatgttagacacgttgggaaaatagagataaaatgatggccctgggaagaggaggaaagataaatgaagagggggcagatttttctttttaccaggagcttccaaatctcacctcaattttcagctaaggctttgttgacactggatgaaaattaaaaacaaaatttatattgaaaaatttgcctgctaatatagtttggataaatgttcctgcccaaatctcattttgaaatataatccccagtgtgggaggtggggcctcatgagaggtgtttggatcatggaggcagatccctcatgaatggcttgcaccatctccatggtgataagtaagctcttgctctgagctcacatgggatctggctgtttaaaagtgtgtggcaccttcccctccactctctctcttgtttgcttctgcttttgccatgtgatgtacccgctccccaatcaccttcctccatgattttaagcttcctgaggcctctggagaagccaagcagatgccaggaacttgcttcctgaaagtcctgtggaactgtgagctaattaaatctcttttctttataaattacccattcgcagctatttatataatagcaatgcaagaacagcctaacgcacatacttagttatctaagttgtctaaataagttcttagttacctaaacaagtacttaacataatggtatcatagaataaaataagaggggtgaataatttgtgcaacatttagcttctagaagcctttggagacacaatcccattgggatgggctatttgaggaaaatcatgtttctaagtacattagatatgaatgtatatttaataatggtctatatttctatataaatcttaagattcaggaaaatggggtttttgatgtcattggaactattgataagccattcaaagctcaggtagatgatacttggatttagctgattattacactgttatattcacaaactagatagttacccaaaaaacaaagtggtcagactttgaataatatgttttctcatgtttctgtattatctaatgacatgaaaccatcacgttcatgagaaaggttgccaaaagttgaaagttaaatgattaaagagacaactattctggattttgttaaaaaaaaatgtaacacgatttacaggtcaaaatgacaactgcaaatctaactttcaagtttgtttggtttttgtgttagttaaaaaaaaaacacacacacacaaagtcaccaagttaggcattctagagtgcaaatgtgctcctaaaaacctaacagttgatcatcttgaagtcttgattgcctttccaaatcttttcttgatcttcagcagagcctgaactgatatccaagagtaaacctgagtactgtactgacctttccaaagtagaagcattttgaaacagatagtcaacaaatgcaaactacaattgtttaaaggtacacattcctagcaaacaataagaaaacttcttgcttctaagtagtatgctatatgtgaccagacgtatatatttaattttctttgactatataacttggatcccttcaagattttttgtgttgttttgttttgttgacccatcaatcatttttttgatcaagtcttttgcccccagaaaagtatgtgttatgtttgaaaattaactatccccaaaaggaattcccacatatcagccttttcctagtaatttattcttcaaggcccatcaatgtagttataaaaacgaaatgactatctgcactgtgttgtcatcccctcccccatccaagaaaaacgaacaaaaaatacttacaatggttcttagccaggagcattttatcccttattcactagtggtaaatgagtcagatatgagttggccaggaaaagagctgctttacccaaaatcttagtatgaaatgagtcatctcactccaaacaccaatatgttctccaaaataactggcaagaatttcctataaaaggaatcttgccttcactcttttccatccatttagctctctgatttttctaatttttcaatttcctgtgtgcttataatattgcattcataagaaaagcccagaaacgtttccgccactttatctcattttgaaagccatctttcctgtttgagtagggggacaatactgatagtattcccctgaaaagagtaaatgctctgtggcttttcagagcattctctctctctctttctgtgtgtgtgtgtgtgtgtgtgtgtgtgtgtgtgtgtgtgtctgtctgtctgtctctgaggaaattcatgcatggttcaattgaaatgcaagagccagttctagaagaattcttcttttcctctgctgaaaaagggagttcagttcaaagccatcagaaatatttcaagcaaaactatttttcttcccacaagaaaaatcaatcacaatagatataatctgtctaaaagtgataaatgaacatgaaaccaggctacactctttgactctgctttcctgcacatcagaacattcacattctctctctgccatcagatgaagcttaaaataaaaatcactgtggactgaagccaaggttaaatctctatagactaccatgagtcaagcacactatttacctgaggataaacaactttgcctacagggccaattcctgccaaactgctgagatttttatattacttgaggctcataacatcacttattattgttaattattctaagctctgcaatttaacaggcaaaaatatttacaattcatttcactcaggttggaatttagcttcgtttttctatattaaattctaaagaatagctatgctccttttatatccaacactaacagatgttagtttcctcagttttatggctctcagatgacagacaactaactgtttttggccttcggaataattgcaacacctttggattatgaacttggttcagttcttagctgggaacggcagggggttagttcttattatcaaagatgtaaagtaagttttcccttatgctctagatattcatataaagttatctttcaatagagtaatatacaacttttcccccttattgctaatctgctgtttaagtggttatggtaagagaaaataattgcataaaaataaaatctcttattcattttatctcctgttcttggccaaaacaagatgttaaatccattaaactctgagtatccagtaaaagcaagaaagtagaactgttcgtatttgtgcattcttgggaaaattgccaacctgtgcactagtagcaggatctgcgtaattaatggtgatgttattgacggagggagtctgatttccttctcaggagcaatttaagagtgcaagctggcagagctttagtaaagcctcacctgatttatttttaaattgaggaaatgtgaccttgaagtcagccatagaaatcaccaatatttatgtacatttatggtggctttggtagacttcaaagaaattctgaatgtaccattttctgtagaactgaatgatgaacaccaaatgcacaaactgacaaacattccttaaaaagagaacaagtgaatcaaatcttagtttcactgtattttttctccagaaatctatattcataagaagatacattaaaaccaattctgtcctatcccaaaatgaaataaaatcagccccaagttcacacagtcctttacacacagtctcttgtctcctttgcaggcaacttccccctttatccagttgttggacctcaaggacagccacgtaaggagtgtgtatgtattttggctatccaacggtctagcattatttccatcttctactctcctctttctctttgttatatcagcaatttcaaaatgattagagaaagaaaaagaacatctggaaaaacagagataactaggaaaaggagttaagcccacaagcagctctttccataacgatctgcactcaattatctgataaggcgtgatttttctcaccatttatctcatcccctctatttctctgtgaactgcaaccacatgctccagctctgcatttcacatgaagaatgaagcaatgaattctcgatagcctaaagcatgtgctgtggcatctgtggctttggagaggacaggtggtggaagtggaggagacaggtgaaggaaagccaggaggaagattcacaaatatcaacgatgagcctggatatgactgacccggattattcccgcacgttggattcatacctgctgtcttcctgagcaaagggctgttccacatccactgttagggaggccagggcagaaacggtctctgtctcctcttgcaactgagcaccagccagagcacagccccttggcacagccaccatccttactgacttccaatacttgcctaggaaaaacatccatcatacttcataagaattgtaattacagcagtaataatcagaatactcacatacgtccaactcagagcagttgttaagttaaaattccccatgttatacacagttgtaatttggtttcttaactgttatgattgggtctttttctcaatataagaatgccaagttgtgaagtgcccatattcccaagctgagtctccctcttgcttacacagcaataaagtgaggaataatccatggcctactgaactcaccctcagactgacagctgtctctgcaactaagtaagcaaactccgggcttcacgctccctgggaaacccacaagagaccaggaggcagcactcttacagagaacatgaatggaatcgtactgttaaacattgctacttgaatcattaactttaagaaaatgaagttggaatattaaagaaaaagaaaagcccagaaatgccagcatgaattgaatggcaactttgccagaacaatcaggtttgttagtcctggatgttctttctttctcaacctcagggtgtgtactagaacaataattgacttaaaactttaatatatatactggctgatgttggagcccatccatatgtcatactgatgtttctttttttgaggcaggaaaggagaaagagaggaaaatagaaggtcatttcatgagaacatgccaatgggataaatatgaaagagcatagttaatggctttcttgcagcccttaggctatttttttgtgaaatgatgagtagccccaaatcaaagcaggagaatctccctaggtgctgacatgactcaccaggttagtactatctctgcagcctgactagttggcaagaactttggtatgcagtgtttgcttacttcttggaagaaaaagccttgtttgagtggaaaaggcaaatggatgaacgctggattgggcagtaagataacagggttctggacccagcactgccatcccaatgacattagtgaggcttttcaggactttatttctgtctctgaaatagggagatgcctcaagtctcttgcagctctaacattttatgagtggcctttatttcttactgtttcatagaggaacagatgtcacattaggagaggatactaagtctccccatctgttccccatgccaacaagaccatctgacataggtgtccattactatttaacttgctgtgatcccttattctgaccaaagtctgagaatcataaagtttttaatttgaaccaaacaataacaattctgtcaatgaatccaaaaactaacattttgtagaagctaaggcttttccacatgtcgaggacacaaagatgcttccctaacaccaagaaatgcatggtccagttgagacagccctgttagttaagaattacaattctgtgtgtaaaatgcccacagtgaccttgaacgggaataagtagaacacgtatttaagatgatggaaaagtatgggaagacttgccaggaaaaataacacttgactgagtatttgaaagatcattagaaattagagtgcaaatgtgctcctaaaaacctaatagttgatcatcctgatgtcttgattgcctttccaaatcttttcttgatcttcagcagagtgaggtcatgggatatccctggaaggggaaacagcacatacaaatatacagagactggagtctctgtgttttactgggtgaccgtcaactgctgggaatgactagaacataggaagagtctggagtgggatggatgagactgctatggtaggcaagggctaattaatacacactcttgaatgacactctgatgatcctggacttcaacctgaggatgatcagggggcattttaggcagacaaggtatagaatcaggcttatgtttttaaaagatccctttggagagattatgggtgatggattggaaggtgataacagtgggggcaggaagaccaatttcacatcttggcaaaagtccaagtgggaaaccatgatgtctaatccaaaacgaagtaacagaatcgaaacgagaagacactaagagagatttgggaggttgaaaatgtatctttggcctaccctacatctctcaactttgaaagttatttctgaattgacagttccattcccagggcctagtttcgctagatcacaatgccaaatactatccagctctaatatttcatgattggcctttctttatcttactgtttcacgaaggaacagatgtcacattaggggaggaaattcagtctcaccacccactttccatgtcaacaagacctgttgacatgggtgtccgctactattaaacttactttcaagttaatgttattgtagtattacccaagttgaaaattccatataccatctataagtacatatattgtaatgagttacataaaatattattattaaacgttattttagcagatgacatttacaaagctagtgatgccttatgacatccttttcttgttttctatggtggctaacatggggactctgacaaacacactacatgtggctagtggcttatgggtcaaattataaagactagaggaaagacaaactagcattattgagaactaaatatgtgccaagactgtgctcggtgtttctacatttataatttgtaattttatttaaccctggtgacaactatttaggcaatgtctggtagtgtttttgaagatcacatggctaataggcagaggagctaaaatccttactcagcactaattttaaattgcctcttcctctgcactctgctgtcctccacccaccttccagtagacatgaaaataccaaaaagctcaattataaaattctcagcttaaaagaattatgtatattgcagattacttactaaagaaataatctttggaaatgatacattacccttgtactttaagatatgtgattcagttgacacacattttctagactttgtggtttatttggacagtgtgagacaatcatgttgaaactagttcactctactcttaatttctcataaaattgcactattgcaagtaccttttaccaggtaaattattgaggctatcataaaactggagacacggctaattgaagagtatgaataagaacctcatcaaaggctgggtgtggtggctcatgcctgtaatcccagcactttgggaggctgaagggggtggatcacttgaggtcaggaatttgagaccagcctggccaacacggtgaaatcccgtctctactgaaaatacaaaaaatatccaggcgtggtggtgcatgcctataatcctggctactccggaggctgaggcaggagaatcctttgaacccgggaggcccaacttgcagtgagctaagattgtgccactgcactccagactgggtgacagggcaagactccatctcaaaaaaaaaaaaaaaaaaaaaaaaaaaaagagaagttcatcgaaaattgagctaactaaaagtatttccagcttggagatcccacactaatccggaagaagtcactggatcacaatggagcacaacttccacatttataaataatagtggtaggcttaatgctatgaaagttttattcctgctctcattctcacttatcgtggtccttctgatctcatgttacatatcaatcttggatgttacaataaatttgctatggcagaaaaccttttcttttctatgagcctatgaactcttgaagaggtcagcaaacattctttgcacataatatgcacatttagaataagcaagggctttaattaccaagcattgggtcttatttctcaacaggagaggtctaggccacaaacaaacatctttacttccataacacaatcaggacagaaggtatgcatggttaatagcagtctttaagaagaatgactgacaatgatcctttaaattttggcccatatgtatgtcagtactaggaaggatttaaaatagttgagacctttttggataaaattgaatgtgtataaaatatcctgctaagttaagattaaatattagaagtttggcttttatccacatgtatgagtttcctgactcagaaataacccaaaactttaaattatatttggcctctggcaaagtctataaaaacaagggaaatattctacattaataatgcatttatagacgactatctctattcatagaggagaataattgaaatggaagtgggtacagcaccgtctgtgcaatatgcagacaattcaaaccccataatttatgggttatattttcatgtgatgtgtagggtcttttcttccattacagaaacagatgtgcaagaaagtcatatctattggcataggaataatatcaccattatcacatacgagaaatgaacaaaggttgactgctagggttttcaggagctgttattcataaagtcaaatattagtaatgagccacaactgggttgctctcctatggctatgcaactggcaaaagagaagagttttccattaaaattggacatgcacactccctcttcagtcatatcctctatccttattcatttttcccactatgtaaattgtcccacttttcaggactttttaaggactatccagccttcaccattctgtgtttttgtttttttctggcaaaagtaacacaaataatgaatctacaataaagataaaaagtatagaatggaatgtagagagtcaagagttagaggtgagggccatagatggggtttcactgggttacacaagacccaggagagggcatcctgcaggtactctgtaaacagacttcagtataaaccagattgttcttggaaatggacaatttggaaaaataggcagttgttgactcatgaaaatctgtgttacacaagtcacctatctaccaaaagttttctcaattcaaacccctttgctactttgaaaacttcctgaccccagaaatccctcattccatcatcattttggagccttagagctgtcactccttctcaaatttgcttttttttaccttttttccatttgaatgatgttgcctttcatctttacacaccgggttctcataggaaaataagctgctgctaatcttaacctcttgctatctccttcaaccacagaaattattaacacctggggcttacaaggaggtctatggattttctaaaacttaatacgtttttaagataaattttttagttaaatagagaactttggcatgatccaaaacattgtttaaatgcaaaaataaagacacattgaaaattggtgcataaattgagtgaccaggtaatttttcatctaaattggggctattttgaggctaaatggggataaaaataaaaattatatgttttggaaatatttgttggccaagaaattatttttatcagttggcctataaaatagtcctattcaaaatttattgttacaactaaaattcatttcaaaaaataaaaattgcataattcatgtttgtcaaagcatagctaccagcttcttctttatattgattatctgaaccttagaaaataacacaagcagaattattattcctgctgaatatcacacatgttaatcagttttgtagctctatcactcactgatacaatatactgatattcttatgaaaaatgtattttttgtttcaacggggtctaaatactttaggctttttgatagaattgcctataatcttgaaaacttaattgtatggttaataagtttgaaatttttagcatttttaatttatccttctcaagatactgcaatatttttcattgagaaatagtctctacaactatggtgctacctggtaagctcagaacaatttctgctaaaagcagaatatcttcacttttaatttttaaaatactgaaatgagtaactattttattccaaatgtctcatggttactgtcttttatctcctttcagcatactccactttggcaaacattttatgtaacacaaataagttaaatgtcaaaaagttttcgttgtttttgactcttcaaaattttaccaaattcagatgctgctatgtcttcaacttcactaattttcttcttctgtactgcataatatgccattaatccatccaaagttcggacttttaaaaatatcaaatgctgtatttttttttctctaaaatgtcaatttgcatggtttttatctttttaatttatctcttcattatgtttactctttcctcttcatattggaagtacatttttaacattctgagtcagtttctgtttattgatttgccttgtgatccctttcctacatttttgcatgcctagtaattttcatttggatgcctgacattggtaatttgaacattttttggctattggattttgtcatattatttgagagagtattggactttgttttagcatgaagttaagttactcacaattagcaaagtacttttgaggctcacttgtacactgtgttaggatggctaaaatgtagcctttaatgtaaggctaatttagtcctataactaagatgataccattttgatgtctctgtttgatgccttgtgtattataagatctctccactccggctaatgcaaactattcccagttctgtgaactccttgaattgtttaacctgctacttttcgttggttagttcctcagctttatggagtttcaccttatatatgtaaagaaaattattcaaatgaaacattaaggaaactcctgtacatgcagcactctgtgcacgcgcgcacgtgtgtgtgtgtgtgtggcaacttcatctccaatattttgcctcacaaattctagccactttatcctcctttatttagaggataaagtgattcttttttttttttttttttttttttgagagggaggctcgctctgtcgtccaggctggagtgcaatggcgagatctcggctcactgcaagctctgcctcccgggttcacaccattctcctggctcagcctcctgagtagctgggactacaggcgcccgccaccacgcccagctaattttttgtatgtttagtagagacggggtttcaccctgttagccaggatggtctcgatctcctgacctcctgatccgcccgcctcggcctcccaaagtgctgggattacaggcgtgagccactgcgtccagggataaagtgattctgtaactttgatggctttattctcaactcagtaataccactggaccctatttgggttcttcttctctatgctgcagcctggaaacttcctctagtcagttaccctggaatctgcggtactcattttgtttcttcattgcctgcaggccaatgtctgaaagaaagacagtgttccatatatgtatggaacattagatatctttttctctctctctgtatcatatatctctctatctctatctgtatatagttttctcttgtttctgatcaaagggcaacttcgatagcagttactctttcatacatggggtcagaggtccacttattgaatatttttgatttctaactaattggaaaaatataaaaattcagaaagctaatttgcaaaatggttcaatattactatagatgttcaaacattcctaaagtatggttgataaggggaagctaagagagaaattttgaactgtcttgctgaagtttcttttttctttctttcttttttaggtggagttttgctcttgttgctcaggctggagtgcaatggcgcgatctcggctctctgcatcctccgcctcccgggttcaagcgattctcttgcctcggcctcccgagaagctgggattacgggcatatgccaccacgcctggctaattttgtatttttagtagagaccgggtttctccaagttggtcaggctggtctcacactcccaaccccaggtgatccgcccgcctcggcctccgaaagtgctgggattacaggcatgagccactgtgcccggcctgaagtttcttttttgttttttaactgtcctcacctgtcacatatctaaaacagtgtattttatttactctatgtttatgtaaagagttttaaaattttgacagtagcttagattttcattggtagaatatcaagcttgtttaggtttttaagagttattaaatgtcattaacttcataattaaatcttaagctatttataaaaattgtgtgctccatacgtaatgctaagtacattcctgctctataagatgttccaccgaactttagatttgtatatcaatgcaaaaccaaatgattttattatcagtgttacacttttaccaaaatttataacaaatagctttcacaataacaccctgcttttttttttttggggggggggcaactttatttacaaaaattttgctttgattccataaattgaatgaaaaatatagaataatcattagaatttagtgatttttctgtttgaagcaattaaggacactgtatcattagcaagaaatgatactaatggagtcaagaaagaagaattattacgtcactcctgaacttttaaaagtaataccagaaactgaaaattgatttacaaaatttttaatcgtagtcattttatctaaataaaaagtaatgcttcatggagtgttacataaatgcaccctctgcaactgcacttcttaaattgttccttttggttttagtttttatttttgttttgttttggtcaataataactaaattttaaagtagaaactgctgcttctttaacagcattgtgtcttcagtgttcgtctgtgattttactctgtccccctgatgaataatgaatatcgacaaacattttgttcaagttacatattcattatcaattcgcttgggagacagaagtagagcactcatttttaaaattcacattcacacttgtttgtgagctcatttcagctaataatgttgatagcgaaattaaaatatgtaacaaaacataaaacaaatatacacatagtgaagttgcaatgtataataattgacaaaatctctgtagcaaaagtattgagagtgtaaatgctgtatggaaggctggtcctttctatttcctgaacatactttattcacacctaactgctgatttctcaaattttcccctaactctatcttttttttggtctgtttgtttttttgagtcggagtctcgctctgtcacccaggctggagcgcggtggtgcaatctccattcatggtaacctctgcctcccgggttcaagcaattctcctgcctcagcctcgtgagtagctgcgattacaggtgcacatcaccatgcccagctaatttttgtattttttagtagagacagggtttcatcatggtggcaggctggtcttgaactcctgacctcatgatctgcctgccacggcctcacaaagtgctaggattacaggcgtgagccaccggctcccgacccctaactctatcttctaacagcttggtagcttcatgcacgtcacaagctacagcaaccatgactggtgtgccaagtggcagcaatgttgagtatttcttcctttaactcccagatcagaaatttaaatgtcatttacaactggtattcgtgaggaccctacacgcttttcttaaaagggaagcgctagttatatcacaaaaggaccaggaaaagagagatgggttatcaattgtattttgtatagatttaaccatgtgttcaaagtaaaaattatatttactttccacgcatttctcatacaaccagaggaaacaatgatagaagctaaagcaaagtacaggtgtaacacatccatccttactcacttaataaaactatagataataatacttcattcagaatgaaaaatctgaaacaaacagtatctggatgagatgttgagacaacagacataaaccaagactgtctgtggctgacaagaaagaaccgtcattgtagcagccactgtcagggcctcatccacatgtcccgccccttactaattgagtgcacacaacctcatttccattcaccagaaccagcatgtcttttcaggacagctttcagtgcccctggagagtttttgctctatgattggccagaaatgtcagggtcatattgtcccccaggagcagtattcaggcaataactgtttggagttggagcataaatttctctgctccctcgcagctcacatgaaataactctgagctatgtgttttacatcagctctcagaatttccccagaggaattaaactctagatacctacaaggatagttgaacaaatgacacttcatttcttttctcgtcacacttcactattcctcttccttttctccctatgcctgcacctgcaaataaattacttgtacatgactccttgtgtatcaggatctgtttctggtagaagccaaaccaagataatctcccaacatgtaacagacgtaaggaaaacctggtaggaactgttcctttcatacatctcaagcgtcctctctgtcaatgttttgatatattcaagccctgagacacatattactaaaatgcattgaatgttgcattagaaaccaacctttttttgaaaattaacttttattgagtaataaactatcccatgtcctggaaataatagtgccaacatgaatagtgaattatctccctgtacatagacaaacatggatattccagttttcttagcaagcatgaagccagattaaggggtaatagatgaaatgaatactcatcttctgggaaagagtcagtctcttggatacggagctgtgagtgcattaatcagaagctatttatgaataaactgcaaagctaatttgttaactcaccaaagaagtatagcttttatgagggctatactattactgtcaggatgaccagtccattttatctcaatttccctacatgggaaaccaaattgcattcaaaggattgtttctatcactcagtgatatggttaggctttgtgcccccacccaaatctcatcttgaattgtaatcctcataatccccacaggttgaaggagagacctggtgggaggtgattgaatcatgagggtggtgtcccccatgctgttctcatgatagtcagtgagttctcaggagatctgatggttttatgtctctgacagttcctccttcacacatttgctctctctcacctgccaccatgtaagatatgtctctttcccttccatcatgattacaagtttcctgaggccttcccagccctatggaactctgagtcaattaaatctcttttctttataaattgcccagtgttgggcagttgtttaaaacagtgtgtgaatggagtaatatactcttacttttcgattttattacctaccaagcattctgatattggaaatacaggaatgtggatactttcatagatcttacaggttgccattaatcaaatgatcatgctctatgagtacatgtctcacagtgaaataagctactaaaatgaacgtactgcattctatgaaattaaaaaaaaatctgatcttaactgataatcagaaggtgtatatctgatcaagggacaattaagctgagatatgaagtatgtataggagttaagtagtcaaagaggaatagcaggaaaaaatatatgaaggtcttgaggaaggtggaaaaatagcacactagaggaactgaaagaaggtaagttgggtcaagagtagaaagcagtagaatggtaatgggcccatttaggtttggtaattgtaagtttctaagaggtcaaactgctatacatcatgacaatctcttgaagacctgcattggggaaatctctggaagaccagtgttagggaaagttgtttgtcctgtatatccagggttgagattttcttagatgggtaaagttgaagggcaggattgttggtaaggtagattgaaacgtagaagggcaaatgaatgttataattttaatgctgaatggaaaaagaagtgaagacaggaaagggcaatgaatgaggagaaatgaggaattaaaaactagacaataaaacagtgccttaggtgtgcaagtcaacaattctatgacatatgggtacaatagcctgatgtatccatcccgtcagagataacgcttgctagtgttgctttaagattcaccttttttaggtctgctaagacagtaacagatggtttcctttttcattctttatccataggagtttatgtctttagaaaaaaagaaaactctgttattgttttagtgggtttccatgaagaagtgaaaataaatgaatactctttatctattatcattatttgaaagtaatcctccttctccatttttaactccacaaataagtcttattattctaatatatctcatttctgccaactctccctagtgccttgtgttattgtgcattggattttattcatttatttaaatatgtatgtatttatgtatttgagttcatattttgttgggcttaatctctgcatatattgagggtctaaattagaaatacattcctccaggaaggaattttactggcttcctcctgaacccaggagtggacaaagatcaaaactctttagtatctatcaaattcatatccctttgatgcggatcttaagatttcttgtgcattatagcactgatgccattatttgcttcagagatattccccatttttgtgttgcttactgctccttattaaatttcagcttatgttttttcccctctcctatttgctgacattctagcaagcccactaatgtatttcaatagattgttttaatgcatgcaaactctattacattttagcagagtcctgttatagtgtctatacttgggaagaggcaatctggtagaacattgttctcatttttgaaatggagtgggaacaggaaggtcatatagatcctttaatcgaaacaaagtgggctttgacatcacagtaagaccaggattaaaatcttagttttccttcttaccagtagaaggaacttgaacaagctacctaaacttgataagtctcaagttattcatgaacaaaatgaggaaagaactgtgtattgcagaattatgtgaggactagagataatatatgtaaatacttaggaaacgatcttccctcaaacctgactttcttctagtacgtcctagtctcagtgaatggtatcatggtatcatgtgtatgtgtgagattgatctgggtgctaacacctgagtatgtgatcacaaagtattcctactctttcataatccacaaagagttttcagtcctagaagcatgcatagttttattttcttggtttaattggttttcccttggtagatgtgtgagtgaaaaaaaaattgcagacgcagttggaataaaaaataccccccaaaactgtgtctcatagcagatggcagacttttcttttttattctgatacattctagtattagggcgccaccaacacaacaaccagactttgaacatttgaagagaatggttaattagaagttcaaagtcaactttcacaaagccatgtgtacaagtctgacctggctgtgatacaagcgagggttggcagggttaatagtgggaaaatgcctaacgctgcttttcttcaatgaaggtctgcctggcccaggactctaacgtcaaggcctctgtctaaagccaaagaatatatgacaaatagcagctcccacctgacaacagtcagggctttaaactcaacagggcagggatttgaaattctgccaatccttgcatttttttctgattagaagtattttacaagtttataaggggctcaaaagtggacgcacagctccatggcttcttgtactttggcactgagcttccagaactgactgtggctaaatctcaattagccagaacttcccaaattcctaattttaacttaacttaaattttgtctaaatatgtcactttgggaagaaatgggaaaaactcaacccaaaaattgcaaaaggaatgaacttatttgtgacatagtgtaacttagaggctaagagggaagactggatctagactgcttggtttatgatcttgcttttgcccactcattagctgtgtaaccttggggaatacaatgaaccttgatgtgcctcagtttacttcactataaaatgggaatgaaaatagtaactactttacagggtagagaagattaaacaaattaatttttaatagtacctcacacactgtaagcactcaattattattacattattttattatttgctatcatcttacagggtttgtattgtgtaaataatttcatccaatgttcctccgtaacttcaatacagtgaaaatgtatattccggaggatactgccttctccccaaattgttaagactttctatcagcaaagtgtctttttcttaagtctagtatttttcacttcctttcaaatcttttctttcttcacaatttcctatcgtgggagctgatcaccaccatcatctcagttttccaagccagaaaacccagacattattaatcctctccctgtcagttaattaccatattataccaattctacttctgaattaaacagctcatatttgactataagccctgctaatctcctgtcttcagagcaagcacagtgatctttcgatttgcaggctttatcatgcttcttccctgctggaaataaaacctcaaatggctatgagctaaaagctcctttccaatattgggaataccttcttgtccttctcccctggatctcaataggatggaaatggaagagagaggagaagagacatacgaaaaaaaggcagaaaatcaaaatgaagtagatggggacaaaaagaaagaggaaaaactgagtttgagttagaattttggtgtgcagtcaagaagctagtaaagtctgtgagataatttatgcagcacacgttgcaatctggagaaacaacgcttttagttgtgtacatagccccatgaggtcaaaacattggataacttcccccaccccccaacaagagatgtatacaaattcctttcagcttagaaacaatttggattttctcctggattatctgatgtaaatgccccttctccttgtactggggtcggtagaggatattataatgatgggagaggatggtatttcagataaaagaagacaatggttgttatctttacggtaacattacataaaatacggtcttattttacttttatagccttttccttcaattcataaccagttctcttaatcgccaagaaaattaggtaccacatattttgattattcattctaatacattgacagtgtttatttagtattttattttacctatgagttatctcccattggaaatataataaaaagtaaaatcaacaaaatcagcattcctttgttcttttctagtatcagttgttacttctaagaccagttcccagaactacagatataataatattagtaataataataggaagaggaggacgaataagagtaaagaataacaataacatagaggaagaggaggagaagcaagacatcactcactcaaaaacacatatacaaaacataaatcaagcacagttctgacaaggagtaggtgtcaaatatacttgcctctcatctcccagggaaaatctgatttcattcttattactctagaatgtgtgagagtgtgctctgtgcattgctggtatggaaccatggagataactgattatgctttagtcaattacatagttacttgtaacattcccctgcaacaaaggaaatcatgtccattttcaaattgtcctcaaaagttggataaattctgaggattataaattcacttctcattgccctaaataatactctgtgtgtgtgtgtgtgtgtgtgtgtgtgtgtgtttaaaacaacagaggattagctatactcacaaattttatatacaagaaacatggaaattgctcctgtatttatgtaaaacacatttgacaagaacatatggtgaaattgcaggcactgtccattcctcattcttgcctgtgccaccattttgccttggttggcataataagaaattctaaaaagacctcaattcactaagtaagggataatccctagagtggggaaaagtgaaagtggggctacagggagaaaattcttactgttcttttaggattcttctgcctatttgccactttgttgtcacagtagcgccaacgtggaaaagcaattctagtgatgtgccatgtcattcctggtgaaattcctcaaacaagtggcttgctcattgtcacatggttgtggagtggaggagaagattacgatggaattcgtatcattttaaaatctcctacactggtgtttttcaacttatcagaggcaaaccactgcagggttgcagcaaaattgtgaaagaatcctcaaatccttgtgcatgtatatgtttccttgatccacaaaacaaaagatgctatggttatgattattatcattcaagaagtctacaaaattggttgacacttaaaaggaatactcttctcactaagaaatttaaataaataaaaggaaactatggctctatacttgttctcatgttttggggtttcacagattaatatcaatatcattcattatttgtttttagaacttaaagtgatagtctttcaaactaaataaatttacttttatgggaaactcacttcatggttcctcccctcccaaatctgtgaaaaagttataatgggccagcactggtataaagagtggtgttttagaactctggcgcccaccatgccatgcagaaaagtgaacgaattcaacggtgcatggatgctgtaaatcactagggtgggtttcaggaaaggaaacatccatatgagagttatttatctcactctgggctgactcgttactggcatcacttgttgattattacagccagttagccaagtgctagatccagctctgagaattgtcaccccaagcttacccgtggaaatggcaactcacaaaaataatccatgttcttcctaacttagaaatgactcatccttgtgggttgtgaagaaaggagaggaaatggactctcatgtattttgcttggtcttcttaatccctcattctgcatgagtgtgccaaggagtataaatatgtgaggttagttacaaaaatcaacgcaggcttagaagaaaaatgtggcaaacattgacagactagctgattcattcattcaacacacatttgcagagcacctaatacatgccagagactgtgcaaaagatacggcaattaaaaacaagcaggaacacagcagaaataatatctgccatcaaaagattgtgctaagttgccacgtattgcagaatttccttttgtaggtctgaataatattctactttatgtctatacaacattttctttgcccactcatccactgatggacactcaggttgctcccatctcttggctatggtgaatagtgccacaaagtacatgggagtgctaacatctcttagagattctaatttaaattctttctgataagtcttcagaaagtgagatggctgaatcatatggtagttctctttttaatttcttaaggaataacatgaaactttttttccattttgtcatctcaaagatagttgacccttgcatgccatctatcatgttaagatggaaccagaccctctcctgtcaggaagggtcttcacctgtcaggataaatcattgcccttctgtggcctgtaaggccttttctcttcagctagatgagcaacataaacaaggacaggacaacataaatgatcctgttggaaaatattcacatacatgtggccaggcaaggagccaacgcacctccagcacctgcataccctcagctgggggactcagttctcaaaaagaaattcacaggagaactgtcagcaccttgccatgtgccttgggataaggctatctagagacttgcctgaatgtttcccacatgctacaagcctgcttctcaagagtaacatagttttctgatactgtcgttgcaaactgcagcacaaaagaacccttcagaacctgggctagaaggtgggctgaaatctgaacaccccctaaagttgaaaggaggcacttgtgtgacactcagagacgtatgtgaagaggaagtgctcctgttgaacaaggactaccttcaggggcagcttcataatgggttacctgtgcagttgcgaagcgccccactctcagaaagaccccatgcttggttcagtgctttgctgttaccctccagaaattattaatttttttaacaaggaagagttcacacagtttcatcttgaactgggtctcacaaaataagtaacctgtccctaccactttctctgccaaaggggaaacgaggaacacaattagggtcctggagtcccaaaggagcaggtgaaatggaagcattggttataaaacagtgagaagcaagagtgcgatttcatatcttgtaaggaaatcaagcactgtttactaatcagggagcccataattttaatttcccaagccattatgaagtttaagactctgaaatacccactcgattttattgctctgtggacattagagggctcttttctcttcctttagcatagaagagtggcccctaagacacatagttataaccacataaaaatgcaccacacggtggtcaaagccacagtgctgaaacactttctctctaccgagtttcactccacttctcaaatggtgagagatcgctttccgatcttgtgttttctttccttttacaacctcaacccactattcagagccctctcaactgacatttaagttgtccttgtggtgatgctactatcattccttcttggtaaacgttttttcacctcaccatcaccttgactttcatcaggactggctacagaatttatagggcctggtaccaaatgaaaatatgggctgcttctttaaaacgcagtaagaattttaggcagcaacaccaagagccttacactaaggatggggcccttctatgtgtaggacctatgtgaccatgcaggctgaatgcccatgaagctagtcctgattttcattggcctgaattgagtcacgtacccatttcttaaccaatcactgtcaagtgggttgactgccttagactaaaaacagctcccctggagttggagctaagttgaacttccccctgagttgcacggtatctggtggcaaagattcatgaataaaaccagactccttttgagtagatgtgaagagtgcattgtttctgggtataccaaaatcagtgtccactacaccatatatccttgactcagaaggaggagctctggttgcttatggcctttgttgtttatggtcttgaagagttattcaagtcctacctactcaaatctgcctgcttttaatggccaggctcccaagcacctcacacctgctgtcaacccttcctggagggacattcagagacaaaaagatatgattcctgtcctcctgatgattatcctctaatttagcaaccagagctaacagacatttaaatatttgatatttttaagagaaacatcgaaaataaatataccgctgaaccaacacatattggtcttgagaaattatggcattattggatcatcagtaatgctccaagctgggtggggtactcattaagagtttagaaggaaatggatttcacagacaagtgatcactgttgggtggtgtaaaatagactttggggcagaagagtggaattgacaatccttagtggcaggatactcctacagcaagttttgatagtagattgagtctttttcaagagtcaaacaggtttgcttggctagagcagactgtagaggtcacttgaaaacatcagtagtgaaaggaaaaaactatgcagtggaaaatcattactaggaaattagatccaatataaaaggcaacagtagagtttctaaagatgtacagaaattacgcctttttatacctatgtggaaatagagtccttcacttctgtcgttcctttcaaagcattttcactctttcttcagttattcaacatgctgttcagcccttaagaaccaagctcaggctatatcaccgtcaagcaaccttccttactatccagtccctctcacccccagttgaaagggactgaagaaacagaccgccccttgtctatgacctcagtgtactctgtgaatactgtattgcaattatttacttggttgtctctcactcattggactgttagctccttgatgcagaaactatgtcttattcctcttcataacctctgtgccttggtaattgatcaacatgtaataagaactcaaaaatgcctattgaagtgatatgctcagaatatacataggaacaatcaattttaacactctgtgtatataatggctaaacaatgctcagaaaaagataataatatgtataaaaactgagatattttcattctattaatgacctgaaagcatacattggattgcatgtggatgaagagaagaatgctgtcaaagatcactacaagattccttgctttgaaatctagaatgacatgtaatagaccctctttatctagccccaatggaaacaagacaaagacaggacaatgacaggattttcttcttaagcttatgaaatcacctccagccttcgctgctttgtctctgtcagttcctgtactttaggcttatatcagagacttgaatagtgcaccccagcatttgaaggtttatttttctattccctaaaagtcttcaaaattcatagtttatttcagttatgacatgtagtcaataaatgtttattgggtacatatagccctcagtcacagcatgagtgagatgaagtggagaattatttttagttcctatatggcctgatgtgtaaatattcacagtatcaaataaatgggtaatttaactccagtcaacccatatctccaaattgctactgaacaagcaaaggcaatgacccaaagagatagctggcaagtggcttcttaagtggcacttaataaatgcttctacaagacagtagcaaacctaagggttttcctgttcctcctggacacctaatagtgccctttggttttcctcttcatgctaatcttcatgttagtttgtgcttgatttcagcatgtgtgtgcacccatgtgtgcttatgtgtatgtatgtgtgtgaagggagttggataataaaaaaagtctatgacttaaccctgctttgttaagttggattttcccatacagaggctttctcattaatttttttttcctctcttgacacatatgaatcagtaaatgattgctgaattccaacatcattaggagataactacccttcattaagattggattacaaaatcacaatttctgcatttatttcatggttctgggtaaatgcttagtgatcataatggtaaaaactccaaatacctgaaatacatgagaaaaacaagattctaaatctagagtctctacgttttgtcatcagtgtaagataagattgctgcattaagagcaacacattaagatatatacttaagaacgcatgtgcaaattatgataactctaaataaatgtttctttgtactataattttcaatataattttagttagttttacctgcttagaatttttaagagaactttaaagacatactttgaatttcaatgatcttctgtaaagaaataacagcattcatattcgggctttggtggagaatatcttctgcaagtggctccagctgcaagaatagtagataatagtatgagcagaatattatgactttatagtaagtctcacagaagcaaagcaaactgaaacaacctaatcctcaggaaaagctt

SEQ ID NO: 107 - protein, 819 aa, Homo sapiens
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNEMNTALRDGLLVFFFLIVPLIVCAIFIFIKRDQLWRSYFRKKRSQTYESDGKNQANPSRQPGSVPRHVSPVTPPREVPIYANRFAVPTYAAKQPQQFPSRPPPPQPKVSSQGNLIPARPAPAPPLYSSLT

SEQ ID NO: 108 - DNA, 6395 bp, Homo sapiens
  misc_feature (4094)..(4102): n is a, c, g, or t
accccgggcaggtggagcgctcgcggctgctcgcggcgagcccgggagtgatggcgaggcccctgcgggcggccagcgcctgaggcgccccgccccgccccgccccgcgcggccctccccgcccggccctgccctgccctgctccctgccggcggctgcgggcgcttcctagtccgctcgggcggccgcccaggcgaggtgcggcctccgcacaggcggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaagnnnnnnnnnaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgcta

SEQ ID NO: 109 - protein, 1025 aa, Homo sapiens
MAPVLSKDSADIESILALNPRTQTHATLCSTSAKKLDKKHWKRNPDKNCFNCEKLENNFDDIKHTTLGERGALREAMRCLKCADAPCQKSCPTNLDIKSFITSIANKNYYGAAKMIFSDNPLGLTCGMVCPTSDLCVGGCNLYATEEGPINIGGLQQFATEVFKAMSIPQIRNPSLPPPEKMSEAYSAKIALFGAGPASISCASFLARLGYSDITIFEKQEYVGGLSTSEIPQFRLPYDVVNFEIELMKDLGVKIICGKSLSVNEMTLSTLKEKGYKAAFIGIGLPEPNKDAIFQGLTQDQGFYTSKDFLPLVAKGSKAGMCACHSPLPSIRGVVIVLGAGDTAFDCATSALRCGARRVFIVFRKGFVNIRAVPEEMELAKEEKCEFLPFLSPRKVIVKGGRIVAMQFVRTEQDETGKWNEDEDQMVHLKADVVISAFGSVLSDPKVKEALSPIKFNRWGLPEVDPETMQTSEAWVFAGGDVVGLANTTVESVNDGKQASWYIHKYVQSQYGASVSAKPELPLFYTPIDLVDISVEMAGLKFINPFGLASATPATSTSMIRRAFEAGWGFALTKTFSLDKDIVTNVSPRIIRGTTSGPMYGPGQSSFLNIELISEKTAAYWCQSVTELKADFPDNIVIASIMCSYNKNDWTELAKKSEDSGADALELNLSCPHGMGERGMGLACGQDPELVRNICRWVRQAVQIPFFAKLTPNVTDIVSIARAAKEGGANGVTATNTVSGLMGLKSDGTPWPAVGIAKRTTYGGVSGTAIRPIALRAVTSIARALPGFPILATGGIDSAESGLQFLHSGASVLQVCSAIQNQDFTVIEDYCTGLKALLYLKSIEELQDWDGQSPATVSHQKGKPVPRIAELMDKKLPSFGPYLEQRKKIIAENKIRLKEQNVAFSPLKRSCFIPKRPIPTIKDVIGKALQYLGTFGELSNVEQVVAMIDEEMCINCGKCYMTCNDSGYQAIQFDPETHLPTITDTCTGCTLCLSVCPIVDCIKMVSRTTPYEPKRGVPLSVNPVC

SEQ ID NO: 110 - DNA, 6395 bp, Homo sapiens; identical to SEQ ID NO: 108
  misc_feature (4094)..(4102): n is a, c, g, or t

SEQ ID NO: 111 - protein, 1025 aa, Homo sapiens; identical to SEQ ID NO: 109

SEQ ID NO: 112 - DNA, 217346 bp, Homo sapiens
gaattcttagttgacagggtactttctttcagtgcttttaaatatgtcatcccattgccttctggtctgcatggtttctaatgagaagttggcttttactcttatgaggatccttgtacatgatgagtcgtttctgtcttgcaactttcgagaatctctctttgtttttgtcttttgacagtttaattaatatgtctgttggggatctcttgagtttatcctgtggagttcattgagcttcttagatgtgtagattcatgtcttttatcaaacctattgaattttcaagtattatttattcaaataatctttctatccctttctcttctccttatagaactcctgtaatacgtatattaatatgcttgattatgtcccacaagtttctcaagctctgctcatttttttcattattttttctttcacctcctgatactgaataatctcagttaacctgtctttaagttcactgactattctgcctgcttgaatctgctattgaaatcctctagtgatttttttattaaaaaaaaaaaatggagacacagaagctgggcagcctccatggggcttccacacactggggcttgcttccggcccccagcgactccaaggggatgagtgaatttaactggcaaggagcaatctgctgtcaccctgggcctctggaatcctggcaggaagaggccccacgaccaccacggacactcgagttgcagggaaagctgcttagagaagtggtggggcagcaagccagctgatgtggagcccagagggtttggtgcaggagcatctattgtggagcatggccaaggacagccatccccctagggtcaacttgctcccataggaaactttagcccgaggagaactatcagacctgaactctgcagggcgatcttgtccatcaggtagggctgctctgaactgagcaccccttggtctgatggtcccccaggaccccagcctggccatacctgcttgccgggaagcctctggcgtccttggagccagcatcctggcttttgcactggcagactgtgcctgacttgcagagagttcctgtagggcggtccccacggccatgcaccagcctgcccactccctccccacacttcagcttccccctggggctacagcagtgccccacatcgctttgctagcatgtgtgtgcatgggctggctttgtttccttgccccaccagtgcacctatgtccatgcaccctgccctgccactgctgcagcaggagggcatgtctctcccgtgtcccatcaactgccactgcagtcacaaccttggcaagcacagggccagccagcactgtggcaggagtgaaaataggcatggagaacagcagattctcccccatcacgagcaaccacccctgcctgcagtgcacagagaaagcacacagacctgtattacataacagtaaagggttcagttcaacaagaagaactaactatcctaaatatatatgcacccaatacaggagcacccagactcggaaagcaagttcttagagaccttcaaatagacttatactcccacacagtaatagtgggagacgtcaacagcccactgatagtattagacacatcatcgaagcagaaaatcaacaaagatattcagggcctgaattcagcactgggtcaaatggacctaatagacatctacagaactctccaccccaaaataacaatatacattcctctcatcactgcatggcacatactctaaagttgattacataatcgaacatagagtattcctcagcaaatgtagaagaactgaaatcagaacagccactctctcagactacagcacaatcaaattagaaatcaaaactaagaaattctctcaaaaccatacagttacatggaaattaaataacctgctcctgaatggcttttgggtatataataaaaataaggcagaagtcaagaagttacttgtagctagtgagaacaaagatatgacataccagaatccctgggacacagctaaggcagtgttaagagggaaatttatagcactaaatgcccacatcaaaaagttagaaagatctcaatttaacaacctaatatcacaactaaaaggactggagaaccaagagaaaaccaaccccaaaactaacagaagataagaaaaaaaaaaattagagctgaactgaaggagatcaagacacaaaaaaacactcaaaaaatgaggctgggcatagtgactcaatggctgtaatcccagcagttaggaaggtggaggcagacggatcacttgagaccaggtgttcaagaccagcctgaccaacatggcaaaactccatctctactaaaaatataaaattagctgggcggggtggcgcatgcctgttatcccaggtacttcagacgctgaggcacaagaatagattgaacctgggaggcggaggttgcagtgagccgagattgcagcactgcactccaacctgggaaacggagtgagaccctgtctcaaaaaaaaaaaaaaaaaaatccaaaaaaaccacaaaagatcaatgaatccaggagttgcttttttgaaaaaataatagaccgctaggtagactaatgaagaaaagagagaggatctaaataaacacaatcagaaacaacaaaggggatattaccactgaccccatagaaatacacataactatcagagaatattaccaaacacctctatgcacataaactagaaaatctagaagaaattaataaattcctggacacacacactctcccaaggcagccaggaagaaattgaaacctgaacagaccaataatgagctccaaaattgaatcagtagtaaacagcctaccaaacaaaaaaagcccaggattagatggattcacagttgaattctacccaatgtgcaaagaagtgctggtaccattactgctgaaactatttcaaaaaattgaggaggagggactcctccataactcattctgtgaagccagcatcatcctgatacgaacacctggcaatgacacaacaaagaaagaaaacttcaggccagtattcttgatgaacatcaatgcaaaagtcctcaacaaaatacgggcaaactgaatccagcagcacatcagtccaccacaatcaaatagctatacccctgggatgcaaggttggttcagcatatgaaaatcaataaatgtgattcatcacataaacagaaataaagacaaaaaccacattattatctcaatagatgcagaaaaggcttttgacaaaattcaacactgcttcgggttaaaaactctcaataaaagaagtattcaaggaacatacctcaaaataataaaagccatctctgacaaacccacagccaacatcatactgaatgggcaaaagctggaagcattccccttgagaactggcacaagacaaggatgccctctctcaccactcctattcaacatagtattggaaggcctagccagagcaatcaggctggagaaagaaataaggggcatccaaataggaaaagaggaagtcaaattatctctgtttccagacgacatgattctatatctagaaaaccccatagtctcagcctaaaagctcattaagctgataaacaacttcagcaaagtctaaggatacaaaatcagtgtacaaaaatcactagcattcctatacaccaacaatagtcaagctgagagccaaatcaggaacgcagtcctattcacaattgccataaaaagaataaaatacctaggattttcttggtttccagggaagtgaaggatctctacaaggataactacaaaacactgcttaaagaaatcagagatgacacagactaatggaaaaacattccatgcccatggatagaatcaatattggctgggtgcagtggctcactcctgtaatcccagcactttgggaggccgaggcgggtggatcacgaggtcaggagatcgagatcatcctggctaacacagtgaaaccccgtctctactaaaaaaaaaaaaaacagccgggtgtggtggcaggtgcctgtaatcccagctactcgggaggctgaggcaggagaatggagtgaacctgggaggtggagcttgcagcaagccgagatcgcgccactgcaccccagcctgggtgaacctagggagactccatctcaaaaaaaaaaaaaaaaaaaagtgacaatcaatatcattaaaatggccatattgcccaaagcaatttatagattcaatgctatttctgttaaactactgataacattcttcaccgaactagaagaaactatttaaaaattcatatggaaccaaaaaaaagcccaaatagccaaggcaatcctaaggaaaaagaagtagctggaggcattatgctatctgacttcaaactgtactccagggctacagtaaccaaaactgcatgttgctggtataaaaacagacacatagaccaatggaacagaatagagagcccagaaatagtgccacacacctacaactatctgatctttgacaaagctgacagaaacaagcaatggagaaaggcttccctattcaataaatggtgctggcagactggatttttaaaatgtggtatgtacacaccttgaaatactgtgcagccataaaaaagaatgaaatagaatgaaattgtgtcctttgcagaaatatgggtggagctggaggccattatccttagcaaactaacacaggaacagaaaaccaaatactgcgtaaagtgggagctaaatgatgagaacacgtggacacatagaggtgaaaaacagacagtggagcctgttagaaaatagagcacaggaggagggagaggagcacaaaaaataactaatgggtactaggcttaatacctggctgacagaataatctgtacaacaaattccaatgatacaagtttacctgtataacaaacctgcacatgtacctctgaagttaaaaaaaaattatacttttcggcttcaaagttaattcctttttataatttttcttaatattctatatttgttggtacattgttttcttggtttcctttacttctttgtccacagcttcctttaactttttaaaatattgatgcactatagatgtactttgtttcagggtacatgtgacaatacgttaagcacttgggcacttaggtcagttccatattttgactgtagtgagtagagctgcaatgagaatgagaggcagatgtctttttgatatattgattttctttcttttggatgtttacccattagtggaattgctgaaccatatggtcattctctttttagtttttgaggaacctccatactgttctttaaagttgctgtactaatttacattcccaccagcagcgtaagagggttaccctttctatgggtcctcaccagcatctgttattgcctatcttttttattaaaaaaccattttaactggagcgagatgatgtctcatcatagtttggatttacatttccctgatgattttgagcattttttcatataccttcccctacatgaatttgttgcacttctttcctaagccctttctttgaaaatcctgcctgtacctgtacaggtcctacatgatgtgaatttatctttttcttcctagtgctgtgttaaatgagaataatgtgcccctccccaaagagtctcttgagactctgatgcttatcacacctgccgacagtggttctgttctaaaggtaagaatacttttacttcttaaaatttttgccaaagacagttttgaattgaatcttgcagtataaccaagggcatctagtgattactgagtgacactgggacttaagatgtgagaagagcagccgagcacaggggctcacacctataattccagcactttgggaggccgaggcatgtggaccacttgagctcaggagttcaagaccagcctgggcaacatggcaaaacctgtctctaccaataatacaaaaaataagctgggcatggtggcatgtgcctatggtcccagcttctcaggaggctgagacagaaggattgcttgagcctgggaggtggagattgcagtgaactgagatcacactactgcactccagcctgagtaatacagtgagactgtctcaaaaaaaaaaaaaaaaatgtgataaaagcattgagccacagttctctagggagaatcctgttgccacactactcacaagaggatcttagggtttcttctccagtttgtatgtactttgtttatattttgggggtggttttgaatgttggctatgctttcactcatttccttttaagatacagtgttgcatgcaaatagggactaagtgcttcttagatgaaagaattaagggatctttttgaattagtagtttcatttactctagggcatgggtccccaattcctgtgcttcggaccggtactggtccatggcctgttaggaactgggccacacagcaggaggtgagctgcagacaaccattgtcgcctgagttccacctcctctcagatcagctgtggtgttagattctcataggagtgcaaaccctactgtgaactgtgcacacgagggatctaggttgctcactccttataaggatctaatgcctgatgatttgaggtggaacagtttcatctcaaaaccataccccacccccaaacctggtccttggaaaaattgtcttccacaaaactggtccttggtgccaaaaaggttggggactgctgctctagggaatgtaagctgtgtgagagacacctgttttgttcattgctgtatccctcaggctggtctcaaactcctgccttcaagcaattctactaccttggcctcgcaaagtgctgggattataggcagcctaagtgtctccaatagtacctggtacataataggcatgaaatatttgttgattgacacaaactttttgaaataacagggacctatcactatcactaattgcactgcagcataaccagctcatcccaacttctgccttttctgtatccactcgctaaacccttaacaattcagaaatcatagaaacccagtttattgccaatgaatgttttaatttgcaagttaaattaaaaattgcccttgcatgaacacttaccatttgtcttttttattgcataatgtacatctgttgtaatttgccaaatacctcacaaaaaggaaaaattaaagatcacttgtattctcactactcaatgaaagtgtatagttggtatttaggtatataagtatctttcagatttttagggttaaagaaaaaacccaacctaaaatatcttcaatcaggcatttcttttctgctgatgaaaatctgaaaagatacattgactaatcattggaaatcattaagcagaacctgagatgtttttgaagcagagaaggacatttagttcaaagatttattgcatatatagtatgtaccagacaacttgttaagcattaaagattcaaaaatgaatgaatgaaacatggtctcagcttaactgcatatagtctagtgggagagagaatcgtaatacattgtggtagacttgcacaagctgttatggtgcacttagtccaggcagcagggtgggaagatgcgagaggagagaacagtttttcatgtttttgtgatttaaattaagttgcacgttgaaatatgaataggagattctccaagacctgaaggcatataagcagaaatggaaatgtgtaaatgggtggctaagtgtggtggctcatgcctataagccagcactttgggccaaggcggtaagatggtttgaggccaggagtttgagatgagactgggcaacatagggagaccccgtctctacaaaaaattttttaaaaattagccaggcatagtttggcatgcctgtagtcctatcttcttgggcagctgatgtgggaggatagtgtaagcccaggaaattcaggctgcagtgagctatgattgtaccattacactccagcctgggtgacagagcaagaccgtgtccctctgccccccccccccccaaaaaaagaaagaaatgtatgaatgaagggctcttttttgttgtgtgctatgccctaggttcctattgtttattgccagattggcattttatcttttgttgttttaaaattctcccagaccccctccctcacagtagagaattgtgtcctttataaggtacttcaaatactggttaaacaaaaagtattaacatttatagggagagagttcatattgtattattttacaaacagaagcacccataagtctagataaaggagcatttggaatttaggcacctcctttatccagtatctcctgtgctgaacctgttactggttttttttttttttttttaagttcaaagtatgatattaccatacagagtagtaccattctcatctagtctaaaagttaaaaggctgggcacagtggctcacacctgtaatcccggtgctttgggaggccagggtaggaggatcacttgaacccaggagttcaagaccggcctgggcaacataagtgagaccctgtctctataaaaaaaaaattggctgggcatggtggtgcacacctgtagtcccagctacttgggaggctgaggtgggaggattgcttgggcccagcattttggggctgcggtgagttatgcttgtgccagtgcacttcagcctggacagggcaagatcttgtctcaaaacaacttttttttatttttttgtatttacttttttttttttttttttttgagatggagtcttgctctgtcgcccaggctggagtgcagtggcgcgatctcggctcactgcaacctccacctcccgggttcatgccattctcctgcctcagcctctcgagtagctgggactataggtgcccgcaaccacgcccagctaattttgtgtatttttagtagagacggagtttcaccgtgttagccaggagtgcccggctgtatttacttttttaaaatttgttttgaggcagaatctcactctgtcatccaggctggagtacggtggtgtaatcttggctcactgcagcctctgtctcctgggctcaagtgatcttcccacctcagcctcctgagtagctgggactacagctgagtgctactgtgcccagcttagctcagtttttgtaaagatgaggtctcactatattgcccaggctggtctcaaactcctgggctcaagggatcctcccgccttggcctctcagagcgctaggattacaggtgtgagccactgcatccagccaaaataatttttttgtaattaaaaagaaaaagttaagagccagaatagtcataaccctacccaagttttgtcttaccaaaggagaatagctatttgaaaatttacatagcacttcagctttttcacatcctgattgtagtataggtttccctccatgcagaagtggaatcattaacaaccatgatttatgagtgtccctgtgtatttaaaggattaacactaatcaggcctgtgtcagaattataaattgagaggatatggaaaaaacttaacatctgatgataaaggggtcatttaacaattctagattcctgtcttccataggaagctacagatgaattggatgccttgcttgcatctctaactgagaatctaattgatcacacagttgcacctcaggtaaatatgctttaaaatagtatgatggaaagaaatttctgttttgaaaaatgttcctgctagattccagttttttcctttttaataattcagttaaacttttcatttgataagagtttatgttttaataaccacttagcattgcctctctgtcctaaaattttaccactttgaatttgtgtatcactgtctacaaatcacatgtctctataagccttttataattcaacatcatattaaatgagagaaaacatggggataaagcagtttcttgagacaataaggatatatttaattttttaaaaagttttatagaaagatgagagcgtaagaatggcattgaacatatcaatcattattacagtctggaagatactgtattaagtatagttgtccctcagtatctgtgggggattggttccaggactccccttggataccaaaatccatgcatgcttaaatctcatataaaatggtgtagtgtttgcatataacctacacatatcctctagtatattttaaataatctagcttacctctaatatctaatgcagtgtaaatgctggtaaacagttgttatattgtattgtttaggaaataatgacaagaataaaagcctgcacatgttcagtacagacacaaccatcctttttttccctccaaatattttcgatttacagttgttgaatccacagatgcacaactcatggatatggagggccaactgaaacagttccttccctccagggatgagagagatagaaatgactaactttgctggacacggtggctcacgcctgtaatcccagcactttgggaggccgaggtgggcagatcacttgaggtcaggagttcaagaccagcctggccaacatggtgaaaccctgtctctactgaaaatacaaaaattagccgggggtggtggtgcacacctgtagcgccagctactcgggaggctgaggcaagacaattgctggaacctgggagatggagcgtgcagtgagccgagatagcaccattgcactccagtctgggcgacacagtgagactccgtctcaaaaaaaaaaaaaaaaaaaaaaaaaaacagaaatgactaactttgtaccttatgagtgatatgacgagaattgctgtaggggctagatgccatcctgaaggcttggaaatacacatgatactgaatgtttgcatagatcattaattctcaaatttttgtgtatatcagaatcccttggaggggacgttaacacacaagattgctgggccccacctccaagtttctaattttggtatatcttgggtggggtctgaaaagttgtgtttctaacatgttcccaggtggtgcagatgtggtctgggaaccacccgttgggaatgaccagcttagattaataaacaaagactttaccaaggataagaattaactgcaagtgtggaaaagtctgtcaaactattttttgtttactattatttatgatattttttctctcttatttcctgctgttaacatgcatctaaaaagtattggtaggaaagtcagattttgtgggttttttttttttgagatggagtcttgcttttttgccaggagtagcgtgatctcagctcactgcaacctccgcctccaagcgattctcctgccttggcctcccgagtagctgggagtacaggcgcatgccaccatgcccagctaatttttgtatttttagtagaggcagggtttcaccatgttggccaggatggtcttgatctcttgacctcatgatctgcccacctcgccctctcaaaatgctggggttacaggcgtgcgccactgcgcccagcctgtgtttttattcttttggtggttatctaatttactaatacctggacttacattagttttttcttatgagtatgtaaggccaccaatgcaaggactagtctaaattactagtaaaatgggtgggtttccttagtttataattctacacatagatgacctataatagaaagttaaacatataaaaataatgtatcaaaggccctgtgaaccaggagcaatatgggtgtttttattgcgctttcttcatgcatacatgataattagagaatgatctgtatctaaacagattatttttctgtgtactttcttgttgctctttatttggattagtcacaatccattgttcaggctgctaccaagaaggctatcattatttgtaattaattaactgaaatttcagaaaataaaatgttaaactgaatactgggtgtgaggtaggggcagtcctattaagtgaactgaaagtagtaatagattcttgaatggtaaatttttagataagagattctcaaaattatgacactttcttaagtggtgagggatagcatctgtgttgtataacagaaaagggtcttggatttagaagtccatgtcagctcaaggaacaccattaagaattaagaattgccctcctagaatggatttcataatagatgtaagtaagtattataagtatgaaaataagtcagtctttccaaaaagtaaatacatacatataaaattatttcaggtgtcttccacatccatgatcacaccccggtggattgttccggtaagttcatgttatttgtgatttttcttctggctaccctttcagggtaaggcctaaaggattactaggttctttgtttttccttaaaaacatgagggttgttatcaaagccttgttaactgaacttaacttaatggcttcaagctagtggcttaccctttctggttgtaaatgtttgtcaggatgctggcagaaacaaaagtaaaagtctcagatgaagaatagttaagaaaaacaaaacaaacagtcataattatcaaaaccatcttcgttaatctcatagtcattagtgaagcttgatttggagctgaagtgctgaccaggcaggtattgttaccctgtatttagttgtgtgtgtatctcccacagcagagtggtgccatgtctaatggacttgcgggatgtgaaatgcttttgacagggaaggagggacatggtaataaagatggaatctcactgatctctcccccagcgccattcttggtagatgctgtgaccaggtgagaaaattatttctcatttgcagttcttaggcatctgttaggaagaaaaaaataataaaacttattatctctaaagcagcaatgtcaattcttccctaactgaactatattgaaatggggcaaatcttttttctgtttgttatttagtgtagtggctttttcttgtcagtagcaattttctacaaaactgtattagcgtttctttatcaagtctttgctaaagatgttaacaggcttatctttgtaatagttgttttaaagtcaatttgtattgtttccctttacgctttactatttattatgattatgcctactgtaatagtgatgaatgatggtgcccgtcaacacaggtgaagaggtgcagtataagtgggtaagttaggatactcctagggtgagagccctgagatgcctttaccaatacatgttgtgagctcatttcaaggcgttgcttgctacagacagaaactagactcaaaaactagagctttttgttcagcatctggttcttcaacttttgatttgctagaaccataactgcacctgttttacaaaagatttagaattgccttcactcctacctcagaccttttttctgaatatatcccacatttcacatatcctccttgaaaatgtgggtcggttgaaatacatgctttcctaattagagaaaggtaggatgaattattagagatcattaacttgaaagaaattcagtttaatttcaaaattgtctccacagtgttcaaagtagcatattactcagcaaacaaacacttattgaatgtctgtgatgtaccaggcattgactgatatctgacactaaagataacagtgaacaagacagatgagagacctacatttgggaagcttacatctagtaaaagagtgctttatacaaatgtaatggattatttttctaagcatttgtatgcctaataatgatcactgtaaaaatagagctgcacacagagaacccgacggtaatgctttgtaattgaatttacacaataaaatgtgagctcttaaggactttcacattaaaaattacagatgaaagcagagcttatctctttcttcctagaactcatggaaaggagtaataaagggcttaaagacataaaaattacaaataaaccaatggaacagaatagagtctggaaacaaactcatatgtaatacagttttctggtttatgaaaaaaatgatgatgcaatgctgtaaggaaagaatggtctttcttttagtaaatcagctggacagattagttgtccctgtggggaaaaaataataatcttgacccaactccataccattcacaaaaatccattctggatggattgcagatctaaatatgaaacatcagataataaacttatagaagaaaacatgagtgaacttacttgtgaccttagaatagacaaagatcttttaaacagctcacaaggagctttagtcttacaggaaaaaaatcacttggattatatcaagaaattttgttcatcaaaaaatgtaatttcaagatattatggaaggggaagccacagaataggagaaaacatttgttctccatccctccttctgtctctctctccctctctcacccccttcccttctccttcctccgcaacctcagtcttaactttgtatggcaaaggacccactcatatctagaatttataaagagttcctccaaataagtaagctaaagatgatagcataatagaaaaatgggcaaaaagcttgaataggcagttcacaaaccaatatccaaatggccagtaagcattctagacagtgtgcaacttgattagtccgtggggaatgtaaattcaaactaccatgtcacagtgctacattatcaccagaatggctaaaatgaaagacacatagtaccaagttttggtgaagatatggggcaactgaaactctgtaaattggagtaaccacattggaaataggtttggcaacatctactaaagctgaacatattcagtgattctatttttatataaatacccaatggaactgtgaatatatgtccatcaaaagacatgtacaagaatttttatagcacctatattcataatagtccaaactgaaaaccttccaactgcacattagcagttgactagataaatattagaaaagagcagtgaaaattaataactacaactaaaatgtagcagtatagatgaatcacataaacataattgtattaattgtctacttctgtgcaacaacttaccacaaaacttagcagcttcaaacaatacacacttataatctcattttctgtggctcaggaatctggatgtagctgagctgggttctctgcttcagggtctctcacaggctacagtcaaatattggcaaaggccaggttttcatctgaaggctcaatggaaggagaggcaccagccagagctcttggcaggattcaggatctgaagacctgttagactaaggaactcagttcctagctggtgattgccaagaagctgccctcagtccttaccatgtgggcctctccaaagtagttccttactttattctagcatgcaaactgagaaagcagtagagtctgctagcaagacagaagtcacaatcttgtatagtctaatcacagaaataacatccttttacctttgctatattctgttgttggttaaagtaagtcacaagtcctttccacacccaagggctagagattacataggagtgtgaacagctggagatggagatctttggggttcatcttggagtttctccactgtaataaggataaacaaaatcaagttcaaacaggagcacaactctataatggttacccttgatgtgctagtgaatagaagagagcccaaaagcagctttgggagtgctagtagtgttccgtttcatattctacatgctgattacagaggtgtattcaatttgcaaaaagttgttcaagctgtaaactcatgccttatgtgctttaatatatagatgttatagtaatttttaaaaatgatgactgggtcccacccatctccacagatttagatttactttgcagcgttctctgtgtgatactgtgtttcaaaggcatcaaatcatgaggacaaagaacaggaaaggagacatcagcaattaagagacctcaacaagttttgggaagcagctaaatgataagtggtaaccagtttagcagagtggagtaaactaaaatctaagcctgaataggggagggagtagaaacaaaataaaaagcaagccagttcacactgcagaaccctgaaaaggcaacgaaattgtaggtaccagatacttgtgaagatggggtacaaagtggagctgagaatatggggattggttgaaagtatttatgcccatttcactcatctgccatcccactacccttgcccattttagcataattctgaagttttccctcgggaggagccaggccagagaggctctggatcttggaatttccatttggagtaaggctctagactgaacacgggaagactaactcaaagtccacacactgaagggtgaaatttccaacgttccttcttttctcagtttcctgaatgctgttagctaagtataaatgtctgagttgaaaaagaggcttattctctggagaagccaaccaaccaaagagaaaaaggcctgcacatacatttttggatcctctgatgaaattgccaggaatctgccaaataatcaccagggagcccattcgttgatgagttttgcccatatatacacaggtcccagacacattccagagcttttctttgaaatacaaagagagctaacgattgtcagatatgtgaggaaagaccagaacaggtaaactgaaaaacaaggaaataaaggcaatgtgaattttgacaaatagaagtaggaaaaaaaggcaatgtaaataacaaaagaaaaggtcacaaaatcatagtatctgaatttagagcgaagatactgtatccatgcaacaataacaggaaacttaaaaaaaaaaaaaggaaaacaagcatttttagaaattattaactatattaaaaatgaaatccaaagagtgtgtaaaagataaaattgagacaatctcccaaaatgtgtagaatagaaagatgaaaactgggagagaaaagaaaattggaggattggcctaggacgtcctatatatgaatcataggagatctagaaagattacagtcaatggaaggaggaaattgtcaaagaaaggaatcaagcgttctcagaacagaggacttgagtttctagattaaagaggtctgttgagtacccagcacagagaatgaaaatagactacaccaaggagcatcatgaatctttaggaggtcaaagttaagagaggatgtaagtctccagcaaaggggaaaaacggagtacgtacaaaggattggtaatcagaatggcagcagactttactgacagctggagatattggagcagtgtgctttctgaattctggagggcaatttctcacccagagttttcccaaactatcagtgaattcccaaactatcagtgaagtgtgagattagaatacatttttagacatacagtttccctaaaatatatactttccatgtagccttcctcaggaagctactggaagatgtgttccatctaaagtggaagatatgttcctcttttttatccaaaaaagaagtcatgggacccaggaggcagtagagaggtgcagggatttacccagagaaaggtgaagggaggttccaagatggtagctgcccagtgggtctagaaaggatcctgtccagattcaaaaaggaggatatagagttgcagaaaggattttgccaagaaaaacacaaacaggctccccaccctccagtttttaaaaaattatattacatgtctgaatgtactgagaagagatccatggtttacctgagaggttagggatagatgagagatttgtatagaaaactgagaagtactcgggaggctgaggcaaggagatcgcttaagaccgggagttcaagaccagcttgggcaacatactgagacttcgtttctaaaaaacaacaacaacaaacccactaagccatcacgacaacaaaaaaatgaggcagttattcagtccagggaaaataaaagttacataaaacatgaaatatactgatagttgtgaaaatatttacataattacaacaaacactgaattttaacatcatcaaaattggtcatatagctgtgctgaaaagataagaaggcaggattgtggggctggggagagggtggaagaaaggtaagccttcacagtccataggaggaagtcattgtataaacacctcacccagaacagtcagaactttggggggtcgtgaggcagaatctctggagacaggtttgtttaaacattggctgctgggctccaccctcatagtctgattcggtatatctggggtggggtctaagaatttgcatttctcccaaattctagagaccccactttgagaaccagggacacagaaaagtgaaggaaaataccaggaaaagaatcagttgaaagtgtttgtccctcaaagtaggaatagagagtggtacaggtgactctgtttcatttataaatcttgttaccactttcaacattttaagttatgtcctttgtattatgtactttgatatcgttttacatctttaaactttttttagagacagtgtctctctccattacctgggctggagtgcagtgtcatgatcatagctgactgcaacctccaattcctgggctaaaacaaccctcctgcctcagcttcctgagtagctgggctacaggcatataccaccctcacctggctatttttgttgttgttgttgtaaatacgtcatctcactttgttgcccagactggtcccgaactcctggtctcagtggattctcccacctcactaagtgctgggattgcaggcgtgcgccaccttacccagcgtgttttcagttttcatgaaaccaaatcagatgtcgttacttccttgcatctaaactcacgcagttcactgacagcagaaattcacgagccctcatgcagagcccatgagggcttctttttcacacggctctaacaaaatagattaactggtaggaacacagacacggccatgtaggaatatgtaaagaaacacagggctgggtgcagaggctcatgcctgtaatcgcagcactttgggaggctgaggagggcagatggcttgagcccagaagtttgagaccagcctgggcaacatagtgaaaccccatctctacagaaaaatacaaaaattagccaggcatgttggcacaggcctatagtcccagctacttctacttttgggaggctgaggtggaaggatcatttgagcctgggatgttgaagctgcattgagccatgattatgccactgcactccagcctgggcgacagagcaagaccccgtctcacagaaaaaaaaaaaggagcagcagcagcagagaacagcctgagtgtgttgcccttgagctcagcacagcactgttcttgatactcatactaaccctgactcattaagaaatggttaagtgtgtgtttaacatatttgctaagaaggggaaattgtgctgtctttatattttatttcaaaatgaaataagcagtgtttatccagaaatttcccttctatggaatatctcattgccaggttaggtgttactacatattgacttaggtctgtaatctgctgtaccctcaaaatgctctgtgtggcactaatggagacatgaatgtcctcctccaaaccccaggggttccctgagtaacccattctctcttcctttcagctctggtcccattttggcagaagaagctgtcctgaagcagaagtgtttactgaccactgagctctgagggcctgtagctggaatacgcatctctccagcattccgtcctgggatccgtttcagctagaatatgttggattcaggagcttgtccattatttgtaggtaaaaaaagctgcacgtagatttgacttcaactccgtaaaaaagacagctgtattttccgtccaactggaattgttgaatcacactgcatagctgcccaaaagagagtgtttggtcttgaactttctatacttttataaatgttacaaattcccgaaagaagggaatttctttttctggggtttccttcaaactcttggctccacctagcggttctatttgttcataacaacttcataacaagcctgcctctggtagtcaacagccttttgaaagctatttccatctagtatcagggtgagagcatccttgatctggctgcctgttagagaaattgcacttttcctgacttacctagaaatcaagaatttaggaaattaatgtggacactataaaggcagacttagggccaacttttttttttttttacaattattacaacactaaagagaagtttagaatatagagagtttttaaatgtctcccattcttttgatttcttactgtactggctatcttaatatttcaagtttacatcaagataaaccctgagaagaactacggagaaatcaaataaaatcctgtcatatttttttcaccctgcctttccacaggaagcactcacaggcaccacacacgtatcatgtaacttatcagtggggtgggttactgttgaagagaccctggggcatttacctcaggcatctgcactcctccgagcccggtggagaatgcaggctgctgtagtctcaggtaatgaaggcacagcacagcagtactccacattgtttcctatttggacatagacttcatttcctttcagtataagctgaataaatttagagctttcaaactggaaaaaaaaatgaaacaaaacaaatacaccaagaccaaaataggcaataggaacaggggtgaagggatgttgtttcttaaatacctaccatgtatgaagctatacacagcatataccgaaagaacctgcattgcactaggaattctgtgttagtttaaaagagatctctaaaacttccccatccctttgggcctgtacaaagaaattctggatgttaaaataatatatactcatcacagaaaaataaagtatagcaatgtccatctgtaattctaatacccagaaataacgctatttagctttataattttcgaatgaacaaggtaaacctcggttgccatggggaagaaggatgatgtggaaaccatattggtaaagttgttaatccctcgttatggagaactgatcttaagctatacctcctggaatttgctttctagttttctgtcctgcaatatgtatataattaagcactaatttgtactgcttagcataaaagaacatccagtcttagatccttaaaacttcatggattggactttcctgggctccttataacataatcgtgtgtccaggcaaacgcacactagtgtctgactggaaagctcaggaattttaatcttgcactgtttcccagggagctgtagtgattggaacccacgtttgcacaaaacatttttgcagaaggaaagtcaacacttcttgctggctgcctccccttagccattatgctaaaaacagcttctgagtttcactggtggggctcttgccagttcttaattataggacatattttctcaaagctgaaggtgacacctagaaccaggggcttgacccaggacatgatggaatgagcatcaaattttcagtgtcttggcaaccgtagatgtcctacagggttaccgttgtgctgctcaccacagagcagctgaggcattatgccttggaagacctaaatctcccatccagttcaggaggtgacaacatccttattttaaacttcctaaaattaggaattaggtagttggacatagtctgtgacctttatgtcgttggatacctgtattcttgacagttagaatattggtagggactttgttaaaattcacttgaatttcaagctcagaggaaactttgtctcatgccctgacatgaagtggcaaacacggaagttcatacttgaatgctgaattggccccgacagattaaatgcgtgttggggattggtttcctgtcatagctgctgctgctgccatgcgcagagctgctgtaacagctcttcctgttctgctcccctgagaacagtgtggtggggagaggcagggctgaggtggtctacgaatgtggcaggtagggaaggggagatgtctgtctcttgagaagagagaggcatgtgtgccggcatccttgatgggttcaaagagaaaggttggagatgatagtgggtgagaagcaggctggtgagactgggctgaggttggagaaggggcagccgggggcactgctgagggtttgccgtgcacgcctcggacggagcacggtggggtggcggggagcagatagtgctgcctccctgcgggcagacaggagaggaacctcaactcagtccatttcatagccctgataggggaagtgggagttgacaggatggtttaaaataagacgtgaaggtttcagttacctgctctagactttgcctgagaacttgtaaattaatcagtgagacctaatttgtgacatgtcagtagcatcatcttttgacacacaggaggtcatggtcatttcattcctactcttcaggagacactgctgaacagaggaatgattctgttccttgtgtgcttacttccttaacatttatacattgttttaagaaaaaacttttaaaaatatttcttatagtctcctaacatttgtctctagcctttgcctttgtacaatcacagatatcctatggagatttaaggatgaaagccctgagttgttcttgggttcttggatctggactacttgttatcttatgcttctcacttctggctaaaacttgcacctcttcttctcttagctaagccccaaaatgaagatttccttcagaagtcttgttagcagaattatttatcagtcacagagagaaaaatctgctatttttctaagtaagagtctcgagaagcagagtttttgtcttgtcattgagaggagtcagcagtcttgttctgtaaaggaccagagatggtaaatactgtcccactcagctctgctggcgcagtacagcagcagcagccccagcacagctgtgttcctgcggagtcccctttacaaagccgctgacccctgatgtgaaactttgtagagcagcagagtggctgcgtgaaacgggaggctggcaggtcctcagataggttctgcagtgttacctgtcacttggaggcagccaacacttctggacattgcatccttattcacacatgtggcagctgaacgaggtgctgttgtgggtgtctcagctctgagggtctttgtgagctcccactgttgtgggtgtctcagctctgagggtctttgtgagctcccactgttgtgggtgtctcagctctgagggtctttgtgagttcccaccaacttttaattattcatgcccttgaccatgtggttgcttggagacctggggtcttctgcagactgaagaagacacatttctagattatttgtcctttttatcctctcaaaaatttaaacactgtacctcttcagtggtcagaagaaagttggaaacttttcctacatattaggcgttagtatgaggacatttgtttgaattatagaaatttgccctgagctgaactgggttgtgttaacacattggtagagctatgattccttcccagttctaagagatacgatctgtaagtccctatgtcaccacattgcttgagatgatcattcagttacttgtcaggatttctcctcttcagagagatttttttttatagcacagattcctttgccccttttatctccttatctggatatgataagtggttatgagggtctcactaactattttgtgtttaccttttatatgtgtaaaactttgcagtagcatttaaagtgtaatttatttttctatcaagtgcactattcatttagtgtgttccagttttatatgacttgtattagaaacactgcactgagttgtttgtacactgaaatgagaactctagatgtaactctattcaaataaaccttcgtgagacattcatgtttttgtgcactgtttctgtttcttggaactgtgattcctacatgctgacctcaacagagttagaccagatccactgttggtacaaacctgaggaagtgagcagaagcagccgcactgtttttaggttgatttccatgtttttgtggtgtaaatttgggagtaggggcattttcaaaggttgaaaacctcattggtcatccccagcatatcctggaaggcacggtggtcattccaaggacagcatggtgcagtatcaccacagctttggacatcggatctgggctctactgcttaatacctcaggttttttgtctgaaatggcacatgaagtgtgtgtcacagcgtgtggtagagtatgcaggtgttgacttctccttctcttggcgcccaccagtccccagccttctctgggtttgcactgcaccatccagcgaggaacagtgccacctgggttggtttcaggacttctgctgggcagagtcatactgcaccatatgggtgttggcaaagctgagaaaagttggaagtcttctctttccctctcccctctgttttctgcctgggagagaggcccagttgggccctggaaactaaggagcttttctctgctttttggagatgtatggagaggggctggaacccagatgcaatcacctgtaccaggagctcttctaagaggaagtttttggcaataagtaatgaaagccaccaataagtagcgaaaacaactcactggagagataaggactgacaggaagatggaggatgggcagcagtggaggtggagggagtgtggatggtgtctccacaggtgctgcctttagagggcaccctggccaggctgtggttccccagaaggaaggggaatggatactgggctaccaaaataaccaaaaaataaacccattgtgtcacccagaatgggcttttgtggccagcaccaggcctggaggggctaagagggtacagatctcaggtcactaaggttattgtcaggcccaagaaaaagaactcaccattagtttggtggcagggtggtgagtcagagtgatctgtctctggccccatccttgtcccagcagatgttcagcccactgtgcttagattcccaggctcgtcctgaggagagaccagcggggtggcagagcagcccctcccccacagcagggaaccctctgcagcccaggctggcgtatccttcacacttgaagtgcaccagtcaaggataacagtcagcacatgctctcaagctagcaaatcatgatgttagggcaggaattgattttcaagattaccagtcccagcccctcagtatgtagataaggtcaagagagggacaggaacttgccctaggtcacatggctagggatggaaattcaagtctgtgcatccaggacatcttccctcagcactgcttgtcttggctccctaaactagacttgcagcaaatagtagtctgaatctgctatgtccccaaggcccttccaacctgcatccagaatttccacaggggaagtcaatctattcaaatcctcatggctccaagcagtacctccccaaaggagaagaaaaccataacatggatctggagggagcttctgccatccttcagggttcccgagggcctgaaatagcccttcctcttgcctgggttgtagccgataccctttaccttggaatgatctttccgtttaccttgtgctgtccccttaagagctctgagtaccatttaggtggtgaattcataggtattcacgggaaagctgcaccatctccctggaaactctcacttggtttgctgctgattcttaatcttgttccaggttaggaactcttgcaaatacggaagcatggcagctttgcatgcaatttcatgtgcttggccatgcatggtggctcacacctgtaatcccagcactttggagaagccaaggtgggtggattttttgagcccaggagtttgagaccagtctgggcaacatggtgaaaccctgtctctacaaaaaaatacaaaaattagccaggcatgctggtgagcacctatagtcccagctattcaggaggctgggaggatcgcttgagtccaggaggttggggctgcagtgagctgtaatccactgtactgaagcctgggcaatggagtgagaccctgtttcaaaaaaaaaaaaaatttcatgtactcattgatcccccagggattctcaggttggaagccctgctcagtggactaacaatgggaatgtcaggccaaggagctgttgggatggagtgggcagagaaacaggcaggcctctggggcagctggcaactcctcttagctttggtgagtaatagacgctcaagaaacgcatgttcggtgaagccttcaaaacatacaaagttctctgcctaaaagattaaagcacacaacacttttaggccagccattttatatgaattagtactgaattacaacatactacaccctgttggaactccatccaccaatccctctgccttatccttgtaaaatggggatgattctaatacttcctcacagtgtgggaagttaaatgagttaatactgcagagtgcttacaagtaaaagtgctaacaaatgtttccagtgtgagttcttgccattatttatggtgatggtggtctgttcttagccaatcttaattgctttgcgttcttcccacccacatggtgaattaccatcactggagagatccagccaccatttctgagggcctggtctcagctgcaggagggaaagcacccacagagcagattcctggtcacaacttcttgggtccacctcacctccaggactcagttgcctgctctgtttgtactccagggctccatggcagctgtctcatagtctccactctgtccctcttcaggggcccctcatactctaagcaaatgacctcatgtctaccttgcagattaaagcagaaagcatcaggcaggagcactctcagcagcccttcctgtgtctgcacccacgtttcctcctccctccctgtttaaatggacgtgctcattccacagcttgtgccccgggtccctgaccatctcccttctaaggggacttactctgtggatctttttcctatctcctgtatctttatgctatgcttcccctaaacaccgtttcactataaaattgaaacctttccaaatatttccccccttaagacaggcaatagaaagttctctttctcacagctccctctggtgtcctccatgttctctccttcacagccacacttcctgaatgggttacccgctgtcctgagtacagccacagtactcaggccttcttggcctggcctcatgacagcattccatgtcctcttttcaaccacccctcttttcttggtttattggttaggagagggtagattacactgtagtcatgacctagaaaatctcagtggcttacaagggtcaacaacgtcatttgcagggcctactgcaaaatgaaaatgcagagccctatttaaaaattactgaggatttcaagatggtgacagcagagcattaaaccaaacccaggacccttctcagtgaccgacatccacagaaccagctctgcttacgatgaagttcatttctcatgccacatttcaattgcaagtgacaagagggctttctgctcaaagccacgtagagacccacgtcaagagacttgacgtgtatttatgatctcagagacaaggaaccacacttgggcttgtcatatttttgcctacaagtgacacacatcacagttgcttgcattttactggccagaacaaatcactcaggtgtgtctgagttcaaaaggtgggcagggcactgactatttggtgaagtaatatagcatcctacatgtggtttaacaccaacttttcctggttattctgccagtctgaccactacttggtatcctttgtctgactttcctcttctgcctgttccttcaaagctagggaccctccttctcggtcccacctgttctcattctcggtcccacctgttctcattcccacactcctgaagcttcacatccatccatgtgctggtgcctcctaaatccctgttacccagatctctgcctggattcccattcctacctagttccatttggatttcacaaaagcaccttagactcagtatatcttaagccaaacttaaaagtcttctgccaaagcccccctcccctccacctgccaaaattgctacttctcagtggcctgatctcattgaactatctgaactgactttgatttgtgtttctcctcccctgtctgatcagtcttcaaatcccactgagtctgtctctgaaatacctccttatctctgcagctacatcccttgagtaagtcagcgtctggcctgagctactgcagttaccttcccattggtctccctgcactcagccagtccaatccattttccgatctatagccagaaataggtcatgatcctcctctgcttgaattccctcagtggcttcccattgccttgaaaacagaacccagactctctatggcttccacggcatgttctacagctctccctcatgactgggcctttcctcattctgccaagaacttggttctccaaggtattacctcgagggtccttgttttggggtcaggtcacatgtcacttctccagatatccctctgagcaccccaatatcagcctgtccctctttgcaattgttacttgtttaactgtcttcctcagtcatataagctcatccattgcagcatctgggtacccagcacgctgtctgccatgcagttggtgctcacatatttgtcaaatgaatgctgaattgattaagcactcactatgttcctctttgtttcctactaggaacttaatttaggtttccccatttggtactctttatcaaaacatgttaggtgcttacaaagtgccagcaagtcttgctgccagtaggtgttggaccaggatttgaacaggtctgtttgactctaatgcctgagttcagcatttctcaaacatcaggcattcacacataagtgaccaatcatcctggtttcccctgggctgagagggttcctgggacatgggactttcaacacacacaaaaacaggaatgtccagggcatacccgggaccatttgtcactctattcaccaccgtcacaatctttgccacatgtgtgttagttacttaatgttcatatttttatatttttgctttttttttttttgagacagagtctcactctgtcgcccaggctggagtgcagtggcgtgatctctgctcactgcaagctctgcctcctgggttcatgccattctcctgcctcagcctcctgagtagctgggactacaggcgcctgccaccatgcctggctaattattttttgtatttttagtgtagacggggtttcaccatgttagctaggatggtctcgatctcctgacctcgtgatccgcctgtctcagcctcccaaagtgctgggattataggcatgagccaccgcgcccagcccatatttttatattttatcaacttcctttcacatagcctcatcctaaaatgtaaattacagcttttaatgggctatttgtattttttctaatatgcatgtaaaaacaattattaaaatgaaaaatgtttcatctgtatatcacatgaaaccatctcaaacatccccaggggttggcttgccacactctgggaaaccctggccaacccatgcactgccccaggcccatgaactgtttttccttccggcttctgagctctcctgcagaagcactgtgctagcccctcctatagctggagtgtcagcactgtgcctgctatgatacgtaggttagctctttcagtggccacagccactccacaaagatggttatcacaaagacatagatgagcaacctaaacctggggagggggggacagttggtaagctgcttgtctggggcaacatggatggtgcttatcatattcagtatataaacctgggtcagccatggtctatctcaggcaaggccagaagcatgggcatagcttcttgggcaggcctggttgatttgggctagccttggaactcttcatctgtctttttctcaaatatgatctacagctgttgtcctgagctctttgacctctgccttgacacttcccatcaactgaaaactgcctgcattcacaccagccctctccgccaggtccatttctgggccactacagaaggtcctgcttccactgaacccactcagataacctgctttgcagctcagcataagagtatgtgcacatggcttcacagtattctgtgacttcctctcctgtgcagggccgggtctagggtaaaataattgagatgcctggagcacaagatggaagaggcttccaagacatgctaagattttgagagaacaatcctgtcactggctttgagatgcttcagtctagtttccagaggttcagggaaactgggggtctgggaggcgaaacttattagcataatgaaatatatttttccttcattttgttgacatttgcactgatagcacaaaaacaatgctgggtaaaactggacaccttcaacataccagaatctctgggacacattcaaagcagtgtgtagagggaaatttgtagcactaaatgcccacaagagaaagcaggaaagatctaaaattgacaccctaacatcacaattaaaagaactagaaaagcaagagcaaacacattcaaaagctagcagaaggcaagaaataactaagatcagagcaaaactgaaggaaatagagacacaaaaaacacttcaaaaaattaatgaatccaggagctggttttttgaaaagatcaacaaaatttatagaccactagcaagactattaaagaagaaaagagaaaagaatcaaatagatgcaataaaaaatgagaaaagggatatcaccactgatcccacagaaatacaaactaccatcagagaatactataaacacctctacgcaaataaactagaaaatctagaagaaatggataaattcctcgacacatacatcctcccaagactaaaccaggaagaagttgaatctctgaatagaccaataacaggctctaaaattgaggcaataatcaacagcttaccaaccaaaaaaagtccaggaccagatggattcacagctgaattctaccagaggtacaaagaggagctgataccattccttctgaaactattccaatcaatagaaaaagagggaaacctccctaactcattttatgaggccagcatcatcctgataccaaagccaggcagagacacaaccaaaaaagagaattttagaccaatatccttgatgaacatcgatgcaaaaatcctcaataaaatactggcaaaccgaatccagcagcacatcaaaaaccttatccaccatgatcaagtgggcttcatccctgggatgcaaggctggttcaacatacacaaatcaataaatgtaatccagcatataaacagaaccaaagacaaaaaccacatgattatctcaacagatgcagaaaagtcctttgacaaaattcaacgcttcatgctaaaaactctcaataaattaggtatcgatgggacgtatctcaaaataataggagctatctatgacaaacccacagccaatatcatactgaatgggcaaaaactggaagcattccctttgaaaactggcacaagacagggatgccctctctcaccactcctattcaacatagtgatggaggttctggccagggcaatcaggcaggagaaggaagtaaagggtattcaattaggaaaagaggaagtcaaattgtccctgtttgcagatgacatgattgtatatctagaaaacccaattgtctcagcccaaaatctccttaagctgataagcaacttcagcaaagtctcaggatacaaaatcaatgtacaaaaatcacaagcattcttatacaccaataacagacaaacagagagccaaattatgagtgaactcccattcataattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaacatcgtgaaaatggccatactgcccaaggtaatttatagattcagtgccatccccatcaagctaccaatgactttctacacagaattggaaaaaactactttaaagttcatatggaaccaaaaaagagcccgcatcgccaagtcagtcctaagccaaaagaacaaagctggaggcatcacgctacctgacttcaaactatattacaaggctacagtaaccaaaacagcatggtactggtaccaaaacagagatatagaccaatggaacagaacagagccctcagaaataatgccacatatctacaactatctgacctttgacaaacctgacaaaaacaagaaatgaggaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaactggcaacctacaaaatgggagaaaattttcgcaacctactcatctgacaaagggctaatatccagaatctacagtgaactcaaataaatttacaagaaaaaaacaaacaaccacatcaaaaagtgggcgaaggacatgaacagacacttcgcaaaagaagacatttatgcagccaaaaaacacatgaagaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccactgtggaagtcagtgtggcgattcctcagggatctagaactggaaataccatttgacccagccatcccattactgggtatatacccaaaggattataaatcatgctgctataaagacacatgcacacatatgtttattgcggcactattcacaatagcaaagacttggaaccaacctaaatgtccaacaacgatagactggattaagaaaatgtggcacatatacaccatggaatactatgcagccataaaaaatgaggagttcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacacaccggggactgttgtggggtggcgggaggggggagggatagcattaggagatatacctaatgctaaatgaggagttaatgggtgcagcacaccaacatggcacatgtatacatacgtaacaaacctgcaagttgtgcacatgtaccctaaaacttaaagtataattataataaaataaaataagagaaaaaaaaaacatttaaaagacaagcaaacaatgggaaaatcctctaagtcatatatactatacttagcccctaggtgctgtgatggaagacatataggtactggttcaatgtttatattaagagcttcataatataatgtgaaaaaaatgagtgtactcagataagataactgtgcattcaagaaaaaaaaaaaaaaactgggcaccttggcaaatcaagagcaatggcaccaggctgtatgaggagtccactgccatttggtgggggttttagagagcctgaagtgaagatttggaattggaaaaatggaaacagctctgaaaaacagattttatggaaattgagtccaaaagggtcaaaacagctgctcacagaagtgtgtggaattttcactctgttgtcacattgcttaaaaggccataaagctaaagatttacttggcttaataaggctcttctttcatcagttatttcctggatgacatggccttagtatgacacacaaagttccactccactggagggggaggcccttccctggcctgcatgtagacacaggttgtgtagggatttggggttgcagggggggcgatgatcaggccatattgaaacctggtgacttgtgaagggagggcagtcttggtaaagtatcatagaggacagactttgaagcaaatgaggatagtgaagtccataaaatagaaacaatctgagataggcaagcaccaaaaataaacctgagttcatagcagccgtattaacaatagtttaaaggtcagaatagcccacatgtccatcactggataaatggataagcaaaatctgatgtatctgcaatggactattattcagccacagaaaggaatgaagtactgctaaatggtatgacatggataagccctgaaaacattatgctatgtgaaacaagccaggcacaagaggtcacatatcgtatgattccgataatatgacatatgaaaagtaggcaaatccatagagaaagaaaagcatattactggttcccaggagcagaagggtggggaatttggaacaagtacttaatgagtcccctttggcggtgatgaaaatgtgttggaacttgatagaggtgatggctgtacaatactgtgaatgtactaaatgccactgaattgtacacttttaaataatttatgttttgtgaattttacctcaataatacaaaaacactgaagtgagagcaaggaaaattaccaggaagaaaggcagacattacataatgatgaaagagtaaattcaccaagaagacataatcccaaatgggtatgcactaaacaaaagagcttcagaatccatgaagcaaaagctgatagaattataaagaaaaatatacagattctcaattatagtcagaaatatcttcaacacccctctcaatatacagaaaatctgtaaggatataacaacttggacaatactatcaatcatcctgacctaattgacgtttataaaacacttcacctactagcactatgatgcacatcattttctagtgcacattgaagatttaccaagatagattgtgttctgggccatgaaacaagtctcgataacttttaaaagattcatatcgtgcaaagtatattatctgacgataatggaattaaactagaaatcaatgacagaaaggtatcaggaacatcctctggtatttggaaatgaaataacccacttctaaattacttactggtcaaagaagaaattaaaaggaaaattaaaagtattttgaaatgaatgaatataaaaacataaaaatctcaaaatttgcaagcagcagctaaagtagtacacagaagaaaacttatggcactaaaggcttatattaggaaaggtctcaaatcaatgacctcaatccttaccttacgaaaacagaaaaatgagaaaagtaatgaaatccaaaataagcagaaataagggcacactaaagagtagaaatcagtgaaaaagaaaacagaaaatttatagaggaaataaaagtcgccaaagatggttctttgagaccaataaaattcataagcctctcatgagttaaatcaggagaaaaaaaaaaggagaagtcacaaattactaacatgaggaatatgagaggtgatagaactacagaatcatcagaccttaataaggatagttagggagtaccatgaaccttttatgccaatgcatttggcaacttagaataaataacatattccttgaaagacacaaagtacctgagggactgatgtaaggtgctcatctctgttttacctaacttggaattcaggccagaagagcagtgagcatcactcagaaattcttcaagcagaactaacaaccctcagacacctggagccaaagataatagttgaaacacataatagactgcctgtgtcaaaactggggaaaatttctttgggaaattaggacattcaaggcagctgtttatactggggaagttagaaagccacacatgtgcccagggcaagacccatgctcagaaaagacctaaattttcccctggggcttattcctagacatagtgcaagccatagtgcaaagaaaatgcccaaaatgttaaaggagggtcctaggacacagtgaatttgcaaggcctgggagagatacttttactttttgtctgtttgttttagctcctggcactcaaagaaatctgtcaaaacactagctgaacacaagtgaccacacccaacaagaattattacagtctttccaataatattttgagcaagtcactaaacaaatggactactatgtccttcaccaattaaaaaaaaaaaaacagaaaaacctgagcaaaggggagaatttgatatccagagttaatacattataatatttcaatgtccagttttcaagaaaaaaatcacaaggcatacaaagaggaaaatatggcacattcagaggcaataaatatacaacagaaatcatccctgaggaaggctagatgtcagaaattctagactttcttaaatatgctcaaagagctaaagacatggacaaaacactaaaggaaaacagaacaactatgtatacaaaataagaatatcagtaaagaggtggaaataataaaaaggaaccaaacaaatgctggaactgaaaaagtacagtaattgaatgaaaattcactagaggggtttaatagcagatgtgaacagacgaaagaaagaatccgtgaacttgaagataggacaattgaaattatcacatctgaggaacagcaagaaaaaagaatgaagaaaagtgaacaaatcctaagggacccatgggactccatcaagcagaccaatatacaaataggagttcctggttggcctgaaggtagtgattcatctcaaatgattgttcacagtcagtcacagattgaaatccttgttctactttttcttcccttctcactactgtacttgactagtctttttgaaaaaagaaaaaaacaaataggaattccagaaagaggagagagagaaagagtcaaataacatttgaggaaataatgcccataatgccccaaatttgatgaaagacataaacctacaaacccaagaagcttaacaaactctgagtaggataaactcaataagaccacatcagacacattataatcaaattgcaactggatcccttccttacaccttatacaaaaatcaattcaagatggattaaagacttaaacgttggacctaaaaccataaaaaccctaaaagaaaacctaggcaataccattcaggacataggcatgggcaaggacttcatgtctaaaacaccaaaggcaatggcaacaaaagccaaaattgacaaatgggatctaattaaactaaagagctttgcacagcaaaagaaactaccatcggagtgaactggcaacctacaaaatgggagaaaattttcgcaacttactcatctgacaaagggctaatatccagaatctacagtgaactcaaataaatttacaagaaaaaaacaaacaaccacatcaaaaagtgggcgaaggacatgaacagacacttcgcaaaagaagacatttatgcagccaaaaaacacatgaagaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccactgtggaagtcagtgttgcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactgaattaagaaaatgtggcacatatacaccatggaatactatgcagccataaaaaatgatgagttcctgtcctttgtagggacatggatgaaattggaaatcatcattctcagtaaactatcacaaggacaaaaaaaccaaacactgcatgttctcactcataggtgggaattgaataatgagaacacatggacacaggaaggggaacatcacactctggggactgttgtggggtggggggaggggggagggatagcattgggagatatacctaatgctagatgacgagttagtgggtgcagcgcaccagcatggcacatgtatacatatgtaactaacctgcacattgtgcacatgtaccctaaaacttaaagtataataataataataaataaataaaaataatcaaattgccaaaagcaaaagacaaatggagagtctttaatgcagcaagagagaagtgacccattacacacatgtgaataagatttatggccaatttctcatcagaaactatggaggccagagatggcagtatgacatttgaagggctgaaagaaaaaaaaaaactgtcatccatatagaagaattctatatccatcaaagccgtccttcaaaaatgaggaagaagttaagacatttccagataaaattagagggagtttgttaccactagccttgccctacaagaaatgctaaaaggagtccttcagattaaaaggaaaagatgctatattaaaacatcacattgtgcactgtgaatatacaaaatttgtattcgttaattataccttaataaagcgggggacagggaggaaagatgccagacagttgcttaaagtcatatgaagaagtaaagatctccagtaaaggtaaacatatgggcaaatataaaagtaggtattattataacattagtttgtaattccactttttatttcctgtagaatttaaatgtataaaaataattataaatcaatactgagcacacaatatataaacatgttaattgtgatgacaacagcagcatcatgaaggaggacagaatggagctctccaggagccaagtttttatatgctattaaagttaggttggtattaatttaaaatagactgttataaattgaggatgccaaatgtaatacccatgctaatcacaaagaaaatatctaaaaattatacaaaaaagtaaatgagaagggaatcacatggttcactacaaatagtcaaccaaacataaaagaaggcagtaatggaggaaatgaaggacaaaaaaatgtataagatataacaaaaccaaatagcaaaatggcagaattaagtttttccttatcaataattactttaaatagcttaaactttccagtcaaaaagaagattggcagaatggataaaaaaaatgattcaactatatactgtctaaagagtcactttagattcaaaaatacaaatagactgaaattgaaatgataggaaaagatatttcatgcaaatagtaaccaaaagagagcaggggtggctatactaataccagaaaaaaattgactttaaatgcaaattgttacaagagacaaagacattatatattaataaaatggttaattcattaagaatgtattagtataacaattataaacatatatgccccaaataagaggtcacccaaatatatgaagcaacactgacagaataatcgggagtaaaaaattctacaataataattggagacttcaatactctactttcagtaatagggagaataactggacagaatagcaataagaaaacgctactttcggccgggcatgttggctcatgcctgtaatcccagcactttgagcggctgaggtgggtggatcacctgaggtcaggagttcacaaccagcctggccaacacgatgaaaccctgtctctactaaaaatacaaaaaataagctgggagtggtgcgcatgccttaatcccagctactcaggaggctgaggcaggaaaaacgcttgaacctgggaagcagaggttgcagtgagccgagatcgcaccattgcactccagcctgggtgacagagcaagactgtctcaaaaaaaaaaaaaaaaaaccccaaaaaactctattttcaataatagaatatctagacagaatagcaataaggaaatagaggatgtgaacaacaaaatagaccaataggacctaacacacatatacagagcattccattcaacagcagcagaatgcacattcttaagtacacatggaatattctccaaggtaaaccatatagtaggccatgcagttgactgaatgttccccccaaattcatatgttgaaagcttaatcccagtgtgatgacatttggaggcgaggcctttgggaggtaattaggtcatgagggtggagccctcataaataggattaagtgtccttataagaagagaccagagagctagagagatagctagccctctttccatcatgtgaggatacaatgagaagttggcagtcagtttgcaacttagatgaccagaatccaatcttgctggtacctagagctcagatttctagcctccaaactgtgagaaataaatttctgttgcataaaagccacccagtctatggtcctttgttatagcaattcaaactgactgtgacaggcaaaaaaacagttctcagtaaatttaaaagtatttaaatcaagccaggcattcatgcatgtagtcccagctacctgggagactgaggtgggaggattgcttgagcccaggagtttgaggctgcagtgagctatgattgtgccactgcactccagtctgggtgatggagcaagacgctgtctcttaaaattctttttaaatactgaaataatatcttctctgaccacaattaataaagctaaaatcaatagaagaaaaattggaaaatgtaaaaatatgtggaaattaaaacactttaaaatcaaccagtcatcaaagaagaaatcacaagggaaattagaattgctgagggaaagatatagctgtaaatgcctacatttaaaaagaagaaagatctcaaatcaataacctaactctatagcttgaagcagtaggaaaagaagaaaaaactgtacttaaagctaccaggagggaggaaataatgagaattagagtagagataaataagagaatagaaaacccagctgggcgtggtggttcacacctgtaatcccagcactttgggaggcctagatgggtggatcacaaggtcaggagatcaagaccatcctggctaacatggtgaaaccccatctctactaaaaatacaaaaaaattagctgggcatggtggtgggtgcctgtagtcccagctacttgggaggttgaggcaggagaatggtgtgaacccgggaggcggagcttgcagtgagcctagatcgcaccactgcactccagcctgggtgactgagcaagaatccgtctcaaaaaaaaaaaaaaaaaaaaaagaaaagaaaacaatagagggaatcaacacaaccaaagattggttctttgaatagatcaacaaaattggtaaacctttagttagacttagtaaaaatgagagaagacacaaataactgaaatcagaaatgaaagtgggaacagtaacagttctattactaccaacctaattaaacaaaggattataagagaatgctacgaacaattgtatgccaacaaactggataacctagatgaaatggataaaatcctagaaacacacaactcctcaaaagtgtatcatgaagaaaatcctggataatctggatagatctataactaataggagattgaaacaataaagaaaagaacaaagaaaagtctaggatcagatggtgtcactgctgaattctatcaaacatttaaagaagaattaacaccagtccttctaaaatcttccaaaaaaatagaagaggagggaatacttcctaattcattctatgaggccaacattgccctgataccagaatcagataaagaaaatcataagaaaattacagaccaatatcccttaagaatatagatacagaaatcctcatatgaatattagcaaactgaagctgagcacggtggctcatgcctgtaatcccagcactttgggaggccaaggcgggcagatcatgaggtcaagagatcgagaccatcttggctaacacggtgaaatcccgtccctactaaaaatacaaaaattagccgggcatggtggcgcacgcctgtagtcccagctacttgggaggctgaggcaggagaatcgcttaaacccaggaggcggaggttgcagtgagccgagatcacaccattgcactccagcctgggtgacagagcaagactctgtctcaaaaaaaaaaaaaaaaagaaatattagaaactgaatccaacagcatattaaaatgatcacacacaatgactaagtggaatttatccaagaatgcaagggtggttcaacatcagaaacttaatcaaaataatacatcacattagtagaatgaaaaaaaaaatcacagaatcatctcaattgacacagaaatggcctttgacaaaagctaacactgtttcatgataaaaacacttagaagtccaggcacggtggctcatgcctgtaatcccagcactttaggaggccaaggcgggcagatcacttgaggtcagaagttcgagaccggcctggccaacatggtgaaaccccgtctctactaaaaatacaaaaattagccatgcatggtggcacatgcctgtaattccagcttcttgggagcctgaggcatgagaattccttgaacttggaggtagcagttgcagtgatctgagaccacgacactgcactccagcctgggcaacagagtgagactgtgtctcaaaaaaccaaccaaccaaccaaacaagcaaacaaacaaaaaaacccactcagaaaacgagaagtatatggaaacttcttcaacatggcaaaagccatatatgaaatacctagagctaacatcatactcaatggtgaaagactgaaagatttttctctaagatcagggtcaaaacaaagatgtgcactttaccactgctattccacgatgtactggaagttcttgccagagcaattagacaagaaaaagaaatgaagggcatccaaattggagaggaagaagtaaaactcaattcgcagatgaaaactcccatatatagaaaatcccaaagaatctataagaaagccactagcactaataaatgaattcatcaaagttcaagggtacaagatcaacacacaaaaatcaattgtggttctatatatctgcaaggaacaatctgcaaatgaaatttagaaaataattgtacttaataataccatctaaaagaataaaatacctagaaacaaattttacccaaaagatgactttaaccaagaagatgaaaacttacacagtgaaaaattttaaaaatggctaaaagaaattaaagaagacctaatgaaatggaaagacatcatatggtcataggaagatttgatattgttgtcagtactacccaatgctatctacagagtcaatgcaatcctactcaaataccaacagcgtttttgcagaaatagaaaaactgatcctcaaattcattaaaaaaaaaaaatccccgcaaggcattaaaacacacacacacacacacacacacacacacacaaacttgaagttgccaaaacaatctgtaaaggcagcacaaagtcggactcacacttcccaatgtcagaacttactacaaagctacaataatcaaaacaggtttggcataaggatatatggtccaatggaactgagagtccagaaataagctcatatgtctatgactgatttttgacatgagtgccaaatggtgaaagaactatcttttcaacaagtggtactgtgacaactggatttccacttgaaaaagaatgaggttggcctctcccctacatggttcataaaatcatgtaaataaaatattcatagaattattgatcaatggatcaacaatctaaatataagaactaaacttgaaacacctggaagaaagcataggggtaaatcaggtccttggagctggcaatgggttcctacatatgacaccaaaagcatgagcaacaccaacaaagaaaaattgggctttatcaaaattaaaaacttttgtacatgaacggacattaccaagaaaagttaaaagacaaagtacagatgggataaaatatgcaaaatatataattgataagagatgaatctccaaaatacataaagaacaacgctcaacaaaaaaagataaacaatccaattaaaacacaggcaaaggtcttgaatagacatttctctaaagaagatatgcaaatggccaataagcacataaaagatgtcaatatccttaatcattaggataatacaagtcaaaaccacagtaatacaactgcatcatctactaggatagctatacattttattttatttattttattttatttattttattttattttatttttgagatggagtcttgctctgtcgccaggctggagtgcagtggcgtgatctcagctcactgcaacctctgcctcccaggtttaagggactctcctgcctcagcctgccacatagctggcattacaggcacgcgccaccaggcccagctaattttttgaattttagtagagatcgggttttaccatgttggccatcatgaggtctcgatctcctgacctcatgatccgcccacctcggcctcccaaagtgctgggattataggcgtgagccaccaggcccagccgctatacattttaaaaaaggaaaatgttgatgaagacatggagaaatgggaaacctcatacattgctggtagtaatgtaaaatggtgcaggtgcagccagtgtgggaaagagtttggcagttccctaaaaagctaaacatagaatttccatatgattcagcaatcctcccccaaagcatatgttcactagagtttaaaacaaggactcaaacagatacttgtaagtcaatgttcactgcagcattattcataataaccaaaaggtaagaacaacccaaatgtccattaatggatggatggataaatatacaatggatataccacatgtacatcctacaatgtgtgtgaatcttgaggacattatgctaagtgtgataaaccttatacgaaatgacaaatactctattattccacgtgtctgaaatatctagaatagtgaaattcatagcgatggaaagtagaatagaggttaccaggggttggggaaggaagggaatgggaagttgttgtttgatgggaacccagtttctgtgtgggatgatgaaagggtttagaagtggatagtgctgatagtcgcacaacaatgtgaatagaatcaatgccacagaatcatacgcttaaaatgcttaaaatggcaaatttcataattatatatatacacacacacacacatacacacatatacatatatacatgagtgtgtatatataaaactactcggccaggcacggtggctcatgcctgtaatcccagcactttgggaggctgaggcggttggatcacctgaggtcaggagttcgagaccagcctggccaacagggtgaaaccccgtctctactaaaaatacaaaaaattagctgggtgtggtggtgctcacctgtatttccagctacacgggaggctgaggcagaagaattgcttgaaccccagaggcagaggttgcaatgagccaagatcatgccattgcactccagtctggatgacagaatgagactccatctcaaaaaaaaaaaaaaaaatacacacacacaagcacgcttacaatggtatgtgacccagttgaggccagtgagatgggagaaactggctaagggcttcgggggaacatttcctcattcctagtgagagctgatggatgagacgtggtctctcctgtttctctggacctggtctctggaactgctgcagccatcttgtgaacagactgagaattaagccaacagggggccacagacagatagatgtgggtacctgaggatgtcatggagctactggacagcctaggaaacatggtgagacctgtgtctactaaaaatcaaaagcattagctgggcatggtggcatgcacctgtggtcccagctacttgggatactgaggtaggggaattgcttcagcctaggaggttgaggctgcagtgagccatgatcacattgctgcactccagcctgagcgacagagcaagatcctatgaaaaacaaaaacaaaaaaatgctactggaccagcggactgctatgaagtcagtcctatctgggctttacagtttcatgagatgattttcttatttaaaaaaaaaggaagtgttggaggcaattaataaagagctcggccgggggcggtagctcacgcctgtaatcccagcactttgggaggccaaggtgggcggatcacgaggtcaagagatcgagaccatcctggccaacatggtgaaaccctgtgtctactaaaaatataaataaaactagccaggcgtggtggcacatgcctgtagtcttagctacatgggaggctgagacatggtctctcctgttggggagaggctgaggcaggagaatcgcttgaactcaggaggcggaggttgcagtgagctgagatcacgccactgcactccagtctggtgacagagcgaaactccgactcaaaaaaataaataaaaataaagaactcaaaaagtccaactctttccttaagcttaaaatagataatttagaaaaaaacctgaaagatgagaaatctaaatgtttagacaaattggtctgatgtctgaccttaccagatcaagaagatgaatgaaaacctcctatttcaagtagctgcaaccaaagcaaccttcaaaatccatcaaaagaaagagcaagtgcactttgagaggctgagatgggcagaccacctgaggtcaggagttcaagaccagcctggccaacagggtgaaaccccgtctccactaaaaatacaaaaattagctgggcgtggtggtgcatccctgtagtcccagctactcgggaggctgaggcaggagaattgcttgaacccaggaggcagaggttgccatgagccgaggtcacaccactgcactctagcctgggcaacagagtaagactctgtctcaaaaaaaaaaaaaaaaagcaagtgtagacaacattagaagatgctttggaggccaagttctttcttcagggaagcctggcactgccctctggcaaggccaaagaatggagaggaagaatgagcaagcttacgccccagaaggaatggctaggaggtaggagcttgggtttagatgtatcgaaggagagatgacctagaaaatgaaccaaaagcagttttaaaaaaatatgtgtaggctgggcgcagtggctcatgcctgtaatcccagcactttgggaggccaaggcgggcggatcatgaggtcaggagattgagaccatcctggctaacacagtgaaaccccatctctacaaaaaatacaaacaaaattagccgagcgtggtggtgggcgcctgtagtcccagctactcaggagactgaggcaggagaatggcgtgaacccaggaggtggagcttgcagtgagccgagatcgcaccactgcacttccagcctgggcaacagagcgagactccgtcaaaaaaaaaaaaaagtgttgatgtggctgagttatatacttatttgaaaactcttaggggaaaaaaagaaactcaaggaatactaaattaactgaagcagctaaaataatggattgcttcaagaccacgtgaaaaaaaatctccaaaccgagaaatccatactgcagtcagaaaagcacagttagaaggggaggggcagaaacaattctggcagaaacttcaagtcctttctgaactcgtgaaaaagaaatgaattttcacccaatactcagtctttccaaagcagcaagcagtccctgcattcccagagtgactttgggggaagtcagaaattgcacaagtgattatggtaaagactgaagagtgttccagaaagaggacctatagggcaccccgcggatgaagtgcaattatgtaacttcctagcgtgcacgtcatggatcattacagggacccgggcacctggacagggctgagtggctctggggcaccttgtttctctaggctgcaggaagcctccaggagtgccgctgctcagccctccactgcaggcactgacccgcctcccctggctgaagtgggaaagactgaggttagccaagggtctctgtcctgaacttgcctcagtgaccaggaagtcagtccagcccctccaagtcacaggcagcagcaggacttcctgcctgggcttgtgtggtggggaacacacagcctttccctccctttccaggtcccagccatcactttcccatgctttgcttgtgcttttgaactgagcccatcctgtcacataaaaacacatcaggacggcctgtgagcccaaagagggtacagtaagtccccctggggtagcactggggtgaggaggggctgctgcagttggtccaggtccccacaccactgcactgagccaaggttccatgattccagcctcctggtacttctgggatgagagggccactgggaaacgaaggtgctcggcctgcgagggtgacagtttgtgtctgctctagagagggtggaaggcaaagatgtagccccagggcttgagggcagccaggacctgccgctgggggagctaaggagcctcaggccaccctgggctggagagcccaggagttctcagccatggctaacaggtgggtgacacgttctggaggactgggttgtgctgtccaggccaggctcctgctggtcagagggccagctccgctcatggccccagccacagctccctctggctgaaaaggtgtatgtccctctggcagagactgcactgtccagggagagggaaggtctgggccatgccaagaaggcactgggctttgtctgctgtgggtgtggagcagagctttctatttctggctggcctcttgggggtagaagcagtgagccccagggtccagagccatgctggctacagctctgcaccctctgaccccagccatgggatgaggtcccctggttgtgcccagcatgtatgtgtccatggtccagcaagcacagtggctctggctggcctttgtctatctctgtggccttggaaactttgcccttctactgccactcccagcagctgccctgctgtggctgcccagcccaacttctctgccaaggggcttccgggtgcttctcactgcacccatgccgcggctggccaccaacttcccttctctatgctccagagtctccacctttatcccctttggacaatccagaagctggctcaggaggatgggcagacacactcattcacccatccatttttttcttacatttacaatatgccaggcctatcagggacccagggaaaaccagcgcagcccaaccctcaaggaagtcacagtcctgtgatggaatcagacgtagaaacagaccgtgctgaggccgcagggtaagggctatgacatggaagccagggactcccccgccacccatccatccccatgagattggaggtgtcaaggaaagcctcctgaaggaggtggcactgtaactaagacttgaaggaagagcaggaattttaccatcagctacagaccttcatagaaccccaaacagagagatggactagggtgaggactgcaagtttagcttggtccttgaaggcatggccagattctggaagctgccagcattcacaaaggggagaggctgctgagaaccccacggaggaagagttcagagggcatctcctccctctgctaacagaagctcccactgccactggcaccgagtggtgctggggatgtatgtgatggcgtttttccattctggtgcttccagagcttctgtggacacgctgccgtcagtcactgactctcggggaagggaccagtcggggggtttctgggtcagctgtgcattcctctgtcaggcaagcctcccgctcagcgctctgtgaccccacactgccatgagggattcttggtagcagaaggaccctggtcaccctgccccgaagtctgggagagaagtcctgagaggcagcagggaggctcccagatgaccctggagggcagtggctgttccagtggctgagaaagtgtcctcaggctggcaggaatcctcctgctttggatttaggcccgctcatactgggctaaggtagggctgatagtgggcaggttctagggcagctgccctgtgacccttattgctggggttgaattgtgttccctccccacccccaacaaaagatgtatccaagtccagcccctgatacttacatttgtaaccttgtttggaaatggggtctttattgatataatcaaggtaaaatgaggtcatactggattcgtttgggccctactttagagactggtgtctttataggaggaagatttggacacaaatgcagacatatggggggagaaggccatgtgaggatggaggcagagattggagtgttgcagccacaaggcaagaatgacaaggattgccagaagccaccacaaacgaggagagagtgggagaggatcctcgtccagggcctgacaaggaagcagggccttgctgacaccttgatattggacttttaccctccagaactgtgggagaacaaacctgtgttcagtcacccagtttatggtattgctgtggccgctacaggagaccaacacactgtatccctccctgggtgaactgcctttggcttgtgcctctgtcccttgtcctagcagccaggggttgggggtgtgtctatcagtgagtcacctgggggcccacacccagtgcttgcttcccttgcttaggaatcatttgttgatcacctaccaggcaccaggcacagtggggttataaacaggcagggcccagctgacactcaggctcggggaggagagcatgagaaacccagtgatgtctgtggcccacccagggcaagccacttgggggcgcctgtgagcaagtgcagggatgctctgacccacggcatcatggaccaccagcgtggctgcacgctgagggcgggcacagctgcaggggatgcctgtaaggctggcagggggagcttggtgggaaacccttggggtactccagccccactcaggaacactggagttcagcctggctcctctgtgtctcaggccgtctttgctcacaatggtgaccacgctggtgatttcacaaagttcaccccccaaagatgaccctgggagaggtcagtggcctgtcctgggtcgcacagctcccctgtgggtatttaaacccaggcctcatcccctgagcagagagctctttttcccgggacctttgctgtcaaggtgtgttctggctctggctctaggatggtgccagtgcattctgatagccacatctgtgtgatttcaaagtgccagagtgaatggaggggaacagccagtctgcaccagagaaccgtacaccctagattctctcactctgaaagtgctgacaaccatggcagccacttcctccagagccgaaacaagccccatggctggacctgggagcagtctttgttggggcagggggccactgcccacagggcttgtaagaatctgaggctgctcagggtgggctcaggttccaggtgacaccacacaggaagtaatagggcctatggggagaccccctttcagctattgaatgtgggctgtgaccaggcgtagtggctcatgcctgtaatcccagcactttgggaggccgaggtgggaggatcacttgagcctgggagttcaagactagcctgggcaacataggaagatcccgtctctactgaaaattaatacaaaagaataaaaaaaaaaaatgaatgcaggctgtcaccaggggggctggctgtgttaggcgcagtgcagggggagaggaaagccctgctgtgagcggaaggggaagcctgaggcaaggaccgagggcccgggggcctggggcggggctgctgctgccctctgtcctcctggaggtggtccctctggaggcccctttgcctccccaccaggaagtgctcctgaattgtcccccgcctcagcacctgggtcacatctcagtctcagcttgtgctaaattcctcattcttcctaccctgccccctccaccttattagatccgccacacacgtggctcagaccttcttcctctgtgtgctcactggccctggagcagtcttagaaattaccctcctgaatataaaagttagacatgctcattgtagaaaaatggttcaatacagaaaagtcgaaaaataaagcaccggtgtcactttggcttattttcttccagacttctctttcccacacaccttaacagagtgtttcaggccgcatttccctcttagcccctgtcttgcctcccccagctccacttagtataatattgagttttcttggactcagtattcaaagaatttactcaatattcaatattcaaagaatttaccaaattctgtgtaaaacatctttttaaaagactgcctaggcagggcacggtggctcacacctgtaattccaatgctttgggaggccaaggcagaaggatcacttgagtttgagaccagcctgtgcaacaaagcaagaccctgtctctacaaaaaatgaaaaataaaaatttaactgggtatagtggtaaagtcccagctactcagtaggctgaggtgggaggatcacttgagcctgggagttcaagaccagcctggacaacatagagacctcgtctctaccagaaagacaaaaattagtcaggcatgatggcacatgcctgtagacccagctacttggaaggcttaggtgggaggatcatgagcccaggaggttccaggctgcagtaagctataactgtgccactgcactccagcctgggtgacagagcaagaccctgactcaaaaacaaacaaacaaaaaattccagcatatgtatgtataatatatttaactaatccccaattcctgggcatttaggttcttttccttttttttttttttttttttttttttggcagtccccactcttcccctgccatgcatggaagccctcagcttgggagctcatcttccacaccgtcaggtgggaaccatggcaggcctgcacccttgtggcggctgcaccccgtttgccaggatttgtctgagccctgacctcaacctaggggaataaaggaagagtccccaggggttctgcggagggttttcctccctgattaaaggagatgcttgggtaaactgttcccttctactggccatcccctcatctgtaggggacacctgcagctgtgtcaggtgacttgggcagctatcaccaacaactgaggatgagggtgacacgacagagaggtgggagacagcactgagacccctggtgaattgttgaacaagggaccctgctcactggccactctgcctctggatttcttgtaacgttccttattgtttaagtcactgtcagtgatctccaaaggtaccctgactgatgcgttcatcgtccatctctactgtcctgggcctgcccatgctgcgacaccccatttctgcaccaagctcacctcacactcaagcactacctcttcctcctccctggggcagctgtccacaggtcctgcttggttccaggtggtccctcccatacttgtatcactggatatccctccagtacttgtatcactggaggctcacaggcctggctgccctcctgagggccgcacctgtacctttttcctttctggacaggccagccatggacccctgggtggcctgcatgaaatgtctcagcttgtgctaaattctgccaatggccctcaaacagttctccagggacctcccaggcaaggccctccttcccactaatggcttctgcctgatgcctgttgggaggatggtagccatcagggactatgctagaccagacaccctggccctgtctggcctcccgaggctgagacttgggtctaggtggccccagctgatccctcagctattgagagtgtggttaacactttcagagcccctgtgggtcatagcatgcacccctgggctagagcagagtccagtctggttctcagggtcagctgggaggccaggttcaggtgtcccatccaaggggataagaagtgggcagggaacaaggactggatgtgaggctgagcccagctggaacccagaggagagcagggcaggccttgagtacagcaaggagccttaagtgatgttcaagacagcaagggccccaaccagggagtcctgtcactgaacaggctgcagagtgggagatggggtggcgggagtggcgggcagctgggtggtgggggtttgggtgctgaggggcagccctggctggatgtgtcacactggcctggaaccctggcctgttctcactggttactgcttacggagtgtgtagggggctggcctgggagggtctcaggctggtgaacgagtctgaacttcccacactactgccggcactgggttaaagcctgaaagggccaggtcaaaatgccagcatggccgtgagggatgggacttctgccatgcatgagtggccagtcatatttcagctctgctgcctaggtcaagagggggccagtgtaggaggcttggtgtggagagaagaaggaaggcagctacacgtccaagagggcaggcctatgacagggctgggaggggacaagagacatgatggaacatgtcgtccaagatcctgtcccagagtgttgctgatgctctgctggaagcacacggcccagcttcgagggcccagcatggccacaccgcagggtaccggggctccagagccaggggcgaagcaggggtacaggcagagggactgggagggagcgagagagctgctgcggtggaggaaggtttcaaaacccacttccaccctcccttccctgcagtgatgctgtttaacaaacaggacatcctgaaaacagagaaggtggctggtgagctttgggtgtgactgtccacccgtttccccgtggtagtcaggatcaactaccccagcccacgggaaaacccccacctccccctttgacagaccatcatggggaaaaggcgttgccactgcaaaacaaggacagaggctcatggccagcttccaggggatcccccaggctcctctgagcacgtccatgtctcgtgctgagattagatggaagatgccaacaggaccagcaaagggttcaggcccccgaatgaaggtgtgagttatcctgctgtgttcagtgacctgactaaccgaggtgctgcagaggacaaggatcaggagtggagagaggctgtcctgtgctatgttgcagaaataaggacagtcacctgtgtttttccttccctgctaggccctgaataattaacctttgaagttaaagactgaagggatctatacccctctgcagtgaatgcctcaactagacactttcacgtgatccattattatcctgtcataaatttattcaccattattcagttaaaattatcaaatttcatttatcatattacccctgcaccaaaaatagtcaaaacacaaaagcataagaccccctgagaattaaaatgaacaaaaatctattcacctcttttactaccccaacaattctaggtctacccacagtaatattaatcattctatttcctgccatgctatttccaatttccagtcatctaattagtaatcgattaacttccattcaacagtgataattcaacttgcactaaaacaaataataattacccataacattaaaggatgaacctgatcccttatactgatatccctaattatcttcattgcctcaaccaacctcctccagcttctaccccattcatttatatcaactacccaattatcaataaatctaggtatagcagtcccctgtgagcaggtgcagtaattacaggcttccactttaaaactaaaatctccttagctcactttttaccacaaggcatacctatgccacttatccctatactagtactcattgaaaccattagcctatccattcaccgatagcattagctgtgcaattaacagccaacattacagccgaccacctgctaatacatttaatcaggggacccacactggtactatcaactattagtcttcccatagcttcaattgctttcattattctaatactactaaccattctcgaattcaccatagcccttattcaggcttatgtcttgacactactagtaagcctttatatgacaacacataatgacccaccaaacacatgcctaccgtatagtcaaacccagcccctgacgactgacaggagctctctcagctctcctaataacatctggcctggccatgtgatttcactttaattctatcactcttttaaccctagacctactaaccaacacactaacgatacaccaatgatgacatgacattatccaagaaagtacatttcaaggccaccatacaacagttgtccaaaaaggcctccaatagggaataattctatttattatctcagaaatattcttctttgctggtttcttctgggcattctaccactctagtctagccccgactccagaattagggggacattgacctccaacaggcatttttcccctcaactccttagaagtacccctcctaaatacgtctgtattacttgcatcaggagtttcaattacttgggcccaccacagcctaacagaaggtaatcaaaagcaaataattcaagcattctccatcacagtcaccttaggtatttccttcaccctcctacaaatctcagaatattttgagaccgcttttactcttcaccctcctacaaatctcagaatatttcgagaccccttttactatctcttatggaatctacagctcaacattctcttttttttttttttttttgagagggagtctcactgtgttgcccaggctggagtgcagcgacgcaatctcagctcactgcaagctccgcctcccgggttcacaccattctcctgcctcagcctcccgagtagctgggactacaggtgcccgccaccacaccttgctaatctttttgtatttttagtagagacggggtttcactgtgttagccagtatggtcttgatctcctgacctcgtgatccacctgcctcagcctcccaaagtgctggggttacaggtgtgagccacggtgcccggcccaacattctttatagtcacaggttttcacggacttcatgttattatcagatcaacatttctcactatctgcctcctccgcccattaaaattccactttacatccaaccaccactttggctttgaagccgctgcctgatattgacacttcatagatgtagtaggactattcttatacgtctctttctactgatgaggatcctactcttttagtataaatagtaccattgacttccaaacaattagtttccatagtatccaaaagagagtaattaacctgacactagccctagtaaccgacaccttaatggccctattactactaataattacattttggctcccacaacttaacatttatatagaaaaatatagcctctatgaatgcggatttgacccaataacctccacccacctccccttttccataaaatttttcctagtagccatcacatttctcctctttgacttagaaatcgctctactactgctcctaccatgagcccatcaaacaacctgacactaacaatcagcacagcccttctactagttatcattttaatcctaggcttaacttatgaatgaacccaaaaaggattagactgagttgaattggtaagtagtttaagtcaaaataagtgattttgacgcattagattatgataggccatatttgccaaatgccctctatttatatcaatattatattggcatataccatagcactactgggagtattagtctatcgatcccacctaatatcatccctattatgcctagaagccatcatactatcaatatttatcataattactcttacaactttaaatatacatttcattctagcatccataacacccatcatcctcctagtatttgctgcctgtgaagccgcagttcttgccttactagtttcaatctctaacacatatggtctagattacgtacaaaacctacacttacttcaatactaaaaattattattccaacaattatactgttaccaataacatgattctctaaaaattctataatctgaatcaacatgactacccacagtctactcatcagcctcattaccctattatttgttaatcaattcaacgataactcacccaacttctcattaatcttttctgacccgctgacatccccccttctaatctcaacagcctgactacaaactccagcaagccaatatcacctgcccaatgaatcacccccatgaaaaaaagctctatatttctatattggtttccctgcagattttaattatagcattcacagccacagaactaattatattttatatcctctttgaagctacactaattcctaccctgattatcatcacccgctgaggtaggcaaccagagcgcctcaatgccagctcatatttcctatttatacactagtaggatccgtccctctacttgttacacttgtctacattcaaaatacctcagtttcactaaatattctagtaatgatatttaccacccaagaactattagcctcctgatccaataatcttatatgactagcatgtattatggcttttatagtgaaaatacctctatacggacttcacctgtgactccctaaagcccacgtagaagcccctattgacggctcaatagtacttgcagcagttctcctaaagctaggcggctgtggtgtaatatggcttacccttatcctcagccccctaacagaatatatagcctacccattcctcatattatccctatgaggaatggttatgacaagctctatttgtctacgacaaaccaatctaaaatcacttattgcctactcctgcataagccatatagcacttgttatcacagctatcctcatccaaaacccttgaagctttacaggtgcagtcacccttataattgcccacggacttacttcatccttattattctgcctagcaaatttgaactacgagcaaatccatacccgaaccatattacttacccgaggccttcaaatactgcttccactaatagcctcttgatgacttctagcaaatctcactaaccttgccttaccccctaccattaatctagtaggataactctttgtgaccatagcttcattctcctgatcaaatatcactattatgtttacaggacttaacatactaattacagccctctactccctatatgtattaatcatgatacaacaagggacactcacatattacattgacagtattaaaccttcctttacacgagaaaatacattaatatttatacatgtcgcacctatccttctattacccttaaaacctaaaattattatggggtttacatgctgtagctatagtataaccgaaaccttagactgtggatctaataatagaagcctgcaacttatctaccaagaaattacgcaaggacagctaacttgtgcccccatgcctaacaacatggctttctcaacttttaaagaattagagttgtctattggtcttaggaaccaaaaacattggtgcaactccaaataaaagtaacaaatatgtatttttccactactataatagccctaatccccttaatcctaccaactattatcaccttagtcaacccctgcaaaaaaggttcatacccaaactacgtaaaaatatctatcgtatgcgccttcaccattagcctcatcccaacaatgtttatatgtacagaccaagaagtcattatctcaaactgacattcaatgacaatccaaactcttaaactctcactaagcttcaaactacttttccacaatatttatcccagtagcactatttgttacctgatctgttgtagcattatcaatatgatacataaactcagaccctaacaatcaatttttcaattatttacttattttcctcatcacagtattaattctggtcaccaccaacaacctctttcaactcttttttttttttttccagacggagtctcgctctgtcgcccaggctggagtgcagtggcgcgacactcactcactgcaagctccgcctcccgggttcccgccattctcctgcctcagcctcccgagtagctgggactacaggcgcccgccaccacgccaggctaatttttttgtatttttagtagagacggggtttcaccgcgttagtcaggatggtctcgatctcctgcataagcagtgatccgcccgcctcggcctcccaaagtgctgggatgacaggcgtgagccaccgcgcccggccctttcaactctttatcggatgagaaggcgtaggaatcatgtctttctaactggctgatgatatggccgagcagatgctaacaaaagcaggcctccaagcagttctgtacaaccgcatcggcgatactggctttatttttagctatagcatgatttctcttatcctccaacacatgagactttcaacaagcgtttactctaaaccctatccccgacacccttccattacttacttagcagcagcaggaaagtcagctaaattcaacctccatccctgactcccatccgccatagaaggcccaaccccagtctcggccctgctccactccagcactgtagttgtagcagttttcctactcatccgtttctactctttaatagaaaataacctattcatccaaacctttacattatgtctaggggctattaccaccctacttacagcaatctgcccttcagcgccaggggaatgcccgacagctaccttctcccccgtgaccgccgggctccgtatcctgggcgagccgcccggctccggatagcaggaaactggggagggctccggcctcgcctcgtcagccccggagccttcaccaatcccgggcccggaaagaccacgcccactgctggccccgcctagcacctgcgcaggtgcagtctccacctcaagccagctgggccttatgatagtcaaaattggtattaatcagccacacctagcattccttcacatctgcatccacgccttttaaaaagctatattatttatatgttcaggctccattatccataacctcaatgatgaacaagatatccgtaaaataggaggactattcaagactttacccttcacttcctcttcccttattattggcagccttgcacctacagatatgcctttcctcacaggcttttactctaaagaccttatcatcgaaaccgcaaatacatcatacaccaacgcctgagccctttctattactcttattgccacctttttaacagctgtctatagtacccgaattattttcttcactctaataggacaacctcacttcataactctattattaatgaaaataatcccttcctaattaactcaattaagcacctaacaatcggcagtatctttgctggattcctcatgaccaacagtattattcctgcttcatcccccccaaacaactataccacttcacctaaagctcacagccctaggtgtaaccaccttaggcctcttactagcaatagagctcaagctcataactaataatcttaaactaaagtacccattacagatatttaacttctccaatatgctaggtttttattcagccacaattcatcgttcaaccccccactcaagcctattcaggggttaggctaaaggttaaagcacagattttaattcattaaacttctattttctttatcctctctttcccccatgataatataggacagcagttctcaaatgctttggtcacaagaccccctcacactcttgaaatgaccgaggacctcaacgggcttttgtttatgagctacgtcaacatttagcatcttagaagttaaagccaataactctgaaaaacatttattcatccatttgaagactatacatccattacatgttaccttaaaaaaatttttaaacctatattttccaaaacaatatatttcatcagtaggagtggcatcgttttacatttttgcagatccttaaagcctggcttaacagaaggctgctgcatcctcatagctgcttccgccttcggtctgttgcagtatggtatcctgactgaagaaaaccacgtggggttgggaaaggaaggaccttgaggaccctcaggggtccttggaccacactgccgagggcatggtgtggcagccgactttaacccatacattctagaacagagagagccatgaccaaaccagagggagagacacctgcagatatcctgggttgcgggctggaagaagtattaacagttgatgaagcagcttggcattgcctctcttttctcctagggaagggataaaccactgtctttttgtgaggcatggttgtgttatgtcaggtgggagcctgatttctgaggtgcgcgcatgggaagatgggggtgcatcagatagccaaggaaagtggtgtagtggacttttgtcatctgaacacccttccttttgggaaaatcttttatcgagtgagttctggcagagtcctgccccctcctcctcgagacaaaggagccagatgctctctcctcgcatgttctggaagctacagaatgaacacatgcctgaggtttgcccaatcatatcctccctcctggtacttaaccttaagctcatggcagacagctgaggaagtactcgcagcagcaggggtgcagctggaggctccctttttgtgggtgtcatgctgtcagtggtggtggctgtggcaagtgctgcatctccagcaaatggtccctgtggtgcagccctgcctgggtttccagccacacaacttcccggatccctgtgaacttgctgggcttcatcccatctttcctgcccggctgaatgacctgtatcccaacagcttccttcactgagtcagggccctggcagggccaggtggggatggcctccctcaccgtctgctgcttctacctacatggctgggctccctgcgcccaggcttcgcctttccaaagcgccttgcatagccctccggagaaactttggattccagcactttcctaaaactgtcccgtgtggagtactccggcctcaccactgctaactgaggggctggaatgcagggtctttctcatctcacctcaaatccccaacagatcccttctaatggaaacagcttttaaaaatttcaggatattcgtaaagcacacgggaaacaaatcatggatgatctgccacacattttgcgactccttgagaaccattttgtaatactgaggtcacggagtgacagccccctgtgtggactgtgcttgttccttggccatgcactgcctcaccccacagaggtcaggcatggccatgtgttgtggccaacagaaagtgagcaggggctgtatttgtgcttgcaaggtagggcttggcctcctgtgcttctgccatgagaaagaacacggcccaaggtaagctgctgcttcaaccagggacccagaatacgggacatgttgtggagcagacgtgatcagacccccagcctggagcataacctagaagccaacttgtagactacccaagaatgggaatctagttgtagaccactgagatttctgatgctgttttgcagcaaaagctgactgatacatcacaggagaaatagttacagaatctgacacatgctgaatgctggataatcagtgtttcatggcagttaggtaaatcccaggcactgaagtgctcgcagcctcacagatcgaacgacttcctacaacctgtcacttctgtttttacctaatggtcctgacagcggatggcctacctggtgagaaagcttgtttccacactagatgctggctttccaacaccagatagcttgggggaagaggaagttaagatgggctggggggttgtggggacccctcaggtttgggagtttgcaccaggtgccaacaagctcctggcctgaaactgtagccaggaggggccagtggtcccactgcagcctccaaacctgcctcccagttcctccagcactgcctgcccatgcacccctaaatcttactgaaatgaaaatccacgtctttgagatattctttaggggtggaggggaggcactgggctcctgaaaacaaagatgagcttaaagttctaggtcaccctgaggctagcagcatccttccctgcattttgcaaaagctgcactgggctctttccctttgtgggtgcagctcacacttctcaccgtacaggacactttgcatgggcagggctgtttgctctccactgcatccccactgcctggcaccatgcttggctcggggtaggtcttcaagaaatattgagaatatgaatgaatcaatgaatccttatttataaaaagttacacccactgctgctcagggctgccggctggtgtaaactgccagtgtgagagagacagagcgagctccctcagacagcgagctcaatcccagccaactaagcccagctgtagctccctcaggcattctggcactcaggttcctagagctggcttttgttgacagcatgtgtacagagcatgttattttaatgttttatatagggcaaaaatagtgaatttagggttatgtgtttttctccaaacccaacaagtttgcctcatggccagggcaaagtgtgtggagcccatttgagatcatttttagtaagttactaataagaaaagtggactccattcagtcttctctgcagtaataacacctacactcctttttgtttcgacctcctttcgaaagtatttatttgttctcaaacattactcttgcaggatccagcttctgccctgattccctggtgtaccaccagcacctaaagaaacactgtacctgccgggtgcagtggttcccgcctgtaatcccagcactttgggaggccaaggcgggcagatcacctcaagtcaggagtttgagaccagcctgaccaacatggagaaaccctgtctctattaaaaatacgaaattagccaggcgtggtggtgcatgcctgtaatcccagctactcgcgaggctgaggcagaagaatcgcttgaaccgggaggcggaggctgcggcgagctgagatcaagattgtgccattgcactccagcctgggcaacaagagtgaaactctgtctcaaaacaaaacaaaacaaacaaacaaaaaaacaaaagaaaagaaaaaagaaacactgttcttatctacaaagataatttgaacagttgtttccctattgctgacagattaaagtttggcccttaaaatgacacctgcttctactgaccacttccggttaaggccactctctccatctttccaatgacaagtaatgcttcacactacagccaactaatagtttaagattcttagaaatggacaaaccacttgttgcttatttccacacagttactacctgtgtggaaaaattcaagttgctaaataacagtgtcactttatggcctggtaccacactagagcctgtcacaagttcccaagggcagtggcctcttcctctactaacgggtactaccagagaccttggttactaacacctaaatattaagacccatgggatttgcagtccctacattcatgcctagtactttggtaagatccacaccaggcacatactgttttatgcagttttcaaggacatctgcaatagacacatatcttcacacctaagctttaaaaaatactttaacgtaataatggtaatgcagagaactagaattcaacatattacactgctaaaatattcatataaatactatatatgcatgggttcattccattagaaaaattcacctatcagaatattaaagaccagtatcagcaaagcccaaggagagagtattttaacagtaggaacactaaaaatatcaactatgaggtttataaacaagtggtgggaaagagaactttttacatttgctattgttatgacaggcacaatctgaaatacaattttagattagcagtgtataaaaatactttttaaacaatagttttgataggtacagtagcatttaaacaaacagctgtgtggttattccttttgaggacctactaaaacaattcgacttactgcccccagctacacctgaaagtgcgaacctggaaagcaagtctcttacccaggtacacatcacacacacccacatactgaaaccacctccatctatgatgcatactgatgaggcggtgatctcaaacacggcgtgagacgagtgtttgaagcctgtttccatttccaggtttgggatgaatgaacaagaggcgaaggccaagtggagtctgtgtgtgcctgggtcctctctaggagtttaatctggcatatcaatatttaacttgggaggggggggaacgtatttcccagggctctgggttataactactctggccttctttccaaatattggagcaattttcggagcttctggaactgatgtttcttcagcatcttcactatcttcgtgatggagatcatatgaaatgttcccatattctcttaaaaatgggaaaatttcaagcagaaactgacagaagtctctgcgaatgccaaaccaccaatgattgcccccctttcgcctaaatgttgtggccattaaagttagtaaggaaagccaaagggggacaaatatggagacgtaggagaatgtattgtggccatccaatctgtgaaccagcaggacctcaaaagtgagcagaggcacgacaatcgttatccaactgatagccatggtcacgtgtgttctccgctgctcggcaaccacatccagggaccgcaggaacaggagggaccagacgatgtaatagaggacgaccaggcaaaggaacgacatgaggatccacaggggcacaaacaccaccagccacggccagtgaataatcctgtccagctttagggcgatgaagatgaactgcaggatgttgaccgagcacaggatctccagctccagcgacctatcgtgtcgaaagccccagacgcaggcagccacggacacgggggacacgaagaagagaggcatgaagaccagcagccagaagtgggtgcccctctccaccctgtcgcagaccaggacttcgaacatgagcagcagcaggtggatgcccacagcgatcagcatggctttgaactccacacaggcctctccctcggtgcggtagcgagggttgcgggcccaaacgcccgcgcccacggaggcgcctgcgacgactagaagcttccacagccatatgggggcaaagacggcccagtagctccattggatgatgccgtccaggcggaggggcagcagcaccgagaagagcagcaggcaggtgtagatgagaaacttactggggttgaagtcctggaacaggcccctggggttcatggcggaggccgccgcttgcctgcccgggcctgctccctcgcgacgctcggcgctcgcgtctccgcggcttctccggccgccgcctcccgggccccgcccaagccggctccgcgtggacgaatgccgggacgaccaggaggaggttcggagcggcgaagcggagaggccggaacacgtgcacgcgcggtcacgtggcccggccggaagcgcgctggggtgtggcgcgcgcgggcacgggcggcgcggcggttacaaactgggcgctgcctcggtcccgccgccgcccgcgttcactccgtacccatcaagaaggcacctaatgcgtgtggggcccgaaggggcctggcgcgctgctgactccccaagcggcccgcgaccttgggcggacgcttccaggcgactccgggaacatggaggcgggagtgagctcacatcctccctgccggccggggcgggccctgcgggggcggggccgggtggagagggcggggcctgggcgttggcaccctacccatctctgccgggatcctcgcctccccgcgctcgccgcggcttcccgggaacccgcccggggctagagcgcccgcggtgaggctccagcaccccgcgcgcgcgagcagaggcggtggccgggctagtgcgggagtttgcgagcgagggagcgggtgccggtaactgaacggatgcaaggcgatgtgcatgagcgcagacctgtgggggccggcggcgggtgtatccctggctcaaaggaaaaggcccgcgcgtagactcagggcacgaggtgggggggccttacctgggatgaagactcgcggggcagaactccgcctggtggagcaacggacgtttctcaggctgcctgcgaagtggctgtgcagagatcccaggcggcagcggcgctcttgtacctgtccctctcactccagagtggaaggtgctggtgagggtgttagaccccactcgggaggaaactggatccagaccagggttgggggttgctttctgccccaggtcacccggcaggttaacagagaatcgcgtcgcagatacagggctcctaccttcaagtgtctagtcctcattttgacttatttggccctgtctctgtgttattctcgcaaaaccatgttttccttttcctttggaaaagggtactggaccagaggtcaagagatttgggttcttgtccaggccgtgccacccatcagctgagaaacctaggcaaattcacctctttctctctgggcctcagtttcctggtctatgaagttgggggacagacctgggtggtgtctaagggcaaggctgcagcgggtctgtgatttggagcacccctttcgccctctggccatctgggcagaccctggaggatttctgtcttccccgctgtcccactgctcagcagagccctggctgccctcaccagtctctcctagtcctcttttcctgaagtggctgtgggatgttgtcacgcaggtcctgggctctgaagtgggacaggccatcagaggaacgcatggcctgtcagggcctccgcggagtggccctcccgcaccctcacagcactgccccaggcgggcatgagcagggtgtccaggtgtcgggcggacagtcccagcccccgaggcgctctccacaacttcacttcagccacaggcaatctgtggccctggggaagggagtccagctgagtgagcttcaccagtcctcaggctcagcccttaaggctgacttcatagatgtgtcttcagggcctcttgtttctggagagccttatctccctccattcctcccctaaacagagttgctccaatctgtctgttttacacattggtcttttttgtactcttttctcccaagaaggatttgtcaactaaaaatttgtaaaagtggaaaaccccctcaccaatccaacctcttcatctgtgaaatgggcttggaaaagcacacaggattgttttgaggattagatgaatcaatacatggaactttgcactttgcatttagagacctgcaagtaattgatttgaccccactaggaaagcagagcccgtggaggggaggcgctgccaggagcgcccccaccctccgggagctggtggcagagtcaggtcctctggaccctgcgagaacagtcagaagtccttcccaatcacctatgtagtcagatgaactcagggcctctgctgccatctttgtggcaaagacagagctcggagcttattttcccaccttgagctcctcattcagaacaagtgcaccctctccatccaagaagcgggtatcaaggtgtcctgtcacagtgcaacagtggctctgctgcacagctcctgagggagggcagacccagcttccaggcttgtgccacagggtgagggatgctgtctgccatctgtccccagctggcttcctttggcctgcaggccttgacccctcccccatcatgccctgggcatcagacacccctccttcactgttttccctgatgcggccagtctctcagacacccgcctttgtcttttatttacctgtaaagctaacatggattgtttgctatgtgccaggtgctggcggcatagcagtccccaaggctggtacacaaaccaaagtgtgaattcattcacttacaggtggtgtgtgtggatgtggtgttccaggccaccggcacgggctgctatcccccagtcagggtgtgcgggggcacatggccccagagggcaggggctgacatggtttgaaggtcactgtcctaacggttggggaagtcctgggatgtgtcctaaccccagcctctttcccctgcttggcatcctcagtcccaactttcctgtctgaactgtaaggctctcctgagctgatcccggcacacctggtggccaggtcccttatggtccatgtaccagcccagccagtctgctgcttccccctgagtgtggcccaccccgacatggcctctgtctccttcctgggcaccaagacccacgacagggcttcaagccctgagaaacctcgacccctggtggaccagtgacccttctctcacctcccacagcatctgggtgccagaggtggggtaggggcaggcggggaccttgttcctatcctgggactcatttccctgggtgttgtctgtttggccttctgtcctttcatgagatttgagctccagacacccagctagcacttatatcgtagcaaatgtttgagagacgttggctgaatgagtgaaggaatgcatttaacactactcatgactgcgatgctcctgtcccagaggagatgctcctgtggccagcgtggcaccgatagtgggacctgtgtcctttcatcaccagcatcctaggccctgttccctccactctccagcccaggtgatctttcttcctcggtaaccaattgccacaggtgtatcagtttaaagcagcagtcagttactgtccgccatgaactgagagtcagaagtcagcatcatatgcccagccagtgctccgcttgagtcacaaggccaagatctcggtgtgggcactccggcagtgaacctgcattcgagttctgtgttggcaggatgcagttccatcgagttgtgggactgaggttcctgttgccttgccagccatgggcctcggggttcattctcagccccttgtatttcctgacttgtggcctccttcaaagccacccgtggtgggttaagtccttatgtctggagtctctcttctgccttccttgttttgagggcttctgtgattactttgggttactcagctaacccaggatcacctctctattttaaggtcagcctgttagtaaccccaattccatctgcaaattccttagaattctgctccgtaccagcggtcaggcccagctcggctcttcctgccccacaacagccactgcttagcaagagctgagctgggtttccagggagagcgaactcttgcctggcaccctccacagcagaccagggtgacagtgacacctgggcatggtcccagtcagagcagctggaagctggtgggagttaagttttccctgtagccctctggctgcaggacatgggatgcctttgctgaatgtcctctgaggggctggcttgggacagggggatgacctgcgcagaaagcccagggaaaatttcccttttggccggatttgtggatttgctcatatcaacttcttcacaaggaatccacagcccacctggcccttgtgccagcctcattgcccaccattaccccttggccccagtctctaaatgaagagcacgctgtcacctctacaatagcctcctcccatctccctgcccccccccactgccagcacacacataccagtgcagtagtatgcccgtgggcatggacttgagtcaccccagcccaggtgcgagtccagactctgtgaacttgacagatgacttagtttccagccccgatctgtgaaatggagataacctcccaaaactgtgacagcaaaaggaaacaatgtaggaaacctacaatgcctccattatttccccccagtggtggctgttaactgcctctcagcagcagattgtgtgtcccctccctcgggtcccacagggtatcatcctgtttgctcatctgactctctggactccctgtgactttctcaaggacagggacccatctcttatctctgttagcagtttccagcacaggctcgtacatggtaagtgaatctggaaagtgcatgcgggcaggaagacaggagctgatgtgacatctcctgtgggctgagcagcgagcacgggaaccttcctgagacaaagcagcttgtctgaagctcacaggtcccagtgttacagggaggtgctgacagttcccagtgttacagggaggtgctgctgggctcgcatgaggacctcctggagcgtgacagcccctcacgctcgcacgtggcttaatatttcaaagcacgatatcatctggagctgacttcagagacagaggtggcaaagcactaacctcatttgacagatggggaaacaggcccaagacccacaaccatggttctctgctaactctgcagctgcatactttccacagggccctgctgttggccaggtgggcgtccctgccctgtttatcagctcagtccagtgagaatggctccctgaagagccagactctggctgggaccccttgagacttaggctcctgttttagcagctttttccttccttaacccgtgtattcatttaacaaatacatatcaagcatcttccctgtgccccaggtccttgtcctggatacacatgtagcaatgaactcttcaggtggcttctcctgtgctggtcccttctcagttcaggtgtcacctccttcagggtcacctccttgactaccccacccaaagtcattctctcacttgcgtctccttatttctcctttttttatatggtcactttagaaaaagctggaaaacgcagactcgtttaaagaaagaaaatgctgtagtcttagcacctacagaagatcactgtgaacattttactgtgtttttccttccagtcggtctactcggcaaagagatgtcatcctccacatacccatttgattctgcttttttacttatggttaattctaaaactcacttcacattttaacgtctctggatcttgcactgtacagtggctgatgttttacaggcactgtcagctggtgttaacattcagttctttctagaggtggttgtatttgtttctgccagtcacctgggggcactgccaacttgacataaccttaaacttaaattcagttacagcatttgcttgaggtgtttccagaccatatgtttgtgcaaattcagactcaaaccagcatgagtactggcttgtgcacgtcctcaggggcagttttgttccctccctgcatccgggtccatggctgggacactggctctttctgcctgacgaggctgtttatcattctcctcccaccaaagaaatagccctttaggatcccagctttacttagacgtcccttattaaataaccattctgggtatttttttcttccttaaaggtacgtgaaatggtggtgtgttctctaatcaacagtgtcttaaatgtgatgaaatgccatagatagaaacacttctcagatttccataaacatgtgagcatgttttcagtggccccacaatattacattaagggtagtgcaatactttactcacccattgcattgtgtatttgagttagtttcattcttttatgaaatgaagggactgcgctctatcttacggcttctttgcatccagattgtttttaagggtagattctcagacacagacatgccatggtgaaggaatgaatacagtagtccccccttatctgaggtttatctttccaagttttcatttacctgcagtacaccgaggtttgaaaatattaaatggaaaattccagaaataactcctaaattttaaatgacactctgttctgagtagcgtgacaaaatcttgctccatctagcctgggacgtgacccctctctttgtccagcatcttcacaccgggcgtgctccctgggcgatcacatcagctgccgccagatcactgtccctctgttcaggtcacccgtgtttgacttaataatggctccaaagcacaagagtactgtgcctaatttacaaattaaactctatcgtaggtgtgtatgcacagggaaatacatagtgtgtataggggtttggtactatctgcggctttgggcatctactgggggtcttggaacatatcccctatggataaggggggacaacttcattctaaagacccttgacacataaagcctagtgtgtctttttttttcctttttttttttttttttttttttagatggagtcactctgtcacccaggctggagtgcagtggactgatctcggctcactgcaatctccacttcctgagttcaagcaattctcctgcctcagcctcctgagtagctgggtggtacaggtgcaccactatgcctagctaatttttgtatttttagtagagatggggtttcaccatcttagccaggttggtctcaaactcctgacctcaggtcatctgtcagccttggcctcccaaagtgctgggattccaggcgtgagccactgtgcccagccttttattctgttttctgtgttatctttgaggaaatggagtcagtgccaccccgagttgtggtgtgagtctgcttgtattgatagcagctggcagagcttatttagaaaactccacagggttgaagaattaaagaggctgaaatcaaaggtagactcaagtatagggctgtataatattaaaagtcaactaaaaacagggctagtgttgacatgtttgtgagtgtgcaaatgcagaagtcagggttttccgcgtcagatcacagccttcaaatgttatgaacaacacagtgagcattgggatcatttaatttgaggcattcacatataattaaatataattaattcaaactaatattttgtggaggtgagtgggaagcttcctgaattatggaattaggcaatccaggtatcaattgtacttaagttgacattactaaaatattttcaaaagttttcatgtacaatttaagttttttccccagtcttatttgcactcttaatttactcagcaaaacatttttttcttggacaaaggtcattcccagcccggctctcacctggctttgtcataaattccaagagagtgtgatgtggacaaatgatgtgcttcctgcgtcagaaacagacgtttgtaaaattgtaatcctaatttcactctgggttgcctttcattcttccattgccaggtgcaaagcagcaaaaaagtaaaataaaataaatgcctctgcacgccactgagagccaggccctggagttaccccatgaacagtgtggggctcctgacttaaaggggcatccagcagtatagcaggcagcacggcctgatgactcgggccacaggagcatggccctcccctgtcaaagctgacttctcgtttctcaggacaaaatccatacgctttaccgtgcccttcaaggccctggctgaccggccgtggcccatctccctggcctcacctcactgcccatggggctcctatggccacctcagcttctttctgctcctcagactcccagactggagccgttgctgcctcagggtgttgctttatgtgttttcacagatgcctttaggggagatagacctaaaagagtctgggcaacatgcacagcctccaagcagttcactcatcactcagctactatggccagactgcctgctagtgcccggtaggtgccaggccctggggaaggaagcaatgccctgtggcccttgttcccaaggaccgagcacttttccacgcagttaaggtgcacaaacacaaaacaccgaataacgctgaaagagcccaagagaggaccagaggtcactgggctgaatatgatgaaaagtcaactaaaaaccagaaaaaaaaaaaaaaaaacattggaaataagctatagggcagcgatcagggagaagcttgtgctctgagctgcaacagaaccccaaggagaccactatcaagagggtgccctggtgtagttaagcatgggccaaagaagggaccacctgggttcaaacttggccttgtcatttcagcagctgtgtgtccttgaccaaatggctcagcctctctgagtctaggttttctcatctgtacaatggggataataatatctacttcacaggatagaggtgagataatagagatacaggcctggcacattcagtagatgcccgcatgggcacgtactcccctcccacgccccaccctgtgctggtgtagaagagagtgcccaggaagatctgtgctcgagtcagctgggcataactaaggacaccttaaattgtgtaaccaggtgacaggcacctcattcattctccaccctggggctggttctgctttataaattaagggggccagggtggcccagaggtccccagatgcaggtccaaatgcagcattgctggctacatacaggcagattctggggcctcaccccgagaatcttggtgattcagactcaccaagtcagaatccttgcgggtgaggctcggaaaccatttttgtaagtcttcccaggtgattccaagtacagccaggtcttcgcacccacacagccagacggcccctgaaaagctttctcagcctttgcagtctgtttctggccgcatcaaatgtgctgagcagtgtgggtttggttcagtgttcatcccccactttcatcagagacagggggcttctcttggtcctcactcatgggaggaagccgcaagcggagacgactaagtggagaaataaatctctagcagctgcctgctgccctgctctggaggttgtctgcgaggaggagaaacggctaacttccaagaactggggtgctttctccccacctatcagctgaatcgaaactgaaaatatgcctccgaggctggagatccgtgacaggcttgaaaccttgacaagccaacccttctcatgtggctgctttccacctaagaaagaaaatgaaactcctcggagttcctgctggttttagatttttctctggtacaaacaaaaattatttactgtcactgaggttctttccagattaccccaaacagccataactttcccagctttatctggggggtatttggtgtggtgaattgctgttcatatagtgaattcctattgcatatccagcgttactagatttcccccgtgaagacaggtcatctcttgagctctgagtgctcttacagagcaggggggttgaagaaagaggttctccctgatggtttctgagtgggtgctttaaaaagctcagtaagagcctggcacagtggctcatgcctataatcccagcactttgggaggccaaggtgggtggatcacctgaggtcaggagttcgagaccagcctggccaacatggtgaaaccccgtctctactaaaaatacaaaaattagttgagcatggtggtgcatgcctgtaatgccagctactcaggaggctgaggctggagaatcacttgaacctgggaggcagaggttgtagtgagccaaaattgtgccattgtactccagcatgagcaacgagcgaaacgccatctaaacaaaacaaaacaaaacacctcagtaagagtggaagtggtttacgactattgatgccacaacaacagatacatcagcaaaaggaaacttcaggaacaatatggtcgggatggaggtgttggacgttgttttttcttttaattaacaaaaaaacaggaacacatttagtagtaaacagagggcccagttttctctttttggtctgaaaggggcttcaaaaaattgtattcagtgttaaatagaataacaatggcaatgaagatagtgagaagcgctaccatctgtttagcatgatgtccgcgtggggactgggggagagatttgctcccattacgggggagactgaggctcagaagggtcaagtgcctggcctaggcacctcgtcctgttagaggagggcacagctgcctgctgcccctccttccccatctctgcctctctaatcttccttgaggaagattccatcagaggttttagttacatattcctacaccatgcctggaacatagtaggtactcaataaatccaacttttcctgagttagtggtgaggaaaagctggactcaggatcaggctgcctgtgaagtctggcctgtagcttgccagctgtcccagcttcagggtcctcacacccagatgtgtgtgtagtaacagagcacttcttgcctgcaacagtgcctggttcccagtgtatgccagttgactgatccgtattattattttatcttaagaggacttccagcctccagaactgttgatgaataaatgtttgctgtttaagctaccagtgtgtgatactttgttatggcagcttgaacagaccagaatatttagaaaataattatttaaaaaggacctttttttttttttgagttggagtctcgctctgtcgcccaggctggagtgcagtggtgcagtctcagctcactgcacgctccacctcctgggttcacgccattctcctgcctcagcctcccgagtagctgggactacaggtgcatgccaccacgcccggctaattttgtttttgtatttttagtagagacggggtttcactgtgttagccaggatggtctcgatctcctgacctcatgatccgcccacctcggcctcccaaagtgctgggattacaggcgtgagccaccgcgcctggcctaaaaagaacttctaagcagacatttgatagagcactgacatgggtggacgttcattctgacccatctctgtgctgcggtggaggcaggctgctctgggaatggccgtgtgcaggattgctgatgcccggggtggggtgccctcctgtttagagaggggtgctgttacagcagtcaggctctctttgatctttacccattggtctgcagactccccgttaaccctggcaatgcttcgccatcttatctgccccctttctttcttggattaaaaagaggccctaggcaataccattcaggacataggcatgggcaaagacttcatgactaaaacaccaaaagcaatggccacaaaagccaaaattgacaaatgggatctaattaaactaaagagcttctgcacagcaaaagaaactatcatcagagtgaacagacaacctacagaatgggagaaaatttttgcaatctatccatctgacaaagggctaatatccagaatctataaggaactttaacaagtttataagaaaaaagcaaccccactcaaaaaatgggcaaaagatatgaatggacacttctcaaaagaagacatttttgcagccaacaaacatatgaaaaaaagctcatcattagagaaatggtcattagagaaatgcaaatcaaaaccataatgagataccatctcatgctagttagaatggtgatcattaaaaagtcaggcaacaacagatgctggagaggatgtggaaaaataggcatgcttttacactgttggtgggagtgtaaaccagttcaaccattgtgaaagacagtgtggcgattcctcaaggatctagaacaagaaataccatttgacccaacaatgccattactgggtatataacaaaaggattatcaattattctactataaagacgcatgcacacgtatgtttattgcagcactgttcacaataacaaagacttggaaccaacccaaatgcccatcaatgatagactggataaagaaaacatggcacatatacaccatggaatactatacagccatcaaaaaggatgacttcatgtcctttgcagggacatggatgaagctggaaaccatcattctcagcaaactaacacaggaacagaaaaccaaacactgcttgttctccctcataagtgggagttgaacagtgagagcacatgaacacagggaggggaacatcacacactggggcctgccagggggttgggggttaggggagggatagcattaggagaaatacgtaatgtagatgacgggttgatgggtgcagcaaaccaccatggctcttgtatacctatgtaacaaacctgcatgttctgcacatgtatctcagaacttaaagtataataataaaaaaaaaaaagggagaaaaaaaaaaaaaagaaagaggccttctggaagttgtgttctaacccctgtgaagatcagtgttttgcatgtagctttggagatgcgatgggagtgtgaaaagtcacttactgtttgggtctgtgctaagagcccacccacttcgtgccagtggagcacctcctgcagcattccacaaggagtgccgtctctagatagcatgtgagagggtgggcagcacgggtcagtgtggagacccaggtgccatgtccccacctgcaagactggattctagcttttattttgtcccaacccctcatttggacacagctggattcctctcttaagataaaataataatacggatcacttaataataatacggatcccagtggcatacactgggaaccaggcactgttgcaggcaagaagtgctctgttactgcacacacgtgtgggtgtgaggaccctgaggctgggagagctggcaggctacaggccaggcttcacaggcagcctgatcctgagtccagcttttcctcaccactaactcaggaaaagttggatttattgagtacctactatgttccaggcatggtgtaggaatatgtaagtaaaacctctgatggaatcttcctcaaggaagattagagaggcagagatggggaaggaggggcgtcaggcagctgtgccctcctgtatcagaacgaggggctgtcgggccaggctgaggaggacagaggctgcagaaccccagagagtctcagctctccagcccaggtgcagctgccccttgggcagacagcctggaacacatctgctcattagtagcctacccaggcagctggccgagcgcctgtccctgaaggcctccctgagctcagaggctcccgagccctggcactgtgggtgcaatccccagagctgctttcccaggctcgttgcacaggcaagtgcagcccaggtgtctgacaactttggcttcagcgtcatggcctccacatcgaagccgttgtgggacacccaggagtctgagctcagcagtgagctcggagcttgagcttgagcttgggttgcagaatccaaaaatcaattaatgtggggcttggggggaaatctgtctgaccggtggtttggcaaaatcttcaatcactgtgagacagaagatgtgtgctgcgtgctgtggctatggtgcgcatggctgcagctgctgccaaataggaaaggcccccacagtgcctccatcccccagccctgcctttcctcccaagtgcagtgggggtgtcttgaggcgaggggctctctaggcactatgcctcctccatagtcctccagaccccctttacttgaagactaagcaactagccctttggcagtcagttctaagggtgaggggcctgaagtgtcagcaagggtcagagccaggcgcctggcagaggctggaggggcagaggcaatggtgatgggagccagtgaggccagagcatgagccaaatctcccctctgatcattttggaccaagtgcagtgagcatgagttggaggtgtcctcaaattgcaatcctctggggtcttcctctgtctcttcttttcgggtgagtttggcagcggatgtgaggaaggtgctcttcatcagtcgctgggttcatgaatggtcctcatttcctgaatccttctggatcattctctgaattcagcaggggcatgtctccctgggctgacgggtggggctccaggtgcatctggctgcagcactctgggagggggcccgaggtgcatgcagatcttgagtgggtctcagagaaagagacacacaggccccacatgcgtgtgcacacgcacacatgggcatgaatgtgggtacgaggcatgtgtgctccacacgctgacttcactgggaacactgaccccagctgcagagagaccggagcaagggctgagggaggcagagtgaaggagcgctcatccctgggagggcgcctgggaggagaagtgagtcattgaccagtggtcatggtgagtttgccttacggagccatctctggagcctgaggtcacagggtctctggaactggcccttcaagttcctgggaagggttttgacagggaagtcgtccacaagggctttcccccactggaacactgcctagccttctcagaaacgccccatgtctgtggcaggcttggtgttcctcctgccattccaggctttctgctgcccctcccctcccctcccctcccttcccctcccctctcctctcctttcctttcctttttttaaatagagatggggtctcctcatgttttccaaactggtcgcaaactcctgggctcaagcagtcctcccaccttggcctcccaaagtgctgggattacaggtgtgagtcaccttgcccagtaatttgtgtaagcatataccttggattctctactaaaccgcctagtcttgccagtcacttcctagtctttcctgcctcctggccttcctttatctcagtcccctgctgcctggaatgctctaattctctctctttctctccctcttttgtgtttgtcagaatcctcattgttttttaagcccactcaagcctcaagctccacctctcccaggaaacatgggggcctactttagtcgaagaagactcttagctctgaagttctttgaaatcatctcttcgcctgaggcttcagtttccttacctgtaaaaatgagacaataccatgtcatggtttgttgtgaacattccctgtgatgaccttcataacagtggccagcacgcagtaggttctcagtgaaatcctcattcctttcctgctttacgccaggcacaaaaatacagatgtgaggtgcacccctggcttctcaggagggagcagggctggggtggaggaggcctgggtgaggggttccatacctacccagggaagggaagggatggcaggaagcctttgagaagacctgctactgggctgggtttgaaggacagttagaggccatcaggagcacccgaggagcaggagtacggtgaggcagtggggcaggaggaggacaggctgggaagatgggagacaggtggtgggaggggctgggtgcggggcactgtcgggggcagccggagagaagacgagagcctggactttatgaagaggtgaggaagtcactgaaggagttgagggcggaggcaacaagtgggagaggctgagccaggagaggcggctcagtggcctgcaagggtgggtggggaccagtggaaggcagccctgactcaggcttagtcagaggtcctggtccaaggtcccctgcccgctccccgctccccgctgcagcctcacagtgcccttcctggaataaaaggtggaaaatgagagtttgctgtttggggctgccattcaacttgcctgggcagggaggatgatggctgagggccgccagcatccacggccctgctcagtccccatctccttgcacccactgtggtaaccaagctccccaccctgacacctggcttgtcttttctggggtggtttctccctcagggacttcgctcctctgttcagtctccgccatttgcacagcccctcagctgagtcggtttcaagtgagcagagcacacaggggctttgaacaccagccatgccgggctggggaggagggcagggaggaggagtgtggcaaaggcagccacgtgctccacgtgttcctctggatgcccccgctcctcctggcgccccgtgagggtctgtgttggtccctgttgtgccctgatccccagcaccatgcctggggaaccgttaaatgaatgcttattgaacgccagggtcactgtctccaagtctcaggtgtatcgcaggtgcacagtacctgcctccgccttggatgcctctaccccaccacagtagtataattgcccaggatgtggggcaggggcagagcgacaagggttgggggagatgactctctcagccctcccctcagcaagccctctgccagagtctcactctgtcctcctccgtgcattccgagaggtaagcgcgactaggagtgtgggcccaggtgacctacgactgttcgcgggggatggggccgtcaggaggggcgtggcctccactccatgcctctgaaatgtgctggcctctgtctggaaattgctcatttttcttaccactgagcttggcagtcattggggaatttctggagggaggggggatcctggaaggaaactaccgtgggacctgttgtttccccagaagctcaaacacaaagagaggatggagtggaggtggtgctgcagagggggctgttttttcccttaagaacaagctgcctcctgtcggaaaaaggaaggccgttatcctttcatctcatgtttttttcctccaaccccgggtctctgtgtgggatttcagcagcgggagagcgggtggcaggaggaggtctctgcatgaaacagcggcagtcaggtgggtgcccgccctcggtgtggattgcacttcgaagccccacagtgaccttgtgacttgcctgttgttatcctcatttgccaaaggaagctcagagaggtaaacagacttgcctggggtcacacagcatgtactcatggagctgctacttttttatttttatttttatttttttttgagacagggtctccctctgtcacccaggctggagtgcagtggcgtgatcttggttcactgcaacctccacctcccagattcaagtggtcctcccacctcagtctcttgagtagctgggactacaggtgcatgccaccacatctggctatttttttttcttttttgtattttgtattttgtagagacagggtttcaccatgttgctcaggctggtctcgaactcctgggctcaaggatccgcctgccttggcctcccaaagtgctgggatcacaggtgtgagccaccgcacctggcaggagctgctatttgaacccaggtctgtgtggtgccaaagtgatgttaaagcttccccctggatgggaagaatggcaggcctacacaggcctgctatccccagtcttattctagatcatgccaggccttccctccatcagagcttactgtttccatgacctcctgggtgtctttcctctcatgccttctcctgcatgtgctgctgagtcagtgtgaggttggcttctgggcacctgggtgagtgtgtggggacttggggagacagcatctggtgggatttcaggctgccacatactcagcctttgggtagacagagagagctgggttttgggggaccggaggcctactgctaggaactgggaacagaagcaaagtcggtgcctacagctggaaaggaggcagcagtcacaaggaccccagatccactgtcacggggtgtgcgtttgtccttagtcctgtgggagctgacggacgggttaacttggatgcaccagcagaaagccacaaggctgagactgcccagtggcgaaaatcatgcaccatgtgtctgggcccctgcctcccactctcccagaagggctcatcctcgagcctgcccaaggggagaacagaggtggccctggctgtaaataatccccaagagccacaaggcccaaggtcccctgcagggagagaaacagcctgtttgcctcctaggagccagaaagctcaggagagaatctagttcacagggtgaagatccatggagtgcctgctatgagcggggctcgaaggtgtgtgggtccaaagaggaaggaaacagcctcctcacaccctcaggatggctgctattaaaagagcagagagggccaggcatggtggctcatgcctgtaatcccagcactttgggtggccaaggtgggcggatcacctgaggtcaggagttcgagaccagcctggccaacatggcaaaaccccgctgctactaaaaatataaaaattatctgggcatggtggtgtgcacctgtaatcccagctacttggcaggctgaggcaggagaatcacttgaacccaggaagtggaggttgcagtgagctgagatcgtgccattgtactccagcctgggcaacaagagcgaaactccatctcaaaaaaaacaaaaaaacaaaacaaaacaaaaaaacagagaagagcaagtgttggaggacatggagaaattggaacctttgtgcactgcgggtgggaatgcgtaatggtgcagttgctatggaaaacaatatgatggttcctcaaaaaatgaagcagaattaacataagatctggcagttccacttctgagtgtatacccgacagaattgaaagcagagtctcagatatatttgcacacccacattcacagcaacattctcacgataggccagaggtggaagcaaccccagtgtccatgggcaggtgagtggataaacagagtgtggcacacgtgatggaatgatccctcagcttcaacaaggaaggaaggacaggccataacacaggtgaaccttgaggacattatgctaagtggaataagccagtcatgaaaagacaaatactgtatgattccactgaaacctggtacctggagtcgtcaaattcacagagacagaaagtagattggtggttgccaggggctgggggcagaggagggaagggcagtgagtgttcaatgggtgtagtgtttagacttctagggatggatggtgatgatggctgcacgacactgggaatttacttcataccactgaactatacacttaacagctaagatggtgacttttatatcatatatattttaccacaattaaaaataattttaggccaggcgcagtggctcacgcctataatccctttgggggctgatgcctataatcactttgggaggctgaggcgggttgatcacgaggtcaggagatcgagaccatcctggttaacatggtgaaaccccgtctctactaaaaatacaaaaacaaaattagccgggcgtggtggcaggcgcctgttgtcccagcaacttgggaggctgagttgggagaatggcgtgaaccagggaggcagagcttgccgtgagctgagatcgcaccactgcactccagcctgggcgacagagcaagactgcatctcaaaaaatagtaataataataataattttaaaattaaaacaaaacaaaaaataaagtggcctggtgtagtagctcatgcctataatcccagcactttgggaggccgaggtgggaggatcacttgaggccatgagttcgagactagcctgggcaacacagcaagaccaccatctctgtttttttaaaaagtaaataaaaaaataaacaaaatggacgcggactaactggcttccaggggccaaattggcatggtgcccttggcattgtattatgtaatctttccatcaacctctgtgagagagagctcccttcgttctgatgcagaaaccaaggctcagaggcatgccttttctcgcccaaggctttcactggtctttatgtctcaggtgagcactgatttggtgcattgtgctgggctgtagcattggcactccgtctgccagggcttctgatttcagctggggcccctcatgcactcaaaacaagagaagaggacaagggccatgtaattggtcgtgaaaatgcgtggacagatcagggaggcctgagtcatcaagaaggcttcttagaggaggaagtgggagaagtccagaggctatggctgggccaccactctcgccccagcccttaccaggactctgctgggtgggaacaggctgtgtgggattcctcaggagaagggcacatgccactggagccatggggaggagcagggcctggggagcacctccctccatcctcctggtgcaggagagctgccacacactgtctcattggagtccccagctgtcctcactgggggatcttttcacacctggggagggagtccttctgcctgagagctgtgtcttgggcctgccactctggcctcctctctcagcagctgggggatttgatgctgttggtgggtgtgggcccctgagatttgcccacctggagattcctgggcttgggtagggttgtcagattttgcaaataaaaatacaacatgcccagttaaatttgaatttcagatataaaaatgcatcattcttcatataagtatggcccctgtattgcatcggtatttcatgtggcaagtctagtcttagggctgtgtccattagagaaggggcagtggatgatgctctgggtgttccagggcctgccacagacattggctgtattagtctgttctcacactactataaagaactacccgagactgggtaatttatgaagaaaagaggtttaattgactcgcagttccacaggctgtacaggaactatggctggggaggccttgggaaacttacaatcatggcaggaagtgaaggggaagcaggcacatcttcacatggcaacaggagacagagagaaaagggggaagagcaacacacttgcaaacaaccagatctcgtgaaaactcactatcatgagaacagcaagggggaaatctgcacccatgattcaatcacctcctaccagatctcaaccccaatatggagattgcaattccacatgagatttgggtggggacacagagccaaaccatatcattggacatccaggcccaggcccaggctcaggcccagcccgtcccggctctgccgagacacatgaggcagccttggttggagctgccgctcagctcagtgggagctgaccaggcaggtagcaggggctcatcattacctgctgtgatggctcacagcctctgttcctgccagtgtgctgtgtgtctcgcagagcctcagcgggagactggcactgtcagtaagctggggtcagtaagctgagctctgcatgggcctcccccatctcctgcctgtgtcaccaaggcctcctgaatagcaccccttcatccttgagtctcctaatcacccttctagccattccctcatccatccatccatccatccatccatttatctgtccatccgtccatggacagatacttgttaagacctactgtgggccagatgctgtggcagccactttgatgtataacaccccagctgctaggagggatgaaaagaattcacagatatgacctctggttagccagaggacccaatttcccatgctcaggcatcaggtgatctggggagagattgtccagaggcaacctttagacaccagccactctaggaaagttcctggaagtagcttcaggctgtgatacagtgggagcaggagcgctgggaggccaggagtcccaaaagtcagggagctgagctggttctgccaaaggtgtgtgagatgcttcccccagtgttctctgtctctttcgtcagccctggtgccgagtgcccactcaggaagagggagagccgtgggaccttcgagccacgcttatctggctgctggtgcctggcacagctcctgcagatagcagaggctcagcatgggctcgttgactgactgtcactttatagatgagaacacaaaggtccagagagtggaggtaacctgttagaggtcacacagctttgcagcatgggtgggaaggtggtggactgggacagggagcacggatatggttgtcaggcattcttgctttcaggcttggtctgcctctcaccagctgcgtgattttggaaagacattgaactctcaacctgataggcctcacctgtaaagaggacgtcacagctccctctcaggctgtgagatcctgaactgctgaggggaggggaggagtgctctgcaatgtcacttgagagagtcctcatggccacacctgccctaaacaagcccctcagggcctgccgagccctgggcctcttctacctgtctggggtcaaggcagggagcagtgggccccagcagcagacagcaggaatcggacctcctgctagttggccttcctggcgccctgcaggaaccaggaggccttgctccggggtgtgtacagctgcctggagagctttctgtgatttatggcctgagtgccaaggctggatttactgcctgcacgggttgtgcaaggaggcccctcccccggggcagggtgtggaggggagggagccctgagcccctgcctctggagctttcccagtggggaccaggccttggtggggacctgccagagatgctgccttcccactgtggagcccaccccaatgtcattgctgctttattttcgttcctgtctgccagagttcttcttagccatggtaaaaaattaaaacccgatagaaaatagggaatcgccctttgatccccaccccagagatgcgcattttaatggtttggtggtcttacctcctggtggagcgagggtctggggccttctcaggtatgtccttttaccccccgacaccaccccgcattcctcgagcctctgaccctttggccttgccctgctctctagcagatgcggggaaggaatggggctgtctataaaaaaatccacagtttaaaaaatgctgctcataaaaattcaccagggcggggtttggcatttgtgggtgggacagagtgacagaggctgcatggtgctttggtgaggggccagtcccagtcctggggtggcccatggcactgcccctcctgagggctggaggaggaagggggatgggcttgggagacagaggggcatccacttgccctttgaagtgcaccccatccctgcccccatcctagaatcagcctccaacagtaagcagtgactaaagggccctgaggcctctgtgacctcttgactctctgagaccgggggtctcctctatgaagtgagaattgctgtgaggggccaggagagcacagccgaacgtctaacagtgccaagcccaccaccaacatcctttccttcctcctcccccttcctaactcgggtcttcatgtcctctttgtctgtctgtccagccatccagagctagctggctgctagcgtcatgtgcatctgcagatcaggagcacccctgggccaaggacctggatccgcctgggtgcggtcagcatgtaggataggtgggctgcagtgtggctgtggttccccagggaagggcaggtgtctgtgactggaccttcaggtgctctgccgtttaaagggcagcagaggtcacggggactgtgagggagagcctgtggctgagtgcagtccccgctgcgtctggtgtggaggcagcatccaaggaagcccttgtgatgctgtcaagaggacagcttagctggggagggagggaggggctgagcagggtcctgtcatgcccttggatgaggttggcttcctggtaggctgcaaatcatatttcactttggaaagagctcagcgcggaatctagacacttgaatctcattttatctcgcaatggagtacttcgcagctgtcaccccgtggcggcttttatctggttacctggaggtcggtaccagatctgcagctgttgttcccgtgcaggttgtgggaagcccagagcatgcgtctgcgggaagagggaagggggaggacacgagaggacatgcagtggggatgagcaatagtgaggaaggcgtatgtctcagttacaagacagacttgacttcacttctgggagataactctttgtaaactatgacagcagaaagataagtccagctaattaaataatttaaaattgaaattgagatgcatgggtttttttcctaatgtgtttcccaagtagctttgttcctgttggaagatgaaagcttctcctttagcaaatgacttgggcctctgactttctaagagagcaattcccaggaacatctggtgagtgcctgctggctggctgggctgtagggaccaccttgagagatggtgatggggaaagagaagccctcaataccacacttagggaaaagtggtttttaaagtccctcgtaaagtcctgacttaccacagtttagtggcaatgacttaccacagtttagtgacaatgactaaactgagaaacagagtcaagcgtttgaatatgtttgggaatcagtaaagggcaagagctttttttggtagctgcctgcaaaaggctgcaaggaaaggaaggctcagggctactgcttaggcgctccacgagggttcccgcgacgcattgcccttacctggtgctttgcatgagaactcaggagtctgagctttttttggatgaggggtagatccctccatcctagtgatgtgaattaaagatcttaggtcctcctctaaagacctcccacagcctggaacttcaggttttcatcaagtgcccaggacggaatgggaatggagctgtaactagccatttattcctgcacgggaatgagcctgtgcaacccatgcctgagaacaggaccagacagcaggaagtgaggcgagaacctctgggcagtgaggggtggtgaaacgcagaggggaaagctgagagaagggccgagggcaagctcctcttgctgtggctgcttggaatagtgtctgtccagaatcatcagcaggtgagaatggctgttcccccatctgtagattggcagccttttttcttttctaattgatgcggttaccaaagatcaaatgcccccagggatgcccacagaagcttgccgggcctctttctaataatacggtctatgaatacactcctgccagctcatggaagcaagtctccactgctggctgatgttctgggaaatccataccctcccccatttccttcctggcttttgagtacccatgtccctggtgtcaaagcacctctagggatctaaacttcaaaccttgcctctggttcctctggggtttggcaggaagactgttctgtttggtcttcagctctcttcagctctcttgctcccttcctcctgcaatctctccaaatctctgatctgagagctgattaccctgtctaggaccccactgtgcgtggacccccggaacagcatcctaacctcggttccacatccaaccctcacagcccaatctccccaccacagccagagtaatgttttttcttttttctgacagcttcttgctgtgtcgtccaggctagggtgcagtggcacgatctcagctcattgcaacctctgcctcctgggctcagcctccgcctcctggactcactcaatctcctacctcagcctccctggtagctggcaccagaggtgtgcaccactgtctggctaatttttttattttttatagaaatggggtctcgccatgttgcccaggctgttcttgaactcctgaccccaggagattcaccctccttggcctctcaaagtgctgggattataggcatgagttaccatgcctgacccagagtaatctttttaaaaccaaaatcaaagcatgtcagcctcctgtttgaaccttgtgttagtcttttttttttttttttttaagacggagtcttgctctgttgcccaggctggagtgcagtggcatgatcttggctcactgcaacttctgcctcctgggttcaagcaactctcttctcagcctcccgagtagctgggattacaggcatctgccaccacgcctggctaatttttttgtatttttagtagagatggggtttcaccatgttggccaggctggtctcaaactcctgacctcatgatccacccaccttcacctcctaaagtgctggaattacaggcgtgagccaccgcgcccgtccgtgttagtccattttgtgttgctataaagaaatacctgagactgggtaattgataaagaaaagaggcttaattattaattagctcatgtttctgtaggctgtacaggaggcatagcactggcatctgttcctggggaggcttcaggaagcttccagtcatggcggaaggcatagtgggagcaggtgcatctcatactgagagcggggataagaataggcggggaggtgccacgcactcttaaacaaccagaccttgtgtgaactcagagcaagaactcactcattgccaaggagtagcactaagccattcatgagggatctgtccctatgatcaaaacagccccccaccaggccccgcctccaacagtggggattacatttcaacatgagatttggaggggacacacatccaaaccatatcaaacctcttcagcagtttctaccgcactaggagtaaatttcaaactcctctgtataaccgagaagcccctgcatcatctggctcttgcctccccttccagccctgtgtgactcactttcccctgctcaccattccaggcctcctggccattctcagcagtaccaagctttcttctgcctcaggactttgcacaggcttatgcctctgcctgaaatactctcctgtccttcctcctacccccatcttttgctaagattgatttttctcatccttgaggtcctagcttaaatgtcacttcccaagagagatcttttttgaccacccagtctaaaataatttgtaatgacataatttgtaatttttggggtgcttgtctgtttactggcctcttctctgtccttttgtgtgagttgttcaccttgcatccgtcagagcaggctaagctatgtgcagtaacaaacaactcccacatcgtagtgtcttcaaaccataagggcttatttctcagtcattctaaatgtccatcacaggttggtagggggcctgtgctcattgtagaaaccctggctgatggagcagtcacatttcctaacattctcagtagccataccaaggacaagagagctctggagggtcttatattggcaattaatttctccagcctagaaatgattatgtgtcatttctgctcacaagtgatcggttagagctagtcacatggctccacccaactacagggctaggaagtttccagtgctcacaagagaggagtagaaatgtttgtcagacagcactaaagactcccacagtaatcaataaatactttagaaggatggagtgtctagaatgctctttccatggcagcagtcgtttacagcatccttaaggagtcctgctggggatcttgtatttctgctgctcaagcccctggctctgctgggagtcagagttctggtagggaaactcagcagacaagaggtcccctgagacctggaatgagccaccttagaggcagctgaggctggtggcctcttggttcccttctcccgttgggacacgtttcccctattggtgtcctgtgtgagacagccccgccaaaagggtcctgccactcctctctgaatatactgcacagctcagggtctggcatgtccaggatctgaatagatgatcctgctggaggagtcccagtaggacccctccgagttctaggcaggcagagaatgaaagcagcatttctcagaaagccctgtgcatcctgttaccaatgcaaaggaatggcacttcagcaccccagaaaaggtggggaaacctcctgcatctgctgtgggtcctaggggatggggggcaggtgggaacagtagaatcctggcctgtggcctgatttctgaccctgttccctcaactatcatacccttttcacttgggtaggctgctgcagctgctctcctctctatacttgcatttgacaaagggtaccaccacagcaggccctttccaccaggctgcacgcggtcacacttgatacagatgggctttgggagataaggctgtaccagattggtgatcacacacttgactgtacatcgtggcctctggtggcaatcactaatgtaagctcacattcctgaggcactcaccaagttcctagcactgtactgagagctctatgtggacttgcatgtacatcttcttacctatagcatggaggtgctgctattgggcagctggtgaaactaaagcccacagaagtagtttcctaattaagtaactgctagtcacaaggtagagccctcctttaatcctatgcttccagactccaaacctgtgcacttaactgttactccgtaagaaaaggtttgggtctgattcctcttctaggttataaatactagggagcttcctctttgagaagcctcctaccccatctccttactgtacctagcaaagtgtctgtcatacgattagcactcaataaaagttttaaatgtgaatgagaatggtaaaaacagaatacttagtaggctaacactaggatattcttctgattgcacttttttgttaagttggtcacttaagactaaggtaaagcttctgtgctttttgatatagatgctgatggagggactggatctggtagatacatagcaatctaatcatggcccaaagcctccaatatagtatacacatgcatcctaacttacaatgatcaacaatgaaagaattaattacactgtgctagcagccatggatatcacattgcataagagatagttccctcccttagagataagaggcagacgtttaaactgtcagttgcgatggcttgtgactctcatgaggtctgcgtaggggtcagcacggtcacaaaacctgtggaggaggaggtggttaggaaggaaaatccaccgagatgaagctgtactggatacaaaatcacacgttcctgggctttggcagggagcttgcccactgcacttcctgcctcgaggctatggctggggtgggattctggcccttgtaggcggcctgggtccagtctccgccatgcactcactaactccattactgctaatgggatgtcatcagcgaagcgagtggtggcggcaggtggagtcccgccccaagacccccgggcggcatccccatcgccgcgctccagcactcttcgccacctcgtaattttcttctgtttctgtatgatcaggtctgtccttcgcttttgctttccattacttcgtcctagccctggcctgaatcccacaactggcgccccaccttgtgcacccgcacccgccctcaataccggcgggcagctcctccactgccgcagggttaccagctgcgtgtccgaggggcagagagagaaacagagggggacggggcaggcgcgctgggcccgcccccccgtgcctggggcagcttctcattggtgaaacctcctccccggccgcccgctgcttggaaaatcagcctcggattggctgacagccccccgacgggcgtggcttccgaggagagggcaagaacggaagcgagggcgcgctctcgagaggaggggttgcctaggcgacgccggaggcgcgctcggggggtgggaaagcgagcccggcagctcaatgacaaatcggtggaggacggctggggtccggccccgggagggggcggggcgcgtttaagagctgcgggccgggtgcggacggcggaggcggcgggactggtccctggtaagggcgcggcgcccgcgggccccgggcggggtggggcgcgggctggggagtggggtacgccgcacgcccgcagcctcttgctccctccgtgccgggctgtggccgggcggcggcaggacatgtcgcgccccgaggccggcggagggcgacgccccggcagcggccccgctccgctccgggaggactccctgggggagtctcggcttcctgggctgcctggggctgaggaagtgggggcggcctccgcctctcccttgtagccgcggttccttccctatcccgcagatggctctgcttccacttcctgccgcgggcctcccgctcgggaccgtccacttcctcagtcctccggccgcggcttgggcagggtcagggctgggaagtgttgcaaaaacttaactgccctcggaacttgcacgcgccgtgaactgggcggtgttcctaaagggcttcggtttgctggttttgttttggtcctgtcttgcaaatgagcataaagttgtttctcccccagcctcctcccctttcctttctgataggggccagcggcgaaggggcttctaaggggaagcgcctggactgggcatcgccgtcccggttcttgccgcctgtgggagtgtgaggttaaccgtgctcggtgcagggttgcggggcgcggagcttgctgcgtccacactgcttgtgtgagcagtgtcctctctgtgctcatttccaacgagaaacgttggaactttggtgttcttatcaggtgagtcttcgggagagaagtgcttgtgcctggcggactgaatgaattggccgtggaagagacttggctgattgctcatctgggttacctgtgactcatcttcagcccttgtagaacagtgcactttctgctctgtcctggtttcctaacctcatttcttctgaagttttggggatggatggtgggcatggagtatcagaggggatagtgaatcttttagaggtgtcaatgactgatgttccaagcagagccataagattgttggatgtcaaagctcagaaccggtcaaggctcagaatgctccttaaacctggagcaatagaagcacagtatcgaagttcccagaaatgggccgaccatgaaaggtagcactgcatattgggaaaaacaggaggggtgagtttgaagacctgggtttgatgcaggttctgagagtttaccggtgttgtgatgtggagcacgatctttccccctctgagctccagagtcagcaactgtagaagggtgatgatagttatcctaattgttaggattaaacgaaataggagcgggggagaagaaggccagggagacatatcctttgtgcgtggctttagttgtcagccggtctgctttattctgaccacatctggggctttccttccttgcccattcacattgcttcccattggaaacagcactcttatcggagatctcagccagatttccctctgcccgaggaatagaacattttcccaggattgtgtgtggaaaatagtgtaagttattagatatcttttgggaacttgggacctagaccataaggataaacaggatttagagtcttccacggcatatgaagagattttggtagaagatgagggtagaaaagttctaaattcttgccttgactgaagatggcttgagattccatgaaaaattttaagcctgagaattgagataatcctttttttgtttgtttttgggggcagagtcttgcgctatttcccaggctggagtggagtggtgtgatcaccgctcactgcagcccccacctcccaggctcaggtgagtctcccacctcagcctcccgagtagcttggtacagtcttgcaccaccatgccaagctaatttttgtattttttgtagagatggggtttcaccatgttgcccaggctggtctcgaactgctgggctcaagccatcctaccaccttggcctctcaaagtgctggggatcacaggtgtgagccaccccgtctggcagggataattctttcttccaaatcacgtaatcctactatgcctctttgcatttagttgctaaattcttacccccctcatgtaacttatggaagttagaaacatcattagagacctttcttgaaagctaaatttggagacaatgtaagactagagtgcgaagagatctaggtgaactctgtagttttccagtgtaacttgtctccagatggtatacaggagtcccacttttccttggctccagttactgctaaacagcccctgctctagacatgcaagacgcttggtttttttttcgttttgtttttttaaatgaatgtatgttctgaatgttatcgcaaagagagccgagcacagaggaaaaggaactcttccttcatcacatggcggagtagttaaggaggagaaaaactaacagttactgagcatcagctgtctgcttggcacagaccactgatccaagccataccagttaaatatgtggccttggagatttgaccatgggctgtctcctttagctcctcagttcttttggtacctaggaatataaatattggtgtatgtgtacatatattcttagatattccaaaaagcagaggggccagtaggcaagagggttgatgagtcttggataggtgacagtggaaagaaagatgaagaggatgtggaagtgagtgtcaaagagggacggtatatgtgcttactagaagcaattgcaaaattctagccaggtctcaatttcaagtttgtcactttaaaaaaagtagctgcttataattttccttagtgttctcctggctgtttttgtttttggtgatggtggctagttgttttttagttgaaatctaaatgcagaaaagaaaaatgccattaattgataattaccaatatattgttttcattgttgcttttgtcagtgctttgtgggcattttttatatatagcattgttccaagctatacggcatgagatgaaggaaatatagtagtttggtcctgcgtgcctggctgcctgtaaagtttgcctaccttttgaatgagttttctgttgctgcataacaaatttccccaaacttagcagcttaaaacaacagacatttatgatctcacacagtttctgaagttgaaatctggggacagcttggctgggtgcttctggctcatggtctctcctgaggttgcagtcatctgaagctcgactgggaccagaggatctgtttccaaaatggcacgttcacatggctgttggctggaggcctcagttctacaccatgtgggcctatgcacagggcttttcacaacatagcttttctccccagagcaagtgatctgacgggggtggggagagagggagagaatgaatatgataatgatcaagatggaagcagcagtatattcgtggctgatatggtttggctgtgtccctacccaaatctcaccttgaattgtaatccccataatccccatacgttgtgggagggactcggtgggaggtaattgaatcatgagggcagtttctcccatactgttctcctgatagtgagttctcacgtgatctgatggttttacaagcgtctggcatttcccctgctggcactcattctctctcctgctgccctgtgaagtggttccttctgccatgattgtaagtttcctgaggcctccccagccctgcggaactgtgagtcaattaaacccctttcctttataaattacccagtctcggatatttcttcatagcagcatgagaacagactaatccagtgtctaatcttggagatggcataccatcccttctaccagcattcagaccagacctggcacaatgtgggaaaggactacaagaggggaggtcagggcacatcagtattcttggaggctagccaccacaacttttttaaggtttagtccagacatcattgagaaaatctttctttcagatgtttactgaagtatactgtaggagatggaaagacagctgaggtctttagtattgtagaagctttaatactatatgtgaaacttttatgttctttcttccggttctttgttagatgctggaattagccaagtatgcagtagctttggaaatagaaattcagatcttgctggtccctaaaccaaaaggaacatctgaatttttttctttaaccccaaaacaagttggtaaaaaaatattgccaaagtaatctcctttgatgaatggcttaaaattagtcattcattatctgtgtgttcttaaaaataaaactcattggcaaagtagctgaaaaattttggggaacctaaaccctcttactcctccccattattttaaaactttggatactgcttgtttgcctagcagttcttcagttcacttttgagaccctcatacattttaattattgacctggatagaagggcgctattcttttagctccagatgaaatcttcctgaagtgcctataggtggagagaagagtttctggatcctgagcctgagcctggctaaatgacctctaagtcccttccatctctgaaaattctatgatccttattttttttttataacgaatatcctttgagttgtgcatatttataacaaaatatttcattgatcatgttaaattgcaacctcagaagacaagcttttctgagaatagcttttgttcttcccaatccagttgaaggttgttagagtcactgttaggcagagttgaaaagtcagcactatttgcacttcctctgcttcctatttttggccccttgcccatcctctgccctaatttatgagctagtatctttcttttctttcattctactttccttgtaatccccctccttcctcccacaggaaggattggtggccagtcctttactgctgatagctgatgctattgttaggaatgaattttagccaatgtgttacctctagtaatacttgcatggcaaaccttttaaaaatctcaaattatatgtgttcatgtagtaaacactgccattttttaacatcctaagtagccctaaaatttagtcactttcctcatgtgcattgttgtctccttagtccccaccgtgttgccggcctggcctggtgcatacccacatctgctcttgacccctctgtttttctactctgtagccagaattaccttttcaacattcaagcctaattatgttacccattgacttgaaacacttcagtggctttccagtgctttcagtcaaaggtcccaaatccctcaacttggcctacactggggtcttgaatgatcccgcccttccttacctcctcagtgtcatcttgtactgggctctgcctctttctctctgctgcagatagctgtgaaggtctttctcgagtttcttgagtggactttgcttcctcttgcttcaggccttcctgaatgcagtgtgtgtgtgtgcaggcacgcgtgattgggggtgggggagtgtggaggagtcctaggtaggaaagcgcttggcacattcacagggctggaagaaggcaaggaaaaggccacggaggccacggccagtggagggtttagctgccgctcatggtgagcctttaaggagcgttaagcacagtttcatgtgcagtgttagaagccccattggaagggctgtgtggagaacagattgaagaggggctggagtggtaatgaggggtcacttaggaagctggggctgttgaatgaatggtggcagagaagatggaagaagtgcatggctttgaaatgtatgttggagatggaatagctagaaatggtcatgaattgagctggggagaggcaatgggagtcaaaaatgacttccaggtccctggctttggtaacgatacggatactagcgtgtccggaattggtgggttcttgggctcactgacttcaagaatgaagccgcggaccctcgcggtgagtgttacagctcttaaggtggcacgtctggagtctgtcccttctgatgttcagatgtgttcggagtttcttccttctggtgggttcgtggtctcgctggctcaggagtgaagctgcagaccttcgcggtgagtgttacagctcttaaggtagcgcgtctggagttgttcgttcctcccggtgggctcgtggtcttgctgggctcgggagtgaagctgcagatcttcgcggtgagtgttacagctcataaaagcagcgtggacccaaagagtgagcagtagcaagatttattgcaaagagtgaaagaacaaagcttccacagcgtagaaagggaccccagcgagttgccaatgctggctcgggcagcctgcttttattctcttatctggccccacccacatcctgctgattggtagagccgaatggcctgttttgtcagggcgctgattggtgcgtttacaatccctgagctagatacaaaggttctccacgtccccatcagattagttagatacagagtttccacacacaggttctccagggccccaccagagcagctagatacagagtgtcaattggtgcattcacaaaccttgagctaaacacagggtgctgattggtgtatttacaatccctgagctagacgtaaagactctccacgtcctcaccagagcagctagatacagagtgtcgattggtgcactcacaaaccttgagctaaacacagggtgctgattggtgtatttacaatccacgagctagatataaagactctccacgtccccaccagactcaggagcccagctggcttcacctagtggatcccgcaccggggctgcaggtggagctgcctgccagtcctgcgccatgcacttgcattcctcagcccttgggtggtcgatgggactgggcgccgtggagcagggggtggcgctcgtcggggaggctcgggccgcacaggagcccatggagtgggtgggaggctcaggcatggtgggctgcaggtcccaagccctgccccgtgggaaggcagccaaggcccggcgagaaatcgagcgcagtgccggtgggccagcactgctgggggactcagtacaccctccgcagccactggcctggctgctaagtccctcattgcccggggccagcagggctggctggctgctccgagtgcggggcccaccaagcccacgcccacccggaactccagctggcccgcaagtgccgcacacagccccggttcctgctcgtgcctctccctccacacctccctgcaagccgagggagtgggctccggccttggccagcccagaaaggggttcccgcagtgcagtggggggactgaagggctcctcaaatgccaccaaagtgggagcccaggcaggggaggtgcctagagcaagcgagggctctgaggatttccagcatgctgtcacctctcactagtagtgacttcagtagctaataaatgggggatagtgaaggagcagattttaagagggaagaatcaagaattctattttgggaataagttgagaatcttgtggcagcccagtgggcaggggcagcagcaaggctgtgagcctggggccaggagagcggtcagggctgcatcctcaggttcgtaagttgtctgtacagccactgggctgtatgtggtgcagatgaggagggagcaagactgagctccgagaagtgctgacatctagatggggaggaggaatgcctggcaagtggcgccgagaaagggcccagagagccacccgggaagcactcagcctgtgggagaatgtgggctgtggaagccaggagggatggcctcaggagggggacgctggaaggggccctatacaggcctgctgcgggccttccctttccaggcagcgttttgtcactcttgctacttgctcattttaaagaggaggagggcatgggaaggaagaaagaagagtttttattggagctagctacgtggagtttgtgggtgatcttgatctcacaaatttctgtgagcttatattgggaggaagttggattggaatggtttccgtaaatagtgagggaaggaaacaaaggcttttgctacacagtgtggggtctgtgggtcaggaacatgattagagactaggttagtggtgccaaatcttgggctccactccagacctactgaatcagaatatgcgttttcacaagattcccaggtaaactatgcattaaagtttgagaagcattagcacagataattcctatagaggaattgtgtcattagctagaaggatatatgggggtcaaaggcacacacgcatgtgtgaatctttagggtgaagattcaatagaacgtgtctacatgctgttggggatgatcctgtagcaaagtaaagactgattgatgctgcaggaagaagggtagtggtaggaattaagttcttgggcatggtggtggtggagggcttggcctttgctaagagcaggaatgtgtactccatgaggctggagacaaggagaagaagggcgtggaaggtttgtagatttgttgaaggagctctgagggagttagggtttgatggcttggtgttctctgggacaaatgaggttaggttatctgtcaagagtaagcagagggagggcacaggggagagtcacagcgagattactaggaagtgtgggggaatgcccattcgtggtttgtgatcataagtgcattgagagtggagtgctgggaggctgctttcttgagtttctttccctcgacagcagcatttgcatgctgggtgcaggtgctgaaaacagtgagtgagatggaggggaagggagcagggagatgaggtatctgcaagagggcttttctcatgtcaggctttgggatctaagctggtgaagggaggcagtgcagcccagagggtcttgttatgcagagagagagtgctggaggccaatgcttgcaggtgtcaagagggcagagaattgtgtgtgggggtggtatttgaacaagtgagcaagaaggatggaggctgaggctagagggttagaggagataactgtttctggtgacggtgaagttcaggtaatgaccatgataatgttagatagaaggaaagaaagggttttcggagaagagaggatcaaggacttgagaggggccgagcttggctgggacatccacatgcacagatgtcattggggaggacgacaggagttgggtagaatggaagtctgcagaccagaagcagatgtcctcaataaatgagggaagtgaccaggaagtctgtagctgatagtaacaaggtgaaggacaggctattatggctggaaaggccaggcctcaaaggtatgggggcttttgtaagacggatggggctaacagaggtactgaagtgcaggtgacattggggagggaggaaggacacatatctggtctgtctggccctgaagcacatggcatgggaggagaaatagcatctgcttgatgtggtgtccccagggcacacccaggtctcagagctagaaggtagaggaacattcttagaagaggtggaggctctcgaagggtttgctggtgtgcctgaggttgcagggaccaggtgggttagccatttcaggagatggatgcagttctgttgggttgagagccctagtcataggaaagagtggggacacctgcacttctggtggtgactgttcaggacagatgttcagcagtgtgctccccttaagaggagggtggtcctgttctagcaccgtagttcccaaacgtggctggggaggtggcagcttccttgtgtgatcctctcagccttcacatactgacacagcagggaagagaaggcaagactgtttctgttagagccgtttcgggagttgctggggagatttaggacagggacatcctgaaatgcccattggttatgcctctaaggcaaattacgctgtgttttgggtgatgaagaaagaagggtgtgaagggcttctgttgatgaaaatctgcctgtgcttgtttccaggtggagtatgcctttggtacgcgttttccacgtgtccctctccactgccctgagacgtaggcagggcagatattgtcagtgagtgggagtgacttgcctaatcctctagtgagtcagtggctgaaggaggactcaaagccaggccccttcattcctcaggacaagggggactgcgtctgagcaaaaagtatcttgccttatctctttcttatggactggcagcttttcctactttaccatatatttggctctgaggccagtttctttctcaagactttctagagtattagagtgatatttatttatttattttgaggtaagttctcactgtcgcccaggctggagtgcagcggtgagatcacagctcactggagccttgacctccctgggctcagtggtcctcccacctcagcctcctgagtagctgggactacagacacatgccactacacccagctaatttttgtagagatgggttttgccacgttgcccaggctggtcttaaactcctgggctcaagcgatctgcttctttggcctcccaaaatgttgggattacaggcataagccactgtgcccaggctagaatgatatttaaaaagcagctaagtgcttactgagaacttcttttaataggtattccttcgtttaatcttcataacagtcctaaggatatagccctcctgtatttcattttatttttgagacgaagtctcgctctgtcacccaggctggagtgcagtggcgtgatcttggctcactgcagcctctgcctcccaggctcaagcaatcctcccacctcagcctccaaacccagctaattttttgtatttttggtagagatggggtttcaccatgttgcccaggatggtctcgaactcctgagctcaagcattccgcccgcctcagcctcctaaagtgctgggattataggcatgagccactgcgcctggcctgtcctatattttattttattatttatttattttttgatacagagtcttgctctgtcgcccaggctggagtgcaatggtgcgatctcggctcactgcaacctctgcctccagggttctagcgattctccctgcctaagcctccctgggagctgggattacagatgcacgccaccacgcccggctaatttttgtatttttagtagagatggggttttaccatgttggccaggttgggctcgaactcctgacctcaggtgatccacctgcctcagcctcccaaagtgctgagattacaagtgtgagccactgcgctagcctatttatttatttatttatttgagatagagtctcactctgttgctcaggctggagtgtagtggtgtgatctcggctcactgcaagctctgccttctgggttcaagcaattctccctgcctcagcctcttgaatagcttggattacaggcacccaccatcacacccagctaatttttgtgtttttagtagagacggggtttcaccatgttggccaggctggtctggaactcctgacctcaagtgatccatccacctccgcccctcaaagtgctgggattacaggcgtgagccaccacacctggccttgtcctgtattttgtagatcagactgaggacaagaaatgttaactaaagctgttagcttcttaatggcagaattcaagtcaagggtttgttttcctgtcccacaactgtagttggtatataactactttttaaaaattctggtaaaatgtacataagataaaattcaacattttacctattttcaggggtacagttcagtgacattaagcatgtttactttgttgtgcagccatcaccaccatccatctccagaacttcctcatcccaaactgaacctctgcacccattaaacactgactccccactcccctcttcccccaccccctggcagccgccattctatcctgctttctgtctcccattgtgattgttttgggtacctcatatcagtggaatcatagtatttgtgcttttgtgtcttgcttatttcacttagtataacgtctttaagggtgatccatgttatagcatgtgtcagcttccttcctttgtaaggctgaatattctacatttacaccacatctgatttatctgtttatctattgatggacatttgggttgtttccgcctcttggttattgtgaataatgctgatgtgaacatgggtgtataaatatctgttcaagtccttgctttcagttcttttgtatatacagccacgcatcacttaatgacacctatgttctgagaaatgcttttaagcaatgtcagtgttttgcaaacgtcggggtatacttacacaagcctagatggtgtagcttactactcacctagcccgtacggtacagccttttgctcatgggctgcaaatctgcacgtcatgttactgtaccgaataccgtgggcagttgtaacacaatggggaagtatttgtgtaaacatatcgaaacgtaggaaaggcccagtaacagtacagtactataatcttatgggaccaccgttgtattatgtggtctgtcattgactgaaacttctttatttggtgcatgactgtataacaactatttttgttgtatattttctctcaggtctttgttttagagcttgtgctctgtgttgcctgcctatgcatttttctccctctttagtgagctttctgacccatagatctgtgtccttgaaataagtttcaacatttcacatcatacttgaagctcttccccaccccactctaatccactcatagagcacagaccatgtagtggctcagagtatggactgctagggctccagtcccagccctgccatccgctagttaagtgaccctggacaaatcatacaaactctgtttgagtgtatgcaatatactagagatgctatagaagtagaagtagaagtagtagtagaatctgtttaagtctctaaataggttttatttgaataaataattcaggatagggacatgtatgctaattccaaatttgccttcagctgttaggagtccagtagctctaatgtctccacggctgcctcttcaggtagcaggaacttcagagtgaatctgtataaatgtgtaaccatctgtaaggctagcagaatcccagattccatgggtgggtggaggaggactttatttcagaaatatattaaaataagcttccaatttcctcccaccatttattgttgctttatagttcaggaaagttatcagataaatgaattaatgtttcagagcttactcgtctgcacagtggctcatgcctgtaatcccaacactttgggaggctgaggcaggagagtcacttgaggctaggagtttgagaccagcctggacaacatagtctctacaaaatttttattttattttttgagatggagtcttgctctgtcgcctgggctggagtgcagtggcgcgatctcggctcactgcaacctccacctcccgggttcaagcgattatcctgcctcagcctcccaagtagctgggactacaggtgtgtgccactacgcccagctaatttttatatttttagtagagacgcagtttcactatgttggttggccaggatggtctcaatctcttgacctcgtgatctgcccaccttggcctcccaaagtgctgggattacaggcgtgagccactgtgccctgccaaaattttttttaaattaggtgggcgtggtggtgtgtgcctgtagtcccagttacttgggaagctgaggtgggagggttgctcgagtcccaaaggttgaggctgtagtgagtcatgatcacgccactgtactccagtctgggcgacagaatgagaccttgtcttaaaaaagaaaataaataaataaaaagcttaccagttaccatttatccttttgaggcctcacaacccaggtggagaacaccagctctggtgttttatctaccaaatattgagcgtccaccaagtaccaggcacactgggcacacaaagatgaatgggcttgaagtttggtgggacaaacagacctcatcttgggggaaatcacgactttccctaagtgaaatggtagacaatattgacaggcatgggggccccctgagactgggaggatgggctggccgggggatatctaggaaggtgaggaggaaatattgcagctgagtcttaaattataggtgatcctcctccatcaggaggaagggcagtcctggcagtaggaatagcatgtgcacagaggtacagaccagaagcagcctcctgcttacaggaagggactccaaagccttctagtttttgttttagttaacttcatttgtttttgttaatttagtttttctttttttggagggggcgcgtgggaagggacaggtaaagaggtatccattagggaatagaaatatctaaaacaaatttccttaggcatacaggagggctaattagagttgttttgcatatctaatgtcagaaaaaagtcaaaaattgaaagataatttagatcacttaattcaactttctggtttttatagacatggaaagttgagtcataacgcgtatgagcatatgaacattttccattccctggtgctaattagaatagcagctacacaagggaaggggaacttgaccaaggaggtcgcttgactcaggccagggtctgggtatgagatcgggagggctgggcctatcatgtccgaagcagggtcagggagccaggcaaatgagtgaggcaggtggaagtaagactgcagcaggcttacgctggctttcacatagtgtatgtcccttccagaagcggcagctgctccacagcaccagctgagtgggacttaggaatgtcagacttcttgatttttttaagcgatgccaaaaatttggacttttatgtgaaatcgttctttaaaaaatgtaagtaactaaatgaatatatatatatatttttttccagatggagtctcgctgagtttgccaggttggagtgcagtggcgtgatctggggtcactgcaacttctgcctcctgggttcaagcgattctcctgcctcagcctcccaagtagctgggattacaggcacgagccaccatgcccagctaatttttgtatttttagtagagacggggtttcaccatgtgggccgggatggtcttgagctcctgacctcgtgatctgcccgccttagcctcccaaagtgctgggattacaggcatgagccactgcacctggcctaaatgaatttttaaaagcactatatgagcaaacaaagcatgtctgcaggccaccaaattttacaaattggcatctctgcttttgccacatggtgaaagctggtccacagcaaggaagagagacagagccagcatgtggcgagaatcacagggatggtctggcagctttcagggccctgtgtccagttgctcctgagtcccagccctatcctcggcctccttcctgtagcatagtttttcgtttcgagtcagtgacatacattagtagtctgctagtaaatccccctttgtggtataaattaatttaccttacgtttgtttttagtggaaattttcaaacatatacgaaggtatagagaatagtacataatgcgctaccttgtcaccatcagtcaatgaatggctaatccgaccagatgccatggcttacacctgtaatcccagctactctggagttgggggcagagggcccaggacgggagtgtgtgtggggggtgttgcttgagcccaagatgttgagactgtagtgagccatgatcgtaccactgcactgcagcctaggtgacagagcaagaacctatcctaaaataaataattaagatccactcagtgttcagatttcctcaatttactttgttcaaattaggcaaaataaggagtatgtgtttaaaaaactttttttaaagcggaagaagaggccgaggcaagtttcagagcaggagtgaaagtttatcagaatgctttagaacaggaaggaaaggaaagaaaagaaggaaagtccaacttcattgttgccagtattaactctgtatcctacaataattctttgtttatatataaacaaacaatttttttaaacaaatgacattgtattatatgttttctgcacgtttctgatagaatttggatcattgccattttgtacctcctcctaaatggatacatctggacattgttcctggtcagtacatatagcacttctccattcttttcaatagctggataatctaaaatttggttgtaatttggtttgttccttccgtgggttcatcgtcttgctgacttacagaatgaacctgcagacctttgtggtgagtgttacagctcttaaacgtggtgtgtctggagtttgttcccaagatgtatccggagtttgttccttccggtgggttcatggtctcactgacttcaagaatgaagccgcaaaccttcgcagtgagtgttatagctctcaaaggtggcacaggctgaaagagtgaacagcagtaagatttattgtgaagagtgaaagaacaaagcttccacagcgtggaaggtgacctgagcaggttgctgctgctggctggggtggccagtttttattcccttatttggccacacccatgtcctgctgattggtccattttacagagtgctgattggtccattttagagagcactgattggtgcattttacagtgtgctgattggcacattttacaaacctctagccagccacagagcgctgattggtgcgttttacaatcctagctacagaggactgattggtgcattttacaatcctcttgtaagacagaaaagttctccaagtctccactcgacccaggaagtccagctggcttcacctctcactatcataatttatgcaagaattccccattgatggaaattttaaagattattatagcattctttttagtgacaaaaaattattcttgtaattatatccttatacttttgtagaataaattcctggaagaggtttacattcatataattcttttagtagttgcttattttttcccaaaaggctgtggcagttaataatatcagtagtattcatttccccaaactcttgatgaacccaatctaatgttttatttacatttccttgactactagagaaattgggtttagcttcatatgtttgttatctgtgcccacttttctgtgaagtacttcttcattttttgcccgtttaaaaaaactaggttgtttgacttactgctttgcaggggctttttatatattagggatattactttgttttgtgttgcaaatattttctccttatctgtttgtctttcagttcttcttataattctcctttgcttttcaaattattttcccgttttttagctgttgaattaaacatttcttaccatattttgattccctgcatttttccattactgcttcctgttgggaacgcttgtttgaaaaaaataacaggaagttgaattttaactatactgttgagtttgagcttttgtaaagtcaaaagacaaaattatcacaaatgtagtttaaagatcttaactggctttatttgcagttctggtatcgggcagcatgtgattccataagattgtgttcgagtgagctgaggagaggaggctggctttgtggaaagaaaagggctgaaaaatgcagaaacatagaacccaaaataggtcgtttcaaagttactttctttgtaaggccggaacagggagacacaacaatggaaaataactggttaaaatcggttagtttttgttgtaaggattaaaacaaaggaaaggtcatttctgtgattgtaggaaaatgtgaattttctgactcaggtgtgccctccaccttgaccagtctccccttggtgttctcccgaagcagagcccttccttctcccttgtttatttaatattcattatagttatggatttctggattcctaatttttcaggggtctgttttcaatactgttcttgtttttgtccctacattgtcccagctttaggattgccagactcaaatattatgattatggcctactaggtgaccttcagttcatactgtctggaggagtgctgaatgcagttattggcaggtgtgtaatgtttgactgtttgctgtgtgcttctgttgccgtaatactcaggacacagaattttaggagggggactgagagattaggtttcccctaggttttcagattctcatttgtgattttcatgacaaccctatgatactgcaaggtggcatttggacacgacttaccaacgcatttcctctttgctcaagcttaataaaagactgactatattggcctatgggactaacgctagtagaaaccacctcttcctcctaacatgtatggttttatgtactatgatttgctttcaaaatacattttacttctcaagtgaatatatgttctggtatttggttttatgctaagtggtagagagccctatctaatattagtgtttcatataacattacatagaaaaaccatttcccagtgctcttgccccactttcccgacaagtcatctaagtggacatccttagtttggagtgtcttgttattctgtatccttgttgattcagtgccttacaagctaagatgggctggaggacccgcctagcaatgactccctgttttctctagaatcaaagtttcttaagatggcactttaggcccatttatagacagagctatctttggagactcattacccaggcacttccccatcccataccttatgcttcaatattatgtgactcctgaacccactgtgatgtttcatgcctttgttgctttgcacatgctgtgtgttaagctggaatatgttctcactcccatctgctgaatggactattattaacctttggagcctccctgattcccttttcctggagttcattatgctttccattatatcttgtaccatctttatctttgcatgtgagaaattacattaaaatgctttatttatagaagtctttcattgggaagactgaattttctaaggggagaaacccaaaacttggcacaaagtagagcccaaatgttttttgaacaaacttcagtcaaacaacagagcttttgggtgagtagatagaaacatgttgaagggtgccatcttaactcaggctgccataacaaaataccatagactgggtggcttaaacaacaggaatttattttcccacagttctgaggctggaagtctgagacagggcaccagcatggttgggttctggtgagggctcccttcctgccttataagaagaggaagagatacctgagctgccttctcagtgtgtcctcacatggtggaaagagcccaggtctctcttccttctcttataagtgcacccattgaataggatcagggccctacccttatgatcttatggtttgcaagtggtccccgccccacagatgtagttctgaaattgttagtgaattcagtgggggaagtctaattgctttggggaaaatgaatgtctgtgcttcatgttagggacaaagtatacggatacctgcaatttacactgaaatatatcggaaaatgaggtgcactgatgggtagagagagggacgacagatgaatggatttgtgataaagcaaatggagcaaaatgttgattgtaaagtccaggcagtgagtgtatggattcacaggatggttgtttcaacttttcttagtgtttgaaactttttgggataaaatgttggggaagatacctgtatttttttaagaacacatttattggctaggcatttccattataggtattaaatcattaacgtgagcttcctaaacttaactgatttttttttccttcctgctctttctcctcctgtctttatctagtcagttccttcagctcttagttcatgcgatgtccctccaggaaatttcccctgaccttccagcctgatacagatatgtctttctgtgttcccagggcaccacttgcatacttctgccatagaatttattatcttgtactgtaatcatttacttactaatctgtctgaaccactagtctttgagttttttgagggcaaagactgtgttctggaatgtttttggtacaagaaaaaacaaacacaacagtggactctttgtggcttaaacagttagaagtttcttatctctaataccctgtgtcatcgcccgttgggtcttcctgcccactgcacagacaaaaccaattcactgagaccatggtattgcagtaaagagagttcagtggactcgaggctggccacatgggagaactggaattatcagtcaaatcagtctccctaaaggctcagagtttagagtttttcaaggatgttttggtaggcagggggttagggaatgggtgctgctggttggttggggatgcaactataggggtgtagaaaatggtgcttgtgcccttgagttcacctctggatggtggcgaggaaccacaggactggttgagtcataagtccatgtggggtcagtctgaaaaacatctcaaaagaccaatcttaggttctgcaatactgatgttatctataggagcaactggggtagtccacatcttgtgacctctgaccacatgactcctgagcagtaagggattataggaaggaggcctatattttagcagaactcaggcccctcccataattctaatctcctggccttttactagttttataaaggccgtttcagtccctgaacaaggaaaggatcaattttagggagggactattattatccttgttaaactagaaattcctctcagggttggtgtggcctatgcccaggaataagagaagacgccgacctgtaagaccagaggcaagatggagtcagcacgttcagcttctttcactgtcagaatctttgcaaaggcagtttcacccaaagtctggaggttgctgtttctaggattggttcagtgaggggcatgtggtcagcacctctaccttccctgttctttcccttaattatgccaagttgactgaagcagtgatacaggctggaaatatccaccatggttatttcagtttttgaactttaagcacagatattttgggaagtatcggggtgtgttgaatagttttcaattcatttattatttcttctagagaaattgacttgtttttgaaaacagcagttcagaattagataactacacgtgtttgcaaggatcccccccaacctggaaaaatatccttttcagacagccataataattcatagaaccaggattgattcagagaaattgtgtgacaggttgatggtctggaggttccaacctcattcacaaacctcagctctgtaggaaacagtgtggaccagaaatgaggccagaagtagtttcaccttcctaaactcaagccttttggggaggtctgcctcttattccatttattctattttagccacatttcagatgtgcttacttatctagttacttgcttagctcacttatttaaaaaaaaaaagtacgtaatttgcaaagggggagtggaaagaacgcctggtgtaggcaggcggtcaagagtaggggggagaagagcaaatgtgatctggactcctggcagccaaggcctttcacaaactgatgagtgccctgaggtcgtcaagagaaagcttggttatgttcagtctgtgctgtttcagaagacagagaaatctaatacatgaaaagtaacttgcaacactacataaataatggcctcaaacaggttttaaatataggaaggtatagataaaattctggtatacacagttaatagtgagtatctctgggtggtaggatcataggtgctttttatgtgtattctgtaaatttgctatgagcatcgttacttttaaaatacttaaaaagtattttaagcattcagaatggttctttttcaactccatcaggtctttcaatgatgtcatttttttcacattttgcctttgtctttgttaaaattgatcaactaatactttttataatatttgcctgaagagtcctgcttgttactgccattgactctcatgaattgcgatttgcttgtgttttgtgagctggaattttaggctttagctgtgagactcccgaacactcattgccccttgttcccccagagaggtttcgtttagcattgcctgggcctccagcactatgagcagcctgggaccacttttcatgttactttattggctttagaggagtgttgtgggtataggttttcaggggagaattccctacagccagagcccagacaagcttccttgtcattttcctctgttggcgcacagatggtgtgctccttcaagggtcttgacttctcagttcccaattgaaaaggtgtctcaattctaactgctaccttgtgtgtatgtctggtctcccagccatgtgaatgtgtgtgtgtgcatgcgcacacatgcacatgtacgttaaatcctaaattaccaagaacagcaaccatccagaactgcaggaactgccgctcttactgctctgattctctcctgtttggggatccttactttcttttgagctcagctgtgcatttaagagcaattctaagccttggctgctcatgaggatcacctgggaatcttttagaatttcccatgcccaggttgcatctcagaccaattatttcagaatctagggtgggacccaggtgtaaggatgtttctgaagctccctgcatgattctgttgtatagctaagaatgggaaccactgatttaagatgatgttgttttatttcgcccagtgatgtgtgtgtgtgttgtgtgtgtttatttttctagtggggatgttttcaggctatctcgtcagcagtaagggaaataggagtccaccatgttgtagttagaatgaacactctcgtaaagtggcctcgttgtctggagtgacatccagagttcttggtctcatggccaaggaaatcaaggatgcagacacaccaagggtgaggtttagagcagaaattgaataggagaaagaaagagaacggttctctgccacagagagtagtcctggaaaaagggttgccatcctgcagtgaaatgcaggggtttttacagatgtgctagtggggaggcagtatctgatctacatagggtgtggaaaaccagttaggaccaagtgtgccatctgcataaggcatgactctctggcagcacccaccacagtcttttattatgcaggcgagtcctcagcctgagctactctatgttgcttatttctttcctattgcacatgtgctaaaaatgggggaggtggaaccaccatggtggacctgcctggccccaggtagcccttctattggtgcagccgctggcatgcagctgtgcaagcctccggcttccttatctatgtttgtaacctgatcttccaggctgctcttttttagaaaataattgatttcttgggctgtgttttgttagaagggaagttctggccaggtgcagtggctcacacctgtagtcccagcattttgggaggctgagcagggggtggatcacttgagatcaggagtttgagaccagcctggccaacatggtgaaaccccatctctactaaaaatacaaaaattaactaggcagggtggtgcgtgcctgtattcccagctactcaggaggctgaggcaggagaatcacttgaatccaggaggcagaggttgcagtgagccgagatcgttccattgcactccagcctgggtgacacagtgagactctgtctcaaaaaaaagaaaaaaaaaaaaggaggaagttctgccgaggactctttgccctcactatctgcctaaatggtctctttctacctcctgtatcactcttacaattagatgggatggaaaacaacattggttcattcctactgggtgctgggtctgtgccttggtgttttccatgtatatcctatttagtcctcagaacattcctgcaaggtaggtggtggttggttttatgcacataagaaaactggcttggagacattgaactagttctagggtcacgcagctcacaaatggcagaaccacactcatgcctgccagatgcccaagccctgccctttattcttgtgttttggtatatgtgaaatagatttttccatacaaattggttaaaataaagattggcacttgggttacggtagattccaggtccctgttaaatatacttacttgggatgctttgttgtcccataatactggagttgctctactcattttatcttccttctgattagggcaaattgattttgagatttctccttttaactctcatgtcatgaaggggtatttgttcttgaactcacttctttaatcaaccagagggatgtgtggggctgtgtaagagtgtgagagcatatgtgtgtgtgagaaagtgtatgagagcataagagtgcatgggagcatgtgcgagagcgtgtgtgttctgtgaacgtgttacagcatgtgagattgtgtgtggtgtgagcatgtgaacatgtgtgtgagagcatgtgtgtggtggcgtgaacatgtatgtgtgagagcatgtgaacacgcatgtgcatgttagagcctctgagcctgtgatatgagcatgtgttagagcatgtatgtggtgtgagcatgaacatgtatgtgtggtatgagcatgtgaacgttagagcgtatgtgagtgtgtagttgtgtgtgtgtgtgaaagcgtgagtgcacctatgagaggacaagtgtgtgatagtgtatggagtgtgtgttgtgagagcatgtgagcttgtgagtgtacatgagcacaaatttgaaagtgttgtgagagcgttgtgaacgtgttatgagtgaaagtgtgtatgtgggtgtgtgtgatagtgcgtgtgtgatagtgtgtgagcttgtgtgtgaatgtgagcatgtatgacagcgtgtgctagcatgtgtgagcctgtgatagtgtgtgagagcgtgtgagagcaagtgtgtgaatatgtgtgtttgaatgtgagaacatgagcatgtgtgaatgtgagaacatgagtgtgaaaatgagtgtgagcgtgtgtgtgaatgtgagttaatgtgagcgtgtgtgagcgagtgtgaatgtgtgaatgtgagtgaatgtgtgtgaataagagcatgtgtgaatgtgtgtgcgagtgtgtgagcatgtgtgaatgtgaatgtgagagcgtgagtgtgtgtgaatgtgagcgtgtgtgagtgtgagcatgtgtgtgaatgtgggcatgtgtgagtgtgttagtgaccgtttgtgagtgtgaatgtgagagcgtgtgtgagcgtgttgtgagtgtgtgcgtgttgtggggtagagggtaagagggcaaagcgaggagtaaagctaaagagctggggattgaggtcccaagctgttctccgcggcagccgagaaccgagcagagaggtaggaaactggagctacgagcggtttggtctctgcctcagtgaggccctgctgagggtctgatgatttttggtgactgggtgtcctctccaccctgcccagtgaggcgggcgtggggtgtgcgctcctgtttctcccctctagccttggcttcgccccagctgtgctggggtaagtgacttccagagttgttggagggctcgcatgtctgccctgagcctgaaaggattactttcctgttggaatgtctgggttagttaggctttaatggaggatgtgaatgacatttggttttagctaggttgaaagcaaatcgcctctaagtctttgtctttgtcatcagcagctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgtatgacgaggtaagccctgctaggcacagaccaccttcctttggcattggccgtagcagtgtccctgctcccgctgtttctgtgccggtcctcccgtacacaggggttcacggagcaagtctgtgttgaggtggcttctgaatagcttcctaggaaggtctaatcagcataagatctggattgctgattctaggtaaataatttcaactccggcggggatgtgagagatctctgcttgcatcgtttccattgttatacttcgagctttctttctgacaaaagcccaggggaggagagaggagcctttgtacagattttccaaacaacacaagcatttagccttgtgattgtcagtcaatcgcgaagtgaaagagagtgaaaggggagctgagctgtcatacaacttaatcctttcgcaagtgatagacatcagatccagttctcccgtgcggcaaggtaaagcttgcactatccttgcccaaaatttacgtcacctacttaatgtggataacatcactggtgttgagttcagtgtgacaacacagccttgatccccggagctacaaaagtccctgcttgagctgtttgctaggatacttagcctactgtgggctctacatctgcagattcaagcaatgtagaatgaaacgttgcggaatgaaaatattcgggaaaaaaacccaatgaaaaataacaatgcaatgataaaaacaatacaaattaaaacatgcaatgtaacaactgtttgcgtagcctttacattgtattatgtattataagtaatctagagatgatttaaagtgtacgggaggatgttacatgtaaatgctgtgccattttaagtaaaggacttgagcatctgcagattttggtatttggtgggggtcatggaaccatttctctagggataccgagggatgactgtagtacaggcagggagagtgttccgagcagagcttaaacctcagggcctctcacttgcattgcggccacatggctttatgagatttgcgaaagaaagctatcacaaccacgtcagttaagatcactacctcttttcactagactttcccattgtcctgcttcctcttatgctgggtgcagctggagtggccatgggcattttcggcctctagctgagggagtttgtgttgggctgggttaggtgggaatagtggtatgtgttggtgtggtttggagtcacgcggcatgtggcgattatcgctggctgcaggagtactccaaccgcccactgtgctgacgtgcgaacatcgtgatgtgaggtgcagggccaggggtggatcctgatgcgaacctgtcctgtggcacctgacacaagtgtgtgagagctagaagctagaaactgggccagaaaagtctttcagatcttacagcttgtacagtgaagctcaatagaggtttcctaaatttggcagtaatcccaaaactttcattactagaaatgccatgtagtcacatgcacatgtatgtttattgcagcactatttacaatagcaaagacatggaaccaacccaaatgcccatcaaagatagactggataaagaaaatgtggcacatatacaccatggaatactatgcagccataaaaaagaatgagttcatgtcctttgcagggacatcgatgaagctggaaaccatcactctcagcaaacacaggaacagaaaaccagacaccacatattctcactcataagtgggagttgaacaatgagaacgcatggacacagggaggggaacatcacatgctggggccttttggggggcggggggcaaggggagggagagcattaggacaaatacctaatgcatgtggggcttaaaacctagatgatgggtcgataggtgcagcaaaccaccatggcacatgtatacctacataacctgcatgttctgcacatgtatcccagaacttaaagtaaaaagaaaaaaaaaaaaactcatgtagttgtgaagctgaaagaacctcttctaagctgtcagaacaaaagacattttcattaaccatgctaaaggaaagactaaattattttttattctctataggaatgtttcaaaatcattggcatatgacaagaaaaagtatacagcaaacaaaaaagtagaaggtattctagaggtatgtcaggcagtttaattaataaaaatattgttattttgctggattttgtgatgtcagtgctgtttgtattagttttttttattactgtataataatcacaaagttagcaggttaaaacaacatacatttgtcattccatagtttccatgggtccagaattggagcctcagctgagtcctctgctcagagtcccacaagactccactcaaggtgtcagctggggctgtgacctcttctgaggcgtgggggtcctcttccaggctccctaattgttggtagaatttagttccttgtgggtgtaggacacaggtgctcggattctacaagttgcccgcaggcccctgccatgtgccgtctccataggcagctcataccacagtggcttgcttctccaaggccggcaggacagtctccagccagcctagacggtcttataaaatgaaatggaaacatgggggtattcccttcgcctcactgagagtcacccgggggtgagatcgctggagtactcatctttaaaactttataatggattatgatttctcattcaatgtcaacatttactttaatgtccagtattacgtgtgtaattttgtatcttaaggaagggcccccataatgaataagcttcaaacccaaacctggttatcctcctgggtcatgctccccatgtcttataatgagacacttttgtgtttggtacctgcttttctttatcttattctggggggtcaaactggataaatctaatgtaatctgctgaatttccccaaaacgtttttgcataagagaagcaggttgggagatctgcatctgctttgtaggtcttttgtttgtttttgctcaaaaacttataatttgcttacgaaagcttttttctcccctataacagaggttggggaagagagggggtggtgagtaggggaattaggattagggagataggattagggaagtagttgttaacagaggtgagagagggggattttgcttccccagggaatattcgtaagtgcctggagacatttttggccatcacagcttgggggaagatgctaccagcatctagtgcgtggaggccaaggacgcactcagcatcctacatcacacaggacagccccgaacaaagtattagccagcacaaaatatccacaatgccactgttgagaaacctgcattagaggcagagccgtggcagatccaaggagagaagattcccctacagtgttagtgattgagaggccctgggttgccagttccaagagcaagttcagatacagagctggggccgggcgcggtggctcacgcctgtaatctcagcactttgggaggccgaggcgggcagatcacctgaggtcaggagttcaagaccagcctgaccaacatggagaaaacccatctctactaaaattacaaaattagcctggtgtggtggtgcatacctgtaatcccagctacttgggaggctgaggcaggagaatcgcttgaacctgggagatggaggttgcagtgagccaagatcgcaccattgcattccagcctggggaacaagagcgaaactccatctcaaaaaaaaaaagataacagagctagcactgctgaggagactaggagagcctggtctggaggtttctgggtgtgtgtgtgttggggaggggggcgggggtgggtaagaggagggggcagatgcatgcagaagattcgagagttttttctcttctttctgttctcttcacagagaccagggaaagctgtgcctggccttagtctgtttttctcatgggctaacatacttgagaactggaaagtggcagttattgaagaaattgtaaaataaaattggggcaaggaaggaatagaaatgaagtgatgtatgtttgggggaggagttctaatcgattttctaaaacggtgctaatagaaacttccatgatgatgaaaatgttctgtatctatactgtccaatacaagtggctattgtgcatttgaaatgtggctggtggctactatattggacagaatggttctagaatcataattttttagctcgaagagaccttagcagtaattgtcaaacctagctgattatagaatttcctgggagactttaaaaaaaaaaaacacctcctgaataatattggtggagttggagaactgggactctttcagtggtgctcttctggtggttctgccgcgtggccaggtgtggcagctcctgcctgagagatcatctagtcaggaaattgagctctgtgttcagggaggccggctgtctaaatcaagcttgtccaacctgtggctcaggatgactttgaatgtggcccaacacagatttgtagactttcttaaaacattcagagattctttttgcaatatatttttttagctcatcaggtatcgttagtgttagtgtattttatgcgtggcccaagacagtttttccgatgtggcccagggaagccgaaagattggacacccctggtctaaagtctcctgcaccattcagactctttgttcatagtgcatgcttaacccttatttaaaattgtttagcttatgtgatggaattttcatgaagattagattatggaaggagccatagtcccagagtctttattcttgtctaagttctgactttgagaaaaattggagggagctgccagggtggcagcagtcagattttaagctccttatgctcggcctaacatactcgtttttgccttttttgggagagtaaggttggggatggagaggctttggcagcaaccgtttcagactttcagtctctggcagcttagaggaaagtcagcttagaaagaaagggtccacgtgaagtttgtcttagactcttgggcatctgaaactgagccatgcagagctctgcaaggccagtaggggatacgtatggttcacgctaatggatacaaagactttgtgattttctgtttccagctgagcaatgtaaataaacatcagggttgtaatggaatgttggggtaatcagcatacttttcattgagtacagaggtatgtaggtacagcaggacattctgacttctgtgtcaaaggagccagtggaactctggctggctttatccttggaagctcagaaatatacagttgagataatttatggtagaattcagagattttcaggggacagtcgtgtgttggatttttttggcgtgtatttttctttttggaaaggagttaaaagaaggacacttgaaagcacaggcaagttttcacatctctatttggagataatttattagtacacgttgaagagaacctaatactaaacatgtcttaatatttttatttttgagtagctgttaactgacaatacaaggctctttttaacagtcttcctcaaataacctttaattcacttggacattttcaattccatttttaagttaaaaaaattttaaatcacagccttattaagatgtaatgcacatatgaaattcgctctttttaaagtgtacaattttttttttttgagatgtagtttttctcttgttgcctaggctggagtgcaatggcacgatcttggttcactgcaagcgccacttcccaggttcaagtgattctcctgcctcagcctcctgagtagctgggattacaggtgtgcaccaccatacctggctaatcttttgtatttttagtagagatgggttttcaccatgttagccaggctggtctcgaactcctgacctcaggtgatctgcctgccccggcctaaagtgtacaatttaataggttttttttgtatattcatacagatgtgcaaccatcaccattatctaattttagatcactttcatcactccaaaaaaaaccaacctacgtattagtagtcattccccgttattgcttccccgtcccacccctggcctctggcaactgctttctgcttctatggatttgcctattctggacatttcatatagatggaatcatacaatatgtggcctttatgtctaacttctttcactcagcatcatgttttgaaagttgttccatgttgcagcgtgcgttggtactacttcattcctttctcaaaaacccacaccactgaaagcctcttggtacactgtgttagttcattctcttgatgctgtgaagaaatacccaagactgggtagtttataaagaaaagaggtgtatagcctcttttcttccacagggctggggaggcctcaggaaacttacaatcatggcagaagggggagcaaacatgtccttcacaaggcgccaggaagaagtgcagagcgaagtggggaaaagccccttatgaaaccatcaggtcctgtgagaacgaactcactatcacaagaacagcataggggtaccgcccccatgatctcattgtctcccataaggtcacttccccaacacattgggatgataattcggattacaacctaaatgatgagatttgggtggggatgcagaaccagaccatatcatacatcttgccaaattacttttcagatgaattttatacttccgttatgaataagaactccagttttttgatatacctaatgttaaatgacgagttaatgggtgcagcacaccaacatgacacgtgtatacatgtgtaacaaacctgcacattgtgcatatgtaccctaaaacttaaagtataattaaaaaagaattccagtttctcacccttgcaggtgtttgcattaaaattttatactgacaataatattgccaagtgttctgctctgtgcctggtttcctcatctgtaaattgggatatctgcctgtattgtttaaaaacaaaaaatggcaaaacagagctataaagaacagaagtgttacgtaaaatgttgcttctgtagtgtcctgttcatagtgtgaagtgcccatatgtggaattttgttttttggcagattttgttccccttaagactttgttaattaccgataatgtttatttcctcagtttgtagaagactatgaacctaccaaagctgacagttatagaaagaaagtggttcttgatggggaagaagttcagatagatattctggacaccgctgggcaagaggactacgcagccattcgagataactactttcggagtggggaagggtttcttcttgtgttctcaatcacagaacatgaatcctttacagcaactgccgaattcaggtatgtctgaaatgaaatagcagaagcccccaggaagctttttgccttttctcatatgtcttaggcctatgaagaatttggggctgagcatactaggagagggctgagcttgttctcaggaataattctgtctaaagaatcttctggggctttctgaatcttggcacattatagactatgatgattataatctctttgggctttcctgatctgtgatttctgaataaaataattttaagagtcttactgtccccgaaaacaatgaagctattccatataatcaagaacatataattttgttcctataaatactcagagattttcattgataaattaaccatctatcctttaaataatgttactaaaaaaagtagcaggtttagtctgtgttgaaggttatgaaacaatgactggaaagtgaaagatgggagtcaaaatgaccatttgctgctacttaaggactttcagcacagtggagggacgagaacgcggctttagagtcaggagacctggtttgaatccctgccttgccgctcactgaccatgggcaagtttacttagtgtcaggattttgtttctttctctggaaatgcacttgtgagttgagaaatgaaatgaaaggatgtattagactgtgaatttcatgtgggcaagaacctggctaccctccattgtcccctgtcacagtgtagacacatggtgcttccatagtgagtagaatatccattgttatttattttaaaatatggcaactattctccatgaaggtgttagagaagaaagaaaaagaaaatatagcagtgaaaaaaataccttcagttcattttgttataaagaaatagccttttgggcataattcttatgctctataaatgtctctttaccccatgcccttccctttctcctacataattgagttttaaaaaatctgttcttcttataaacatatctatctagatgactttttaagaagcagatctagagtttagtagggaactgaagagaaaaaacccaaaaatcaaatcagtttttttcattcttcagcaagttctggtctgacagtaaggtggtcaaccagaggtgaaaaggagaaagctagctatccttccaggacttggatggaagcatcactgagccagggaggcctcgggtgagcacaggtcacccagcagggctagtgaaagataatagggaggtgcctcagtgatgcttcatagctccaggcttcagagtcgaagacctacttttctggaagcagagtgcgtgtggtgcagtgactagttaagtgactatgactcattatgagaagttctgttaatttttagacatttcagaccttcctaagggctgctctgtttgaatgtagcccatgtatttataattgtttgcatctgcgtagtcctgtttttaatgcctcatagagggtaaaacaggacagatgcacacactctcttcttttcttccctgtcccgagccttttgatttcctgttgttctgtgacttacttagaagggaagtgggcaggagagttctctgcagaggatatggagaaatacaggtatttcaagtgctccttgtcctctcctcagtcaccacacatgcacagatagcactcgggcgttctcacagagttggagcagggctcccctcaatgtggaaaagggttttggttgttaggtggaaagagagatccttagaagaaaaaggacagatgaatacctaaaaccagaaagaaggggaagttgacctctgcgtaggtttctcatgttgttgggaacagaagaatgcaggtcaattatctgagccctgtggctaaactcaagtcactttacttcatgtctgttagcagttttaaaacagcatttgtgtactatcttccaaatagaaaggccccaatataaaatgacatgtgaatatgctgtcttccttgaaactttttctggaaaatattttatgaactaagataagttctgtcataagagaccagaacttggtactcccatttttggatcgatatgtttatcaatgaggtaattttgtgtgcccctgcaagactaatgagccagaaagctatcagtttttattgttcatagtttataatgatcacatgacttcaaatgtatcatgttctttgaccccagttcaaatgtaggctataacaaggctacacaaagccaatttcaagcatcttttcatcttttttagtttgtcttaaaatatttgatgtctggcacttaaattgactacatgaaaattttagtttttttttttgtttttttttttgtagatacaaggtctccctatgttgcccaggctggtcttgaactcctgggctcaagtgttcctccctcctcaggctcccagagtgctggcattacagatgtgagccaccacgcctagaaaatatttttattattgtgaaatgttaccctataccatataaaaatcaatacagatctctacaaaatacatttttgaaggggactctttttagaatgtattggcatataaaagtagaaatattctcatgggaccaaaataatggaaatggggtatttaatttttttaaatatttagttttgattagtactttcagatagctgataatttttagtagacgtaaaatttaatatgctacgagtaatggtatttttgtagaagacacttttgaagtacttttccatagggcttgtcgtatttcctttcatttttttcactttgtagtagaaaaatggtacgtattggaatgtgattactgcctaacatatctgtctcgattctgtggcctataacattactgtgtctgcatggaaactggggatgggatgacatacttgtcgtgtacacatgcagatctaatcaaaactgaagtttcaaaacaatacaatattcacctttcctacttgagattcccttggatatttctgatctggtcagttctgttctataatctatttcactgcaggggggagaaactgctggttgcgacccactagattggttttgtgatccactaataggctgccaccttccatatagaaaacactggatttcatagcttttatgtcacaaacaaatattttcaggggaattaagcattttatggagatagttcccttagcttgtttttattgcagagattgaccatttttcttctttttgtttttttttttgtgtgtgcataagttggggaccctgttgtgacgtaaaatcctgggctcctatccagacacttctgtaagactgagcccagaaatctgcatttgtgatgagcatcccaggggattctgatgtgggcaaactgagaagcagacttggaaaacacttgtcttgctcatgactgcctctagggagtgctttctcagaacatgccctaaatctagtgatttttttttttccttctgccttaggaaagccttttattttagatgggttcacaaaaccagggttcgttctttagtttttttagctgctgtatttttggtgtaacaccttagggaacagattctccgtgtgaaggctgaagaagataaaattccactgctcgtcgtgggaaacaagtctgacctagaggagcggaggcaggtgcctgtggaggaggccaggagtaaagccgaagagtggggcgtgcagtacgtggagacgtcagcgaagacccgggccaacgtggacaaggtaggcgtgaattctgtgtatttctcagaaacagacctgagaaacagcagaatggaggcatctcatctgctgggttttagggaaccatttatgaaaactaggtgaagattctgattcctatgaatgtctaagccattatcatgattataatgagaaacattgagaggatgtcaccttgtatttcagacaactcacagaaccttttactttgtcatgaggcttcattagagtatgcttaatgtgttcttttgggtttttcttttttgagacaaagtctcactgtgacaccaggctggagtggtgtgatctcagttcactgcaacctctgcctcctgggctcaagcaatcctcctacctcagcctcccaagtagctgggactacaggtgtgcaccaccacactggctgttttttgtggagatggggtttcaccatgttgcccagggtggtctcaaattcctgggctcaagtgatctgcctgcctcagcctcccaaagtgctgggattacaggtgtgagccaccacacccggcggactatgcttactgttggtgtggtcctgggaaggatggtgggacgaggccattggtttgtgaaggctgggctggagggatggacgtcattagcttctgtgtgtgctctcaccttccacagccttgctcttcaggagcagggtgggcgggcctggctgcttctaggaggttcccctggaggtgcccttgaaagatacgtggagcttcttgattttgctctcattgagttattggtcagatttgttcttttcaccttactgttcactgacagagccacagtgttccatctttgtagtgtagtctctaaatagtatttgctctcagaactcaaatctctgggatctcttttttttttttatctcttatcccatcccagcatactttctcattcaaatctctgaagctaataaaagggtgaccttgagtgacaatgatgaatgctgacaatttgaaaatccacctatcagggattgctattgttaggccttttttctttttaaaattaaagttcaaggtggttgccacacagctaaaattttaacgctgtgccttaaagatgaggctttctgccttgacctcattcactagctctcactgcatatccatgtgcttgtagaatctaagcacatagcactttggcagccacacagtggacacgtctgctttttgttctgcagcatcagcatctgaatcccctatatcctgtcttctgtttctctttcttgtgcagaaacattcccctttgctttcattacctgacaagggagagatttttatccaagctttattttcacttgaagtgatgctagaagaacattggtatttagaatgttggtattagaaggggtttgctttagacgcacttcggcaagatacatctatttgtatgtatcgtacataaaaacatgtatcttaggagacatatacatataggatagatatacatataggatacatatattgtacaacctaagtccgtttagttgtaatctgcaatgggaagcgcgtgttccgccgtcagcttttctttatattgtcatctctcaactcttacactcttatattattgtgctacttaaaatatttttattaaattattttccagctgtggaaaccacacaggaaatccagaaatatggctcattttaaaaaaatcagggagactctctcagcttggaactgtggatgtgtatttcctggatgggttgtcgcgtggggggtctgtgttgtcatctccccttgtctgctggaccagcttgacctgccaaacaggaaccagcagagacttatgactggcagcatggtattcacttgtaaagaatttctatgaaaggtgtgataagatcagcccatgaacaactttgtcatcattttaagttggatgcactccattcccctcctcttgtcttttgctgttaggacaaaaagacaaacctgtagcatttgaaactgttcactgttgctgtcttgggcagtgctttcctgagaggctggcaagaagggatgtttgggttggcctgatctagctgggggctggggttgggggtgcttttctgtgcctggagctagtggtaaatgcatgtggagccccacactccagaggcttgatcttgcttttcaccaagaagaaggtgtggccatgaaggagcttgtggttttgtgtgaatgtctgaagataagggctgtgctcagtcccacacttgcagtctctgtcattctctatgagaaatctcaaatgtctcttcgtaggattcatattttgtctgcttgggtataatcagtcctctggcatgatggctggtagcagagggcaaaacccaaactactgtgacaaaaggataatccatatctaagtaacacactgaccttcaaaggacaagtctcatcagttcttgataaagttcctctcagctgacatcacaagggtcggaggagtggttgtcctgagattgagggtgggggagtgtgtgtggggagggatagggtggccagaaggacatctctcatcctccatcttctcagtcgcctagtgcaggagctttagttgttgatgctttacgccctccttctcccatcctactgcctccccagggtggctgttgtggagttagctgggaaagctgtcatgcataatgatgttccaacctccatggggtccttgtaaggattaaatcagatgcaggggtgtcaagagcacctgggagcagggactcattatggcattcttcccttccctggtggttggaaatgctagaaagtctgcttgctgttattactctcaatatttgtaaattttataaatgtatagatctgttatatgcaaaaatatgtcttacccttcatcacacttattgtaagattttatcattttgaaagcagctgttaggccgggtgcagtggctgacgcctgtaatccgagcacttggaaggctgaggtgggcattgcttgagctcaggagttcaagacccgcctgggcaatatggggagaccctgtctgaatttaaaaaaaaaaaaagctgctgctgcatggcagtgacagtacgatgattctgtccttggcttgagcagttgtgtgatacgagcagttgtatgagagatgtttgctttgtataattagaattttttaaggttaatttttcttatttgccccagagctattgtttctgttgacatatggtttataaaaatcagtttgactttgtgctttaaaatgtaactacatatcctgcttagtcaaattatttcattgaatccttaaatgctgtgttcacagtgtcaggttaacaaaagaaaaaaatcattaaatggctctttcttcactattctttttactctttactcctcacccccaggtgttctttgacctaatgagagaaatcagaacaaagaagatgtcagaaaacaaagacaagaatggcaagaaaagcagcaagaacaagaaaagttttaaagaaagatgttgcttactatgagtgtcaaggtgacggatgaagccagctgctcctaaggacacagggctgggttggtaaagagaaggctatggttgacttcttgcttgtgcttcccactctccccgacttcattcactcaaacttctttaaatggggaaaaatatttgtgactctgtggctggcagaagaaataagcccatgcaagtggaagggctgctttgtcaggaggttgtggaatttctttcttctccccttcttccctcccaaaagcttagctatgtataaagtgccacagataggaaacagctgttaattacaaagagaaagaattgtcatagcatcttattttgttcctagttttataacattaccatccttcgttttgaactacagatgttgtagtgggttttggaggagggagtggagtaagatgccctcccacttttatcagtttagtagtagtactgagaaaaatcccttcagctctaagaacactgaaaaatccaccgattttttgggtaagcttcttggcaataccctgtggatctgaaacagctaaaaaaatgaatttgaattgcgccagataggtcaataccaagcttctgattcctcctcacatatgaaaagtgaaagttgtgagttgttttcctcttatttaaacattggcctattataatctgtgttggttatttttctcctgtaagcatcctgatttttctgtaggaacttttctttggcagaccaagtgaagactcaggaatggtgtgcattataaatgacacacattgccacttgtgtagatatttttaagttctttggctaagtcctctcctaactgcctgtcctctggttaggcccctccctctccactagtggtgaatgcatgtgtctgtctgatcagcatcactgcacacggaggtctagtgagcctcttgctaagtgtcacacacactcttcccaaagacgtgatgagttaaagttgtattctgaaatcatgaagccagagcctgtgccagaccttctgctacctctcatagaattgctctgtaattctaaatttaaaattagaagtagagagagataagccatcgcccctttgcctctgagaattggctgctgtttctaatataattattttctaagatagccagatagttagaaaaagattttcattgatgacatatctttaaactttcttgcatcagtattctaaattgagcaaactgaaagattttcatcaggaaaggagcactgtgggaagagcccagtattcacattttttccccatttttcagaagcgacatttcatatataggtgccaaaagtgaatcggggtgcggagagtgggaaccttttgaatttatgattgtcacagagatggtagaaattatgatctgactggaaaacaatcctgtatcccctcccaaagaatcatgggctttttttttgaataaaaaagcagacaaatagactttctcgggatttcagcctttttattttatccttttgtcatacatgtgaaatgcaagtactgaaggaatggccagttattcattattcttgtcaggcgttcttcaatatctgacaaactatttcaattaatacttgagttgaggcaaataaaatggtaagtattaaccgtcctttaaacttcatctttcctccatctcttcttaaaatttaaaaagttgatggtaatgacactcttgaatttttgaaacaagctttttgttttcatcctagtttgccatccatttgataccagttctagtcaagagtgggtaagtttgagccgatcacagtggctcacgcctgtaattccagcactttgagaggctgaggtgggcagatcacctgaggtcaggagttcgtgaccagcctgagggaaaccccatctctactaaaaatatacaaaaattagccgggcatggtggcgggcgcctgtcatcccacctacttgggaggctgaggcaggagaatcgcttgaaccccggagacagaggttgcagtgagccgaggttgcaccattgcactccagcctgggcaacaagactctgtctccaaaaaaaaaaaaaaaaaaaaaaaggtaaatttggaatatgtacaaatgaattaaagatgttatgacttgtttcatgctatagaaattatacttgatatattctattagtatatttctaaaatttaattggatagccattagaaatggatcttctaacaaaataacttatgagattcttagctattgaaaaataatgaagccatgctgcttatagatttgaaacacagtcactaaatgtttagatgttatgtccatagcttagtgctattttaaaaaatatttattttagaattatttgagcacctacttggtgtcgagctctattctaggtgctggggatgtggtgttgaacaagataggcaagatgtccactctcctggagcttaagctttagtaaggaaagagaaatgaaaacatcaggataactgctttgatgaaaattgggtaatatgacagaaaatgtctctaaggtatagagctgatttagattgggtggccaacaggcttctccgagagagtgatgtgtaaactgagacttggtgaccagaagcagccagcgctgtgaggaatgggtgggctgggtgcaggagctttccagactaggagacagttagtcccaggatcctggagtgttcaggaagaaactaacaaccaggatacggctggagtacaagggagcagagcagagtattagaaatagatgtaacaatctgatttcatcaaataatgtggggaaaagtatgttgacataattttctgcaagtgccctattaaatctaaggcaccctgattacaagataacataaacaatttatgtaccactaggaaccctaccaattaaatgaattcatcttgattccaatgacataaaaatgtaggagaaaatgtgtcttttagattaggtcaattttggcatataatttaaatgacaactgaaatacaaaactcacctctgttggtctatgagctactttctaataaagcaccatagaagcttaacagtgtttgaaaagtactaatatgttaatgttatagcagtaaacttgacctcgatattttcattttaaaagtttattattattactattttttgagatggagtctcgctctgtcgcccagactggagtgcagtggcacgatctcagctcactgcaagctccgcctcctgggttcatgccattctcccgcctcagcctcccaagtagctgggagtacaggtgcccgccaccatgcctggctaattttgtttttgtatttttttttagtagagacggggtttcactgtgttagccaggatggtcttgatctcctgacctcatgatccgcctgccttggcctccagaagttctgggattacaggcatgagccaccacgcctggccaaaattattattttatgtttgtttgagatggagttttgctcttgttgccaaggctggagtgcaatggtgtgatcttggctcactgcaacctctgcctcccgggttcaagcagttctcctgccacagcctcccaagtagctgggattacaggcatgcgccaccacacctggctaattttgtatttttagtagaggcagggtttcaccatgttggtcaggctggtctcgaactcctgacctcaggtgatccgcctaccttggcctcccaaagtgccaggattacaggcatgagccaccacacccggcctaaaattatgttatcaaaattctaactgcatgggctttaaagtccagtggcctggaagttgttgtgatggaaggtcttcagtttcactcttccctgctccagcttcaaagctcacatctaacccttcctactctcagctcattcattgggtactcctgtatttctaaataatcatcttatgccattatttcttttcaacctcagacctttccagtaaggatttgacataacagacaaggatttagctcacctgttcccctcacccccagttatgaccgtcagcagtaatttcagttttaattcgtttcttggtgactgctatacctttaaaactgtatatttaaacttctgttttcttatttggtcaactctcaaaagcgctgtgtggttctccacttggaagggtgagggtgtgagcagtcctgccaccatctcttgaccctgtctccttcccagctcttgtcagttctttcttctttatttacattatcaggatggatgacatggacattccattctgtgagcataattcaggcgttggtgcttctctgtacattaattctgaaagttgaacaccaatcgcagatgatacggttattctcacttatgtgaacctggctcactgtcgagctgagcaccatgcagcaatcatgtcttttaccgtgccgtgcaggctgccacttgaaggagcattcctagtgtctggtccagcggactgttgtcagctgcctggatcacgccatgtgtgggcttcagctttggttatttcctatgcagtgccccttcaccccctcgccatttttcctgatgttgggttgctttttttcttgagagaacactcatgtgctctcttccccctcatgccagtttcttcctctatcgcttggaatctgcttccattcttctgaagattattctgcttagagctcatggatcgcgcgatctcatttggactggttactttgtaggaggtgagatttgtattggacacttggatcagttccacacttttctgaatttcacgtcttcctttcttggttttcatcctcgttttgctggagtgcattttcgggaaggacgtgatggagagctttcagagcccctcggcatgtatgacagtatgggtacttttgccctttatttgattgctagttcagcttggagtaaaattctgggttcaaaattgttttccctgggaatgtggaaggcttggctcagagttcaggagggtgcatcatcactgatcaaattggtgcagccctccctggttgtccctttgcagtgggggccctggcttttccctctctcccgttatcggggccttctccttatctgcagggtctgaaatgaacacagctgtggatcttaagtgtggctgttttgtgactcatcctgcttggtagtcggcagaggcttccaatgaagactcctgcctcttcagctctagaaaaagtatttttgaaattctttgatcgcttctgttttctccttccagagctcctgttaccacctttggaacctcctagattcatgtctgctccatccatttcctatattttccatctttattttctctcaaatttatcctccctccctgtgtttttccaagcactttgccaagcactgttgtaagttcttgagatagagcagtgagcaaaacagacaaattccttgccctttggaagcttacactagtgggatcaactttgtcttctcacttgctcaccgtgtgtatgtgtgaacaaaagctttctttgtctttatttgttcctttttcatagcaactgttcttggcggccttacggattcaatatcttgacttttgaaggatattagatcttttgaaagttgtatttttattcactttttcttctttattttttaagctgcagtttttctcacgtatctaatgattcctgcttgtccagccatattcttaggaggaaatagaaagtcggccaggagttccatgtacatgagtggggcttgtgaaatagcaggcttgactttggggtgaatgggtagaaaaccagtcatagtgctgggaacccctaatgcctaatcgagggaaggtgtgctctgggggccattggccaggctggatgccttggttcactccaggcagtttcttccaagagaaaagcactggtgatggacagagctgcctgcaggggtggggtggaccgtgtcccacacagacctctacctaggctctctagccacgcaccgtggttctgctgctccatctgccggttcagactgagccggtcctgttgccctcatctcaacagatccttccttatcgaacggctcacgtctgggtttcagcttctgtaaatttgtcagattcacacatcagctagtgacccttccattctctttgccctttgggttttttaaatactattatttgaagagaggcttcaggggagactaacttttgggctcagctttccattttgccctggtttcattgtcacaaatacttaaaatttcctttttttgcagatcaatgttaaataaagattagagtgaacacattgatttgactttatgcaggggtcattttgaacttgagggcctatggcaatctctgttctccaggagtatggacctcagcatttggggtcagacctgggtctggccagttgtctttatttaatttttgagacagggtcctgcttggccacccacggtggaatgcagtagtgcaatcatgactcactgcagtcttgaactcctgggctcaagcaatccttccgtctcagtctccacagtagctgggaatacagatgcacgccaccatgcctggctaatttttaaatgcttttgcagagatggggtcttgctatgttgccagactggtcttgaactcctgggctaaagcgttctgcctgccttggcctcccaaagcgctgggattacaggtgtgagccaccatgaccggcctggtcagttgtcttctgataccaactttcaagtgagggaattgtgagttttcactaagcctgtgttgatttcacttatatgttttgcttttacctcttggtgatcagtttattacctgtgcaggtaacaacctgaactgcccgtgtggagtagtacatcctttgtcttatcttttttgaaatgtagctgacttgggatgttctcttgtttttatatggtcaacaaatctaagttaatttacctgtgctgttagcggttttgtagattttttgttctcaggtttgggacgatcctgcttgccagctgcagttggtgagttacctgctccttggtgatgctgctttttaaaatgcatattgtcagtgcagacttcctgatttccttttgtaagttgctacacgaggcccgctttgaggactttttagaaaggatgtagtacaagttttaaaactaatttgggcccttgggtttaaggctgttcttctctatttgagtagatatgaatgaaaaaagagacttcctccaacacccttccgccccagcctttgtctaattcaagtgctagagcttgtcctgacacaccgcagcttgctgttcatttctacttgttcagttgtgtgccaccaagctagacgtgttcagtcacactgacagtactgtcaggatgattcattgccacacacgtagctcaagtcggaatggggcctctggtcgtgtctgagaagcacagaaacctggctaagctgaggattcggcctcccacccaggttggtgaaggtgctgcggcctgggagcaggaacggagcccccagctgccaggagtgtgaagctgcttctccgcagtgcagcctccacaagccttctcaggtggcagtgaagaaggaccagatacctaaacagttttcaagttccggaatccttgggaaagttagtgtccatcaacttcacatgttaaaacaagcttacggctgggcgcggtggctcacacctgtaatcccagcactttgggaggctgaggcgggtggatcatgaggtcaggcgatcgagaccatcctggctaacacagtgaaaccccgtctctactaaaaatacaaaaaaaaattagccgggcgtggtggcgggcgcctgtagtcccagctactcaggaggctgaggcaggagaatggtgtgaacccgggaggcggagcttgcagtgagctgagattgcgccactgcactccagcctgggcgtcagagccagactctgtctcaaaacaacaacaacaacaacaacaacaacaacaacaacaaaccaagcttacttatttctagtagttaaaaacatctcaaggtgagtgttgcacaggaatcaaagggatgagctggttaacttcttatgggctaagtcatcagttacttcttgtgtattttcagtagttgcagctgggaaagttttcctaaaatctgatttatgtggcgaaaacacatgtatgatattattttaatcctgtggtaaaactctgtgagtctagactgccttaattagccacacattggtttgagtgagaatctaagacaagaagatgtcctgacccatgaagtttcttcatcccagcgcagctggaaacgtagccccaggccagggtttctcagcctgggggagggctgcggcattctgcaggggctggcactcagtgaagtgggggaagtgctggggactcgattctggctgtggagacagcagtggagtgtggcttccttaaaggccctgacttcctgggtcaaggtaactaagatacctgtgtaactttaagtcagcacttatccatgtgcgattggccaacttatcaactcatctgtgcaaattatgttctttattagggaaaaattgcttttggtatgtgtatggattttttttttctcctgcagagattcttgaattgtatgggtgtaggaaaatacccctttcttctttttgtcttttcatggctaagtcgtattccttacctcaggcacagggcaggggctacatgttccagaaacacacatcagtcgccattgcagccgcttccacttctgccaggctggttggggcagagtcaccagggacctccccctgcacagtcagtggccgtttccagtctttacagtattgccagtgctctcgtgcctgactgagctttctcctgcttctcctttcacctctctccctgctcggggtctcactcctttactgcccactgtggtggtgcgcacctgtagtcccagctactcgggaggctgaggcaggagaatcacttgaactcgagaggcagaggttgcagtgagccgagatcgtgccaccgcactccagcctgggtgacagagtgagatgggaaaaaaaaaaaaagaataaagcttattgacgtataacatacaaacaataaaaggtctttgtaaagccccgttctgaccctctgctcacccttaagtaccgtgtagctgctctgcagcctttctggacgcgccgaggactttccctgacgtgcctcatgagcccctcacagctccttctgcggcttcgtgctcctctcagtccctgttgtcgtgtgagccccatgagcacagagaccacacactgttcactctgtgtctccgggccctctattgatgtggactcattgcaggatcttgggtgttggctaaactgaatgagttagcttaaatgtaaaatcatgtcgccttgaggaagtgcttcaagtttctctataaagcaggggctctcttttgaggactggtaccaagagacatagtgaaataagagctagagcagtgatcttagaagtctgaccaggttctgtttctctaaacccagattggaggactgattgttttctcagtgagaaagttttctgctaagttgaaagtagacacttgccgtctgccttgccgctccccacccttaaatccggtggtggtgagctcgccctcacgttcttttctgccctgtttttcttccgttaaacgtttgctggccggcatgccttctccctggtatcccccagaacatagttttccgtttctacttttcagcctcctcttcttccttccttgttttcctgacctcacacgctttggagatgtggtctggtagtcatggtggtcttcccactcaggtctctccctgtttctgtccactgtaggaacccctgccttggcagctggcttaagtactacccagattgcactcctgcccgtcgcctgcagaagtaagtacaactgatttagccagcgttagagcaaacgatggaactgcctcaactgaacacacacctaagtgagccatggcgcaccaatgctgtggaaatgcagctttggataagccttctccatcccccaccccagctgttcctccaaacctctcctctgtagggattctggagcgctctatcagagcccccagggacctcaccccatctggatgcctgccatccctccacctgcacccttgccgttcagcactctccttctccctgagcagtgcctgtacttggcatagagaggttgctctggctgaggaatcacacagagctctgtgaatttcagctctgccccatgtgggctttgtgagccagcaagtctgtagaacgaaggtggttagagtggcctcacaggtgattgtaaagatggatgctatgcaaagccccttcctttcccctcatcgctctgtgcctcttctcatgcaattcattccgcctggactcttactctcctccaatttctgacacagttctacccatcctttcagggccaccaccccgcaaaggtgctccttcctccacacagatgtcccacatctcgagctccacactgtgcacggcagcctgaacccctcctggtcatccctcctggtcaccctattgaactcttttcagatgtccccgctcttttcctagaacccctggcatgccttctttggctcctcctggtcgtctgcctccactctgtgctctgattgccttctgaccattcttttgggtaggactagggtctgccccatgtgtctatccttgtcgcacctgactccttcaacagagggggctgtcagcgtcaactacaggtgctttcacaagaagttggctaaacctgtgacggagcctcgcgttccatattctggctgtcttgcataaaagtcttctagcaatctttccatgttatgggctgtgaagaaactttatatttcaaagaggcaagagaccactcacctgtgactagaaagcaactttaagagttgaaatttctttccaagtcccttcttgaaatgtgtgtgaaatgtacatatctagctatgaggataaaccagctgagtgtctgcacacacaaactgtgcaaggaagctgtgttaagtgtgtgaaactcacctcctgtgtgaacctgaagcagtaattatttctggatgaaataattacttcattgccttcgatattgattttataggctttgtgggtgtctaatccagagggtgggcttgctctgccagcctgtgatcaaaggctcagagcgctttccaaaggttttacagatgctgggtccaggaatcaaactcaggccgagcttgcggcagagaagcttggtccaagtggcactgagtgggtggttaacggaagtgagtgccctaggttggtgaagagaatatgtcagtatatttcagaggccctgggtttataagcaagcagtttataagcacctacaggaggtgaactttgactgttaccacgaaggtagttatgaactttagttcagggctaaatcagggagaaagtaatcctatagaacttctgtttaacaaaagaaattaaactttttatactctacctgttcattagaaaaacaactgcagtcctccttcctccaaagaaaacaaggataatcaaatcagaaaatgggtatatgatgactgatttgatcaactttgaatttacatggtaacaaactgcctttgggagaactggtatgacgggataagttaaacgtttccatttaaagagagtgtatgctgatagatacagatcctttgtgtggttttggcagtactggagccctggttttaatagattgtttttccaaaatctcttactgcaaaatcatagtagttcttgctggggtgggtggttgggggcagagtctttttttttttttgatgagttatttaaaaaaatatgcctttgaagaactgtacaatgtgatgtacctattgtctgtattattttgaatgttcatgagagcttcttaaagcattttaaggttgaaaatttcatagactttaaaagatttataacatatattttatttactgctatattagatgggtttattaccagtaataaagaggtatatctaatatttactctgtggttctacagctgtttattctgttgcgattgccagaattcttgtgtattgataagcgctctttctggacagttgtctgaattactgcaccctttcccactgaaaacacccctcccagttccagtgcttcatggatgaacaaagccagcgaggaccactagaggtcattcttctgcctcatcaggtctgcagaagctccccagggcaccggagtgtgtatccagaggcttctcagtgtccaccaggcagtccagccaacaggaaagcatgcgtagtgggtgaacgaggctgtcagagactctcctggactctccttccctggaaggagggtgaacctagcaagctcctgggtaggtccatagagtcagttatgcaaacaatatttgtccagtggttgtttgtggaaactcctgtgccgggtgactgctaacgtgggtgatagtagggcttcaaggataagtaaacattagcctcgcctttaattactttccaaacttctagtgctgctggtcatttcatgggcaggagcatcacttcgaccaacatcctgctctgtctcatgctttgggctaagcactgggatacaaaatgaaatacacacagccctgacttcaggagtctccacattgttggagaagatgaacatgtatgctgataaaagtaataccatgcagtaatgcactaggtagcacaactatcatcgtgtgcaataatgctctatgctagcagtatgcatttgtgttaggaataagtaacccaggctagaaagggaaagaaggagggcttcttagaggaagtgacaagatgtcttgaagggtgggaaagtagagaggaagacaaagaaaggaggaagtttgttcaagacaagaggagactatgagcaaaatagaagcagcgaagcagccagctgtgtgtggggagacacaccatcctgatgggaagatggggaggccagatggcggcaggctctgggaagtcccatgtgaagggggacccaactctcttttgaagtgcctttggggagtggcttgtagtggaccacactggagcacaaacacatccaagcaacctctggtcacacccgtcctccacctgctgccacctgcagacttcatctttaagggaagactcagagctggcaggccaggttgtaaggattgtttgtaacggtcaggggcagcctgtggaaaaaacgtaggctttaaaaagagcagcctgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggtgtggtggtgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaagagcagcctgagtcttagcaatgaagctctatgcccatttatgagttcctcaatctctctgagcatcattttctcatagtttttcttaagtggggatgatgccattttacttttttgtccttggaaagatgtaatgagtgtgtatatacatttatatacaagatttaacttatggtagatgctgagtaaaacagtacatgatgatactcatctccactagctacacacacacacacacacacacacacacacacacacacatattttttgagacagggtctcactctgtcaccaggctggagcgcagtggtgcgatattggctcactacagcctcgacctctttttttttttttttgagacggagtttcactcttgttgcccaggctggagtgcaatggcccgatctcgactcaccacaacctctgcctcccgggttcaagcgattctcctgccttggcctcccaagtacctgggattacaggctcctgccaccacgcctggctaattttcgtatttttagtagagacggggtttcaccatgttggccaggctggtctcaaactcctgacctcaggtgatccgcccgcctcggcctcctgaagtgttggaattacaggcgtgagccaccgcgcctggcctcacagtgacttccatgtttccctggcaggtgattggaaggttcatggtatggtgtctgacacagaggccgcagggagatgagcagatttctggagaaggagggagtgaatcgtgagagggtgcatgtgagagccagccctgtgtaggactggaatgtcgagcaggatgcttcagggctctgctgaacaggctgtcctcctgccccgacagggccaggctcccggggctcccttccctgccagcagctcctctgggactcagcacctcctcctgcatttgccacgtctgctctgctgctgtgactgctgactgattctctgtatatgtcaagtgccatctctgacatcggacacccttgtttggttgatgtattggttacctcttgctgcacaaatttagtggctcagaaaacacacatttattattgtatcttacagtttctgtgggtcaggaatgtgtgtactgcttggctgggtcctctgcttaaggtctcacaaggctgcagccaaggtgtcagctgggcttttctcctctggaggctcggcatgggaagaacacacttgcaagttcccagaattcaattccttgcagctataaaagtgagttttaggctgggtgcggtggctcatgcctgcaatcccagcactttgggaggctgaggtgggcggatcacctgaggtcaggggtttgaacaagcctggccaacatggtgaaaccccatctctactaaaaatgcaaaaaaattagccaggcgtggtggcaggcgccagctactcgggaggctgatgcaggagaatcacttcaacccgggaggcggaagttgcagtgagccaagatcgtgccattgcactccagcctgggcaacagagcaagactgtctcaaaaaaaaaccaacaaaaaaagtgagttttagttttttgttggctgttagaggagctgccctcaagtccctagggcctcccatggttccctgcgctgtggccttccccacgggtcattcatgacgtggcaattggcttcttcatggccagcaaaatgtaacataatgtagtcaagatggagtgccatccatcacactggccgtattccattggttagaagtgagtcacaggtcccgcccacactagaggggagagaattgcacaaaggcaggggtgagtaccaggaggtggggctcagggggctgccccaggctttgttgccacagtgggctagtcaccctcccatgcaaagcagaccccgaacgccagggtggcttcttttgggtcaggactcagttctggggctgggctgctgtggctagaagggggttagtttgcccagcctggagcatggcagcctcttcgtgctacctgcctctgggcacctgtgccaaggggtccctggcattgcaggcccagggcatcatgtcctgttctttgggacccaggggcgaggggaatttgcttgagttcacaccgcagtaaacattgtactggtaaaaacctgtacgctactcatgagattcactttttctaggtaagcgggtggtttgggtagtctaaagattgacactggcattctttggatgctgtctcagcttttctcatgttccatctcctcagaatgggtagtaacacatttattgatttttttttttttgaaatggagtttcgctcttgttgcccgggctggagtgcaatggcgcaactcggcccaccacaacctccgcctcctgggttcaagcgattctcctgcctcagtctctcaggtagctgggattacaggcgtgcaccaccacacccaggtaattttgtatttttagtagagatggggtttctccatgttggtcaggatggtctcaaactcctgacctcaggtgatccgcccgcctcggcctcccaaagtgctgggattacagacgtgagccaccgcgcccggctgatttttctacactgattttcaacacttagaataaatcaacttttcagtagctgttttctcatctctgtttaaaatactcagcattccccattttctgaacttacaaaaagttttgacataaataattaacagtttaacaaaaatctttaacactgaatatgagaactttgcctttcgaatttaaagaaaaaagtcacttggcttttttgttttctttttttttttttttgagacagggtctcacttgtcatccaggctggaatgttgtggtgccatcatagctcactgcagcctcaatctcctggactccagcaatcctcctggctctgtctcccgagtagctgagactacaggtgtggccagctaattgcttgattttttttgtacagatggggtctcgctatgttgcttagtctagtctcaaacttctgggctcaagtgatccttctgcctcagcttcccaaagcattgggattatgggctgggcatggtggctcacacctgtaatctcatcactttgggaggccgaggtgggtggattgcctgaggtcaggagttcgagacccgcctggccaacatggtgaagccccatctctactaaaaatataaaaattagccaggcgtggtggggcacctgtaatcccagctactatggaggctgagccaggagaattgcttgaacccgggaggcagaggctgcagtgggccaacatcgcgccactgcactccaggcggcctgggcaacagagcgagactcagtatttttttttaaaaaaacaaaaacccacaaagcattgggattatgggcgcgagtcaccgtgcccggcctcacttgacttttctgtgcttcaccttcctcatctgtaaaatgaggggggtagtaagccattctctgtttctgaggtgctgaacttctggggctaccctctcccaggcttgtggttaggatcaaaggaggacaaagcacaggtgttggctgcccaaacacacaccaggggtgtaatcacaccacaaagagttccattgtgatgctgcagctattttaaatagaattgcttctcttctgtctcaggcttatttgcttataatgcttcatttgtatatgacttttcagaaacctgttctatagattgagattcccacatcaattgctaagccctagcacagaggcctagctaggtcaccaaaaaggtttaatgacaaattcggggtctttgcattcctgactgtacatttttgatggaatctcctctccatcatgtctttgacttgttgctactgtttcaaccaaaacagtactgttttgaactggctgttcagccaacagccagtactgtttctactggctggtttgtttgttcgtttggttttttgtttgtttgttttagatgaagtctctgtcgcccaggctggagtgcagtggcatgatcctggctcactgcaacctccacctcccacgttcaagcgattctcctgcctcagcctcccgactagctgggattacaggtgtgcaccatcatgcccagctaatttttgtatttttagtatagacagggtttcaccatgttggccaggctggtttccaactcctggcctcaagtggtccacccgcctcggcctcccaaagtgctggaattacaggtgtgagccactgcgccctgcctctcctgactgtttttactcaaatgccaggaagtcattggtgccacaatctgactttccgtcagcactggcctgcatgtcccattgaattgggatagtgttcttcaaaaaatatggcacgaaatactagttcttagaaatgcaaattggtttttcaggaaacaagggttttatgactgaatgtgctcatggaacattgcatgttcatgttagagtcctcctttctggaggttcaaagcccttattaggacactttatttttaatccaatattttctgggcttatttgaataggaaacacttttttttaaattaaaaaagttgagaacaaaacacttattcatatactacaggtcaaaacaatctttggcaaatgctacacatgtgcacagatatggtttcttttgaaagtttatgttagctctggaagaccctagagctccttggctgctgcctgaaccctgtgacccgattcctttaaaattacactttttggctgggcgtggtggctgatgcctgtaatctcagcactttgggaggcagaggtgggaggatcacttgagctcaggagtttgagaccagcctaggcaacatgatgagaccctgtctctattaaaaaacaataactagaaaaattagacatcttttttttttttttttgagatggagtcttgctctgtcgcccaggctggagtgcagtggcacaatctcagctcactgcaatctctgcctcccaggtttaaggaattctcagcttcagcctcctgaatagctgggatttcagggacgtgccaccacgcccagctaatttttttgtatttttagtagagatgaagtttcaccatcttggccaggctggtcttgaactcctgacctcgtgatccacctgcctcggcctcccaaagtactgggattacaggcgtgagccaccgcgctcagccgaaaaattagccttctttttaaaaagcatgctgctttaataaacttatcatttcctatgttttttcgtggtttgtttggaaattagcaactagctttcctcttctggttcatcattgattagccataaacggatccagagattcctattggaacctgtttggggccctctagctcttcctctgcccacctacaggaagaagcctcacaggtgactccactgtggacttgcagaccctggccctaagggttcattcaccatccctgatgctggggcggggctgctctgagctctggttatcttgtgtacttgatgaccatgtacaaacttatgctccccgccatgatttctttctaaagttatccgagaaagaaattctttttttcttttctttcttttcttttctttttttttttagatagactttcgctcttgttgcccaggctggagtgcagtggtgcgatcttggctcactgcaacctccgccttgtgggttcaagcaattctcccgcctcagcctcccaagtagctgggattatagtaggcgtgtatcaccacacccggctgatttttttgtatttttagtagagatggagtttcactatgttggtcagactggtctcgaactcctgacctcaggtgatccacacacctcggcctcccaaagtgctgggattacaggtatgagccatcacgcccggatgagaaggaaattctatcaacgaggatgtgtgttaaaaagtgtcagaaaacatgagtttgaaaaaagacttatcacacagccaatgctttatgtctccctcttcagtttacgtctgtttcctgataataataacaaaacagtcctaacaacgtctgaagattgcattatcttttcagaatcctttcacatcccctggcaaccctagctgctggacagggagggtgtcagcattgcttcttggtacgtgggtccctgggcgcagcgacctagcacagcaggcggtgaagttagttgcgcagtgaatggtgccggtctccgcgttctcaggactgctccggttgggagatggagagaggcgaatcaggactacgtggcgcctcaggttctggagggttcctctacctcctcccttcctcccattctccgcacttaaaatgagacacggattccttcccgaccacatacggggggcttcccccagcatgaaactttcaggtgcttcttatagctcccactccatttcacttttatgtgtaaagggtagttgcatataaaaatgacattttaatatcgtaagtccccagcggcaccaaagctcaagctgccctttttggtaaacacctagctccgcctagtggccacgggaaagtgcgttttcccgagaaaacgctgcgtggctggcctgccccgctctcggcggagggagctctggtaacgctttgtaaactgactcggcgaggagagcacctgcctgaatcactcccttgaaaaaggcccaagtgcagttgtttcctttaatgacctgcgctattacaggctttggattttgtgtgtgcgccaagaagaagggtaaacaacacacaaactcttgaagggaaggtttccttcggagagcggggcagacaacataagccgcactgtttgtgagggccggtggtttcgcttttatggcatcaatcagtttgtattgtaattgataggaatcctgttcccacactgagttttgtttactgagaaaagatttggagagtaaagggaggccccagcccttagccggaatcccagccaactcttcctccagatgaaacagaagcaggaggaccccacagccaggcggagccacgcccgccccgaggagcaccgggctccatcgccttcccccagattgcagcggaccttgatttcaagaaacattcccgccgtgtcaacagcagccctgtgcagcggctgccccgggccccacccgctgtgaaccgacgcaatggccttcacttcaaggactgccctctcacacccgagcaagctgacctcagaggtctggggcagccgggcaggggacgcaccactctcacccgcgggcagtcctctgggtgggttctgaccgtgacctgtgagctggaccacgggacacttttggcatattctgcttgggtgcgtggcaggtcgtggtgaccatcttgtcttacgcgtcattttgtccttctacattgttccagccacgtgtgtctgacctagagctgtggtgtggggagactgtctctgactgcgggggttgtggagtctgggaaatgggctcaccttccagaccctgtaattcagctttgcctccaggagctccggacggagctggcagcagaaagccacttgcacataatgaaacggtgaccatatgctgcctaaatctccacgcaggcttgtcgtagcagctccttgtcacccagctaacagtagctggactcgccttgccatagatgttcacacctctcccctcctgtcctgtgcctttccttctgcgctcccgaaatcacagatccttggtctgtgcggggaaagacatctttgggcttctgctcttcatggatgcgggtgctgtgtcagcctcccccggccctccttccctccccagcctcctccttccccacctgtatgcggtgggtccctggaagagctccaaagcactttctttcatccctcgactgaggttttatttttaattagaaagccaagcacacttttaacagccacagccagactgagcaagctcttctgaagcagcgcaaaggtggaagcctgtgctgctgatgtggctgggctcacggaagatgacgggcttcctgccagcttgcactagccttggaggaaacctttgttgtgtaggaggcaaatcacccagggcagtgttttcctaacttcttctgtccttaaacaactgaccacaatctgtgccttcctcaggcccaggctttcccatctctgtcctgaacactcttcactccacgggcttcaaggtaattttttctccctggtgacatcgtcggtgccgcctcctgcccccggcacactcgtccacacacagaacagcagcttgtttctccatcactgtgtcattccctttgagccataatcctttccttcctgccctccagcggcttctgggatggattctctctcgcccgctggctgagggcggcctcccacccgaaagcaccataggagcttggctgcccgcagggtgacaccgcaggtgtcctcactcttcccgttgcctggcccctggtgatggtcaccgaatcgtgctgtcctttcttgtggtctgtcaagtgtgctccttctgggtggcctccactgccccttggtgccactgtctggcttgtacagcatcacgccttggccactgcgaccgtcttttccctgacctctcacactgatgctctggtctctggtctctaggacggtctttcactctaataccagtgtgagctcgctgctgcacaggcctggccatgtcactcctcagctgacaatccctggagggtgggggacaccaccgtgaccacacagccattgacgagtgggtgtgaggctggggggctgccagccccttctgcagagggcacctcctctgtgtccctggctgccatccgcagaacatcattttgtctgtgctcccggctgtcatctgcacacgctgtggtcccatcgtgtgcctgttgcccttttctgcgtgttcagcactgtgcctttggccctggctgcacccttccccaccctgccgccacagcacacagcacacttcccccaactgtgcccttctgcttctccaggcaaagccagacactggttcccaccccggcacagtgctgaaatgcccgcagcagcactgtggcccttgtaacatgatggtcaactccagctcactcccctccctgagttcctgggcagcccatgcctttttgctcagtgaatgataatggaatggcgcagaagcaagcacagaggcaggagcagggacagaaatagcagcgatgtgagtaacagccttttgcatcctcacagtggccttggccctggctggtgctgtcgtcattttagaggtaaggaaactgaggccctgtgaggtgggctgacttgtttgagttcccacagctgctgtgtggccccaaaacctctgcttggaacattctgcagaaagtggagacagggcctgactgtgctggggtgggggcctggcaagggccggaggggtggcctgaatgccagggcccaggaaaccggctggtgaggaagcctctgagagctgctgctggctgagcagatgtgcagggctgcgagtgagcgcagaggagggctgctctggctgggagacagggcagggtggccagagccagggagggtatccagatggatttcagaagcacacctggaggtttggagggacttggaggtgacttaatgtaaggtggggaaggagaaagaggcctcgggacatgggaaggagaaagaggcctcgggacgtctggtgcttctgacttgggggaccgggtggtggagtccccctaacagacattgggaaacaggagagatcagtcctgctggggtggtgtggggaagggaggagccagctgtgaggggaccactgttttcctgatggagggatccgacagcagccggagctgcagttggtggcaagtccctggcatggtacagcaagggcagtaggaaagctgcagaggggtggggtttgccgggcaggggtggggtttgtgggtcacgcaggtcccaaggagcccaagctcaaggtccgcgcctgcctgctctccccactcacccttgcccatgggagcgctgtccttttctctgaaaaagcctaaacgcgttggccttcctctttagcgaagtctttcctgcctcagctgagtctgtgaggggcagcccagcgtcccctctgtgccagctgtcttctccctgttcttggcccaccctttctgggcacaggcctcagctccctccccattcctaagccccgctttctgtatctccacagaggccttcctcggccctcccagcctgatgcagggctgccttggttcctactgccaagaacctgcgctttgccaccagctcctccccactcaccaagggaagcaggtgggaagcaccctcctttctccttctgtaaacctgggttggcaaaccttttctgtaaagaccagatggcaaataattttggtgtcacaggccccactgtctctgttgcaacagctcaaagtgagaaagcagccccagatgatatgtaaaggaacaagtgtgactgtttcaataaaactttatttagaaaaacaaggggtgggccagctttggcccacaggttgtagtttaatggctctgctctaaaccagtcctcatcctcctgctggataacaaccaaactttctagaaccaacagggctgggggttggaagcagcaggtggaggtggggtgttggggaaggaagtgggaggggaggcctccacagagagatggagagctgtctgcccagtccttcttctcttctctgggagaaccgggcacggtgccccctccaggtttagttgcccatgacgcagagccccattagttccacatcaggcctccgcttgcctatgaactgaaaatcagtttctctggctccatgattcctgcccccttcccctcatatatatatatatactagggaggctgcctcagcctccccagtagctgggattacaggttcccaccaccacgcccagctaatttttgtatttttagtagagacggggtttcaccacgttggccaggctggtcttgaactcctgacctcaggtgatccgcgcacctcagcctcccaaagtgctgggattacaggcatgagccaccgcgcctggctccccttcccttcatattagttaaacaaagcatgagacaggaggtccctcatcctcttcctgcactggaaaattagtcttcagttaccacagcggtctggaaagacttgaatgaactccacagtttagttgtcaggtggggagtgtccctgtgtgtgggcgctggtggttccaaggtaactgtctccggcccctgtccccaggtgtgcagtggaggtcaaggcctggagtccctcctttcctggaactttgagccccaaacctggtgaccccacgagcacctcgcacttcttcacttttcctcggttttacatcacatgtgtgtagcccctgttctttcttctctaggctacaactgtacccgctgccaccaagctagaccctcggaggtgaccacttcctctgggggtaaagggcccctcccaacccatcaccaaaaaaacttccccatttaccccaagtctctccccagtttaccctaacatgcgagttgaagttttccctcctgtgcggtggaggtaaagcttatttcccgctggccctgtggaaaatgcagggagcagggaccattcccgaaatccccactcagcaccaaccacggaaggagcagcacacacttacttctctgtgcagttggaagatgcaaaatggaagctcagtgttcgatggttcatccaaggagaggtacagggatgggatttgagtccaggtccgggtgacccgggtcctctcagaggcctgtcttctggggttccacagccttgcccctctggaacagagaacaggatgcaggggtgggggcagataaagcgttctgtgcaagagacaggcttgacaggcctgggggcggtctgctgaaagggacccctggagcagcccagggccgactggaggcccttggggatggggaggacgttcactaccagagggagaggcaaggtggggaggccgcaggccccttctcggcccctctgtctgctgtatctccaccctctctccctgtgaccaggcctggaagggatgggctctgggccaagccctgctcttggcacaaactctccaccccaccctggaggcgcttgttagtgctttgcttaaaagtaggctgagaagtccgagcaaagatgggaagctttgttttcaaatataatgggaagggtgtgtggaaacagacctggcaaaacaaaggcagattgatgtttctgtttgtgataccagtggagagaggagggcacaagcaggtatgttgggggctatggaggccagggcatttgtttttttaagagggggagaggggagtgtctgcaggagccgttcaagcgtctacaccggctctgctgtgagggtggctcctgccgcacagctgtgggcctgcgcttcgcctcctcagagccgggaggccaggaatggtcctgctcacatctgtattccagccctggagactgggcgtggcaggcagaaggtgctgtattggaatgcgtagggcagcagaggagaatggaacaggttctgaaccatggcgatgacctcttggttctcaggggagtcaccctggtgtctggccctggcatgtcagccctttacctacattatcactccactggggcccacacaactcctccaggtgggccctatttattattttcaatttatagacaaagaaacagagccacagaaaactaagtcgcccagagtcgcagaggcagcacaaggtgaagctggctggtgtctgtctgagcgttgggcactgggtgcgtgaccacacagcccaggtggacccccacctcctctggcctgtgatctcctcagtgctcagcaaatgatcatcaaatttggtaacaccagcaggaccagaagcgattcctacagcctttattgatcccataataaagaggtgttcgtgtttcagaccaatgtgagtgcttccgagcaggtctgtggagttcaaagccgacaggatgtttagccatttcctgcacttccctgccctgtcatttacagcctcattagagcccctggcttgccaaaacacctctgtctgatgccgcagctctgacggaacgcctcgattttccctttgcgagcttttgcttgggctgcaggagtagtgggcggtggatgtttttggtggaactttgtgggccaacatcagacacggccaaaatgtggcagaaagggaggggcgtgtcggggaggtgtctctagaatctcagcttttctgttccggggcaatgctgcctgcaccgcaaacgctgtatgctagaagccatcaggcctgggtccttgtggggtagtagttgttcactccaagtaactgaaggagaagggttaggctttggggcaaatagggaatgaatgagcttctgttctctaacctgaccacatgagttggaggctttgcgcccgtaaacacaccttgtgcaggtagacgcctgtctgctcaccacactcgcatgggagagatgcccttctcatgccctggcatcgctggatctttgctgctcgaaggacactgcaactttgaagcagctccccagttgcttccagcagggatgaaacgagccatcagcagagcctgcacctttaccacaccttggcaaggcccctgggaaggcaggtcaccattgagcaacacccagacagagtctagcattcatttccagatgcctctggggctcaattgttttcttcccctctccccacccctctctccctatagttagattttgcaagatctgcacaacacgtgtgtgtgttgatttccctctcctaagtcattccgatctatcagcccagtgtttcttttgctgtctccaacgctgatggttttcaacagctgtgtataggaaagctgctggattagagcaacaggctatcaacagcactcacacggcttcctctgtgggatgacaagaacctatgctttcttcatgcgggcaggatggccagcacagctttcacaaacaggcctgggaaactttgggttttttttttttttttgacagaggataatatccttgtttgtgataaatggaaggttgggaaacttagggtacctgttgggaaagccaattcctacaaccagagtcaagggaaaaatatccttgagatatatagattttcataagggcctcttcttcttcttcttccttcttctcccttctcccttcttctccctcctccttctccctcctccttctccctcctccttctccctcctcctccttctccctcctccttctccctcctcctccttctccctcctcctcctcctccctcctcctcctcctccctcctcctcctcctccctcctcctcctcctccctcctcctcctccctcctcctcctcctccctcctcctcctcctccctcctcctcctcctccctcctcctcctcctccctcctcctccttctccctcctcctccttctccctcctcctccttctccctccttcttctccctcctccttcttcttcgagtttaaacatagagacagggtctcgctctgtcactcgggctggagtgcgctggtgtgatcgtagctcactgcagccttgaacttctgggcccaagaatcctccctcctcagccttccaagtaactgggactatacaggcttgtgccaccatgcccagctaatttttattttttgtagagatggggtgagggggttctcactatgttgcccaggctggtctcgaactcctggcttcaagttatcctcctaccttggcctcccaaggtgttaggatcataggcatgagccacatgcccggccatgaaggccttctttatacactgttctttctgagctgttctggctgtgagggaccggcaggaccccctccatctacctcggggggttgaaggtgggctgatacccagcaatgactgtgaactctaagtgggacgcctggaatgccagtgttggggcttcatgcctttgaatcatggaaggccttttgctgcaaatactgtacatctaaaggtgctgagcaatgacaaacctgagccgggggccttcctggggcagggatgcatggcaagcgctctgtgtcacacgttggatgcgcagggtgggccagggagaacgatatattcaatgtcttcagagtttttgcaaaaggtttgctgcgaggacccaggctaaagggggtggttcatttcctgtcacttccgggggtggctgcagcaactactcatgaactcacactactggaatcttctcttcttcatttgagcccttacctggtggcagagatggctgtgtttccatcaaaatctgtttccttttcctcctgggaacccagtggaactactttttctagcctcttgcccagtgtggctgtggcacccaggcctgcccagtgaagtgtgggcagaagtgtgtgctatttccgtgcctgcccggaaagcttctcacacaattctccatgtgctcgctcctctccaggggatggcagggacactggggggaaggagcctgggtccctgaatgacgatgtggaagcctgccactgccctgtgaccttggcattggactttgaatgagaaacaaactgtcactgggtcaggcccctgaggcttgggtgtttgtttgttacggcagctagcattgcgcgccctaactaacgcagaaccagcagccctctcatgtgttctgctgtgcctgtgcctcttgcttttctgggttgctcggtgtcatctatgtgagattcagcccctccacctgagcacttctcatttccagctccctttctctcatccttctcttctgtcttagaggataaagtgtcttttcccttcaaatctaaacctatctgcttgtggctgggtgtgggggctcatgcctgtaatcccagtgcttcgggaggttgaggtggcagggttgcttgaagccagaatttgagaccagcctggagaacatagtgagaccccatctctacgaaaaataaaaaaattagccaggtgtggtggtatgtgcctgaggtcacgctactcaggaggctgagatgggaggatctcttgagaccaggaggtcgaggctgcagtgagcaatgatcagttcactgcatttcagcctaggtgacagagagagagagagagagaccctgtctttaaaaaaataaaaagaaaacaaaaccccgtatctgcttgtaccctttgttctgggcccctgcccgcccctagctcctcgccagctctgccctgtgcacactttttctcttggacagtttaaatctttatctccctggctcaattccttcttgtctgcaaatatgtcccaactgtccctatcttaaaaacaaaacaaaacaaaaaaacaaaaaaaacccctcatcctggttactcatgtatccacttctcctcaatgtcagactttttgaaaagtgtctcccctgctgctgcctcccccctcctcctcctcctctgttgcaatcagccttggctccactgccttgggctcggcttggtgaccagcccagagctacctcggtcacggcagccccagcatctgcagttcccacgcctcggccttttggccaggcttgagccgagctaggctgtgtcacattgccctttcctgggtctctgaggagctctgccctttccagcatgggccagcctccgtggcagggtagaggggaaatgtattccccgggctcctgcctgggcctcccctcctcctccacggcctctccttccggaatatgtagtagctgccgccttcatgccaaacaacagcaacatcaccttgtcttctgggtctgttccttgtggcccggtccccacagcctactatattttggggtgccagggaggacaggtataagtcagccagctgccccgtccctgttagttctgtctccttgaggtctcccaagcccacctccccatgtgtacggagtctctgtcgtggggcaagccctccttgtctctctgcttaattaagccttctaagtggctgaccagctgcctccctgctcctcaccgtcctccaccccacctctctctcctgactgacctgggtgctgagtgcttgtgggggcaccatgtgcccagacgtagtgcccagaaagggaagggcgtgggctgtgggcttgggcagacctggattcctgtcctggccttgccacccaggagctgttgactggcaattgctaaaccttctggaggctcagggttcacttataaaatgtgatagtgccaactttaatggggtgatgaaaatcaaatatgagaagtctgtcagccccgagggcacacagcaggtgtccagtgcccagtagctatctccctcatttctcttgcggagctcttgggacctgctggagggaagcctggtgtgataagtccagggcttgtggccacgaggaatgcaggaagccaccacggctttatcagtccttcaggtcagccgtggttttctgctctagggcctcgctaatctgatgaagaaccccaagatactgaaccatgtttttatccctcatgtttaagctcttttatttctaggacatttataaacagtgagctcttcttccagaccttcagttttactccctgggagaaaattaggccattggaaactcttcatccactgcagaggcacaggctgcaaaagccttagtgagcaagaccccctccccaggagttacctttaagtcgcccatggggccaggtcagggtgacgttgccttaggaagggcgaccctggagctgcgtccagaccaaggtcgtgatgggggaatattccacacagcttttaggtcttctgcctgagggctggaaggcgggccctcaggtgtctctggagacccagttgttactctgctaccagtgtgggcagggtgaggaggtcagcgccttgtgtttccaatgcacttccactgcttaataaaagcccgaaactcctgggccaggcccattgagaagataaaaaaaaaataacaaaaataagaaattgttgaggcactctcagaagaagagcacccataggtttgcagaaagtcctgtacgtgcccaagggccaacacctgccctgtctccaactgaccaacaacttcctctaaccagctgtcaaggacagtctggccctggggtcacagacaccagagtattattttggggattgccactcacctgctggggtgacccagggcaacttgaccactggatcccatgtaatctccagtttaagcatggaccatcgtggctggtgctggggaacgctcggtgtgccctgctctctcagcctcacaacagctgttgtgcagggagaagggcaggtgcagcccgccttgcgcagatgagcaagctgaggcctgggaggggcccagcgtcggctgctctgatggggccaggcccctcatactgaatgccttggctcctaatcccacccatctttccaagggtgggtgaggcatgaaggtatgattgatgtcattccccgagttactaggcttggagggcagtcctgagacaccccttgttgttcctcactttggatctttcttgctttctttctctccctctctctctcttgctttgtttgtttttttggtttttttttgttttttttttttgtttttttttgagactgaatttctctctgttgcccaggctggagtgctatggcacagtctcagctcactgcaaactctgcctcccgggctcaagcaattctcctgcctcagcctcccgagcagctgggattacaggtacgtgccaccgcacctggctaatttttgtatttttagtagagacggggtttcaccatgttgcccaggctggtcttgaactcctgacctcaggtgatccacccacctaggcctcccaaagtgctgggattataggtgtgagccactgcacccggcccccactttggattcctatgaagagcttagaaagacaaaaactgaaaaacccatggatggaaagtcaagcggccgtggatcaggcaatgttgactcctcgttgggttgttatcccttcttcacacggcacaaatttcctttgcatctaaacccaacttctttaagactctggcttataaatatctgctttctcttagattcatgccaggctcagagcctgtcccggtgacagacgcccaaacaccttgatggctgaggaaaagtagagcgaggagggctctctgaagatgcaagcgtgtgggtgggacaagtacaggcagcagtggagatgaattcacttgggatggattccaaggttgtctacacctggagcagtcacagacttcaacatatctttaagtgtggtgccaccagtagctgagttcaggccactccacgcccagccactgtttctgttcaggccaagggagctgatgcgggaactcaccagcatcgtgggaagcagctgctcattgtcctttgtcgcttctgaaacgttcggcagcagcacagaagagacatcaccccttaatgctttatttacatgagctcttttgagaaactttttttttttttttgagacagactttcactcttgttgcccaggctggagtgcaatggaacgatctcggctcactgcaacctctgcctcccaggttcaagcaattctcctgcctcagcctccctaggagctgggattacaagcgtgcaccaccacgcccggctaatttttttatttttaatagacatggggtttcaccatgttggccaggctggtttcgaactcctgacaacaggtgatccacccacctcagcctcccaaagtgctgggattacaggcgtgagccaccgtgccccactgagaaacattttacaaacaggtgcattgtgggagtgggtgtggttagtgtcgcatcagggacgagtctgaacacagaccttggccgtggctgtgggtcctgctcctcatttttctgcgaggacatgatacaatcagggactcttgtgaaactgcctggaaaggagcttggctgggttggtgtcatcccgggaacacctgccagccaccttcccgctttgggttccctgaggcgcaaccacaggcctatgtgtggggcgtcgggggacttgaggcttccttgtgatggtctcctgaggctgccacaccctctgtctctgtgtcactgggagcccctgagctttgggtctgtagctgggtactcgggtgccggcacagcttgttcgtttagggagaagacaagagggcaggccttctgggtaggaggagggtttttgttgttttgtcttgtttgtgctggttattatacaaaactcaaacatgtagaaggtcatgtgcccactgcccagctccaacagccgccagtgtagacaggagtcttcgggcgtgagtgctggggccagacatgtgctttaggaagctgcctggtggcgcctgcagcccccatgccagaagctgggctggaggcgaggagagatggttgggtctgtaggcttgttgaggtgggtgagggtgaggacccagaacaaggtagggggaagagaacagggtggagagttgggagagagtctgaaatagaatcagtaggatttggtggccagctgaatgtgggagccgggggaggtgaaggggttcggtgattccactgaccatgggggattataggggaaggaaagggtttaggacagggcagaagtccaaccacagccctcaaagccccgtgcgaccttgttttgggaccttgcccaccatgctccagcccccttggccatctcctgatgccttcactgtacccggcgctgtgctgcagggactctgcacatgtggtccctgctgcctggaccgccccagtcctcacacctcacttccggaagcccctgtcaccttgggtctcagctccagcagtacttccatcgggagagccaccgactcttgctctgactcttgtttccttattaactaatcacaacatgcaattgttttgcctatttgattattttcatgtttattttcagtttgcctcaacagaacgtaagcccaagcaggcccgtaccgagaactcaatagacacaagcatgggaggaatgagggactccggaggcaaacgttggtggaggcgcttggacgaggcactgcagccagcagcgagccagggaaggctccgagcagaagaggggcctgagggaaggcacacaggggcgctcagagggagcccagagtcagacacaggaaaaaaccagctcagcccagccttctgttattcaacccctccatgctctgtgggaagagggtacacagaatccctgaattcagtcattaatagcagatgcagagacctttctaacttggaggcttagatgtcaaatacatggttttaacgaaagtgaagtcaattagtatgttcttgtgtcttactcaacttgtgtgtgcgcaagcttgtgttattaacctgttgagaaagccacaggcgctgaagaaccagagaagcgccggggctcccaggggctctctttggagccttcagtgccctggacagtgaaacagcctccatctctttcacagttggtgctgtactaggcggttcaatggtgtgcacatccattgaaggtctcctccacgccggaaaatgatgcacatctgtgtgcagcagtcacttcagaaatgctttcaggaagtcctgctttgtgcagaaaccttccccagctcccaagctgttacagcatctggtggcagctcccctccttaacctaggaggcctgccccacccacctcctctggctcgtgcccattacgtgcttgtgtctccgccatacccttgctggtggcctagaatgtcgttcatctccagcaacttctccttcgaagctgccctccaggccttgcatgtgccctgcctgttccccgggcctccctgcctgccccaaaggcctctgactcctctggacacccaagttgcctgggtccttcatcatgtgagtcttgccttggctaccattgtttctcttgtatctgtcttgagttcccaacatgaagctctttgaaagaaggtatcattgttttcaccacatcttctgggttctagctcaagtgtagaccttcaaaaatgtatgtaggttggctgactgactgataaggttagcgggggattgataaagtgctattctataccaggctttaaaaaaatgccaatctaattccagagatggctagaaccaaaaggtgactagaaaggcctggcgaccacagcagtaggtgcaaatgtgctgggttttgggcaactgtgatgtgctcttgaccatctcttactctttcttttctcccagccatgaaactgagggggcccccatgctctctgccccttagaggatatggtgagggaaaatgaggtgctataaccatgtataggtcttgcttggaagctgtgattcttatcaggcttgttagcgtctcagaggagaggcttcccaaccaggcctcccatccccttcgcacagatactgtctgtgtgcatgcctcttgtgacgcctgcggggacgcacacccatgccaggcagtcagggatcctgctcctgtttcctcagagggtgagcagttccatccaccgcttcttgctttgtcaaatgggtaatcctggcagctgccaggctcattgctatttgcaactctacctgttggttagctccaggtggattgcccagaccgggccaccctgttactgctggctttgggccactgggatctctcagctactgtcactccccagatgttaatgtctgcctgaaatcccagggcaggaagggacccaaaaggtcatctagttctccctcctgccttgaagtgagaccacacctaagctgatccagacagccgagggtcaggcctggtggtaaaacctgcagagaagcctcccccgggtaacttgttccaggcccctccatcgggaggcactgacactttctcacttcagatctggttgctgctcattcccgaggggttttggatgcccctcttgaacatctgctggtgtgttgggggaaataggagcctgccatcctcgctgcaagggtggagtgagccaagaatggagagtgtgagtgtgtgtgtggggctttcgggaggtcttgctccctgtctgccaggggcctgacactccaggggcagccccgactgggaagtgccccagccctgctggtggacagtgagtccagtccagaatcctactgagcccagcctcttgttctggaagaaatgaagtttcagtaggaaagaaatgagggcagagcaggaggagtgaatccgtcagaacttacatctcttcactcattcagcaaattcttgctggcccccgctacatgctgcttggggataggggagaaatgagaactggagggtgtccaggttgctttggctgtcggagagaggtcccagcccaaggttgtagggcaccgggagagcctgcacagtcttgtgctgtcggcaggggtgtggggggttgaacatatttgcagagccccacctgcctgctctggctctctggaatggctccgctgtgttgggaacagctggtcttcgctgcactttcctatccaggccatcccacagccaccatggcctgcagtggagcaggcacccagtaaagacaggtgatggttcttagaacctgctgtacaccatcccacccctgacccaagtgaggctgccgggggcacatgcagctccaggcactcagcctacatcatctcccctgaccctgccggcacctctgctgtgagccatgtcccctcgaaactcatatgtccaagcctgaactcccagcacttcagaaggtgactgtatttggagatttggagatagggcttctaaagagataatcaaagtaaaaagaggtcatatggttgggccctaatccagtgtgactggtgtccttataagaagaggagattaagacacagacacacacaaagggaagaccgtgtgaagacacagggagaggacggccacctgcaagcccaggagagaggctgcaggagacatcaaccgtgccgacaccttgatcttggacttccagcctccagaactgtgagaaaataaatcttgttgtttgagccatcccgtctgtgctactttgtaagggcagccctagcaaactaacacagcttccgcggagcgggatgtcatccccatctaacagatgaggtctgtagcgctgccagatgccacacaaggaatgccgggccagttcctaaacctccctgagcctctgtttcctcatctgcaaagagggattaatgataattttgtggtaaggattcagtgagataggacacaatgcatgtttgttccccacgcatgcctcggcctgatttgattaagaagcccatgggcctggggcagaggctagctgtgagttctgcatgtggttgacagctggtgttgatgaatggtatgttaaaaataaaacccaaaccaaaaagccttttgcactctatggagaacctgaaatcggaagcgctcagtttcattagttggcagacgtctctgacttgtgaacctgaccgggcaccctgggactccctatgtcaaagtcttcctacggcagcctccagcgaggtgggggagggtgagagggcgcgtcttccaggcactgtctgcctgacttgaccctggtaaagtgtacacgggaacagagccctagggaccaagccctcaagcccaggggcagagctagctgcccgcctgtaggcaccattggtgcagtgtcaacccagtggatgttccctgttaagcctgtgccctgctcagctcagctcggctgtgggagtcagcttccgtctgcctggagacacccgagggtgcagagcagcacgtgcagatatgttcctgggggcgggtaccactttctcttttatttggaagttgtctttcacaatgaaacagcctttaagccacataacctttttccatccctgaacctggaggggccatcgaaatcctcaatgtcactctgggggaagctgattctgggagggacccaagggggagggcaggcaggggcccttctttgggttggtccagagacctactctgtaccactcaattatattttaaaatctatctgtacgctttcacaccacaagtcctaaagcatctttaattaggtcccacacacagatacacacacccagctcaacaatgatagaaaacgccaaattccagttgacaaggagccagaagcccagcctttcctctggctaaacagagggacccattatgctggaatattattttctcatggtttggaaccattacatcagccttgatgtaataacattgtttaacttcagaggtgtatttattttggtttggagttcagatagtttagccgttagctggggattgagcaaaacccagacaaagccactaaagtttgaaatgaaccattctgccgttccccttctctgctccccagaataaatattcttcagatgtagtttcatctcacagcaaaggtggtgacctggctgctgataaattttggaggcaattttttttcccctctggtggttggccaacatgatgatgaccagctgggcactgagtgggtaatcaagccccaaacccagtaaggacttgggaattccaccagcagcttctctgaagatagcctgtgatctttccacggttcctccataagcccagctcttctccttaaataactcgctacaggtggcgctttgatcggtcaccgtggggacacaggggatggctcttgttagcggctgagcccagagggccaggtctccagacaggagctcttaagagccccagagagtaactggaggcttctaattgtttcctctgagcccaatccttggaatgggtggaaaaaactctggtatctgggctgtgatatcctctgtgctggagtgcaagtgacaggaactgtgaaatgaccactgaggccgggtggtggaggcgtgggagccccagggcttgttggttggggagccctcccaactgcatgttccttctagctccatgcatttctgtcccaccctccacagcaacaccaccatggggaagagtttcctggcaggtccacttgctcatcagccattctttccgaggccttcttcccccactctactgtgatagctcttggctcttatcagggtccctaccaatctccacgtggccacgtcccgggtgcattcctgttctcatggtactccatgctcgcagcatttggcactcggccctcgttccctctccaccatgctggcccgttttcctcctcctttgctggctctctggccttcaaaggccaaagtgccccagggttcctccttggccctcttctcttcatcaacaccctctcactgagcgaactcatctggcccctgggtttcaataccagacagttactggtggctccccaaacggtatgacctctgccctgaatcccaaacttccccatccaactacctcttcagcagttgcccttggcacctaacaggcctctcgaaagcaatatacccaagcagaactttcactgtcctaggtctctccccatcccttcctgccccgtgaatggcatcctcctcctggctcagccccataacctgggatccatcttcttgtgtctttccttcatatccacacccaatctttcagccaggtctgtcagctgaggcaaatccagccacttctcaccacctccacgctgaagcgctagcccagccaccctcatctctcacttggattattgcaacagcacctaactcatctccctgcttccactcctcccggctctagttccccctccatctgtagccatagcggtcttctcacctggtaaatcaaatcatagcagcactttttaaatccttctcattgtagttagaatgcagctcaggctcctttccacacccttgggcacacccagtatttattcttatttatttatatttatttatttgagacggagtctcgctctgtcacccaggctgaagtgcaatggcgccacctcagctcactgcaacctccacctcccgggttcaagcgattctcctgcctcagcctcctgagtagctgggactacaggtgcatgtcaccacgcctggctaatttttgtatttttagtagagacggggtttacatccagtatttattctgtgtgtcttactttctgattgagccctacttttatttggagcagcacagtacccagttaaatgcctgtatttcccagcctcctttataacctaggggtggccaatgagatgaaagcagagctgttgagtgagacttctggtattgtcctttcaagggagctggctcagctgggagaatgcaaaatttttcctgttccatgctttcctcttttctactgcttagaatacagatgtgatggatggtgctccagcagccatcttgtgatataaagcaaccttgacgatgaaaacttcataagagagatagatgaagcagagctgccagatgaccacagagtcatcataccaggcttggaattcctaattctgaacttctctgatgtaagaaatatcttgtgttagccactgattgaggctgattgaatctaatcctaagaagtaaaacctgcaaagcttgaagtaatctggcctcgacctctctaatttccttcaaccactctattctagctttgccatgtatcatgcatgctggttttctctcaatgctccttgaacattctaagcttagtcccatcttgaagctcttcccccagatctctgtgacttcttcttttgtatcttttgaccttttcagagaagcctttcctgacttatgtagcccctaaccagtctgcttctccttaagctcctttaacaaatttcatagcactggcctggtgtggtggctcacacctgtaatcccagcactttgggaggccaaggtgggcagatcacgaggtcaggagatggagaccatcctggctaacacagtgaaaccccgtctctacaaaaaatacaaaaaattagctgggtgtggtgcaggcgcctgtagtcccagctactcgggaggctgagataggagaatggcatggacccgggaggtggagcttgcagttagccaagatcgtgccactgcactccagcctgggcgacagagcgagactccgtctcaaaaaaaaaaaaatttcatagcagtttcactctttgagattactttgtaaaacatgcttattgtctgtttccccccttagattgtaagtttcatgaggacagaggttttgactgtcttgttcactgctttatctcctaggctttgcatatgatacgtgtttagtaagttatttgttaaatgaatgtgtggaatgagatgacttttcagaagtttctgaaaaaaactggtcttgggtgtggccacacatcacagaatcccttctgctgtatttgaaaatagcccagcaaacacttgtggctcacccatgacttgctgggcctgctgcagcactgggatgtaaagatagagtagctccttgtctgagctctggaagctcagagtggacaagagcgtgtgtagatagaagactgaggtaccaaaatacaggaacactgcggccagcctcaggaggcttcagtagagacttagaaggcagaatcctaggggcttgtcattgtctggatgaggaagaaagggagaagggagaatggagagtggcaagtgtctggcatcagggccacatttcaacaggcatgtgtgacattagagggcatgacagagaatgcagcacatctggacagtaaagtatttttttttttttgagacagagtcttgctctgtcccccaggctggggtgcagtggcacaattttggctcactgcaacctccgcctcccgggttcaagctattctcctgcctcagcctcctgagtagctgggattacaggcgcgtgccaccacgcctggctgatttttgtattttttgtagaggcagtgtttccccatgttggccaggctggtctcgaactcctgacctcaagtgattcgcccgcttcagcctcccaaagtgttgggattacaggggtgagccaccgcgcctggcctagacagtaaagtattgaagtgctgtgctggagctctatgcaggctaccaaaaaggcacagaggaccacctggcaggttctgtggttttaatagagtcaggggctgattaggagaagctctggggaggcagtgatgctggaggcaagctgtcaagtgtcttcctcacagacaaggctcaggggaaggagctgcagactgagcaaatagtagaagtaaagatatgaatgggcgaggtatgtagcatgacctggtttgtctgggactgtcctgatttcaccacagaaagtcctatggcccaggaaaacccttcatcccaggcaagctgggaagattggtcattttagagacccggggtctgttaggtccattggagtagctttcagtggctggagaagagagagtcagtgcgtgagttgcgggggaggaggaaggggctacttcctgggaagctggaggcagtaggggctggataaaaagcctcctaggcagcagaaggaattagatctttttcctgaataggggagaatcactgaaaaatattgcaagataggagtgaggcagtaaagaaatgaatgacatctccattggagaatggttcttcctactgtaacataacatagagctgcagctcatcagtctgtgtgttttatgggccaggctcggctgccaccacttttctcccaaagcagcacaccccatacccagggcagaccgggcataggcacctgcttgaggaaatggctccagtgtttgcccggctctggcatcatcggtcagaagccagttacatcaaccatcccttagctcccacttttgggggcttcccagctgaagagtctcgcagctctgggctccctgtggacctgaatcaggagggcagaccacgcccttatgcatccccagcgtcttccctgttctggtcactttttacactcagagaccacccacctcctgccctctcttgcatactgtcacctgcagtgccctctcctgcctccttcagagcccacgctgctgtgcctggactccctgccaccccctggctgcaggacaccacctgtcctcgtttccttccacctccctgactgcccctttctgtttctcatcttcgttttctcctgcttcccagctcccatctcaaccctatgcctcttgactcagttaccattaggtctggctgcacatagtggaaaatcccaaatagcggcggcttaagtgcccaaggttctcttctgtcccacaaacgcagagcagaggaagcagctcagggctggtgtggcggcactgcgaagtcaccacgaccccgcgaactcaccacgaccccagtctggcctttaggaatctgctgtctggaaggccctggccagaccctgttccccgaccctgactggctgggccctacttcctccagggtggctccagcccccagcgcaggcccaggcagctctcccacaagctcccgttggccctccatctcctgcaagctccactgtgccagggcctgtcctgctcatttgctccctccgtactgccttctgcggggcctagtgcttgctgccaaggtgtctgccctccctgctaattgatctgaagtcaggacagtgccgtagcccagtcattgcctggtacagtgttctgttcctactaggtcctctgcgtacatgtggaatgaatacaagaacctttttgaacaatagttggaggcatcaggaagggctaaagaccatcctgaggggccccgaacccagaatatgttctgtggttggaggccgggagtggtggctcatgcctgtaatcccagcactttgggaggccaaggcaggtggatcacctaggtcaggagtttgagaccagcctgaccaatatggcaaaaccccatctctactaaaaatacaataatcaaccgggcgtggtggctggtgcctgtagtcccagctatttggaaggctgaggcacgagagttgcttgaacccgggaggtggaggtggcagtgagccgagatcgtgccactgcagtccagcctgggtgacagacaagactctgtctcaaaaaaaaaaaagaaaaaagaaaaaaaaagaatatattctgtggctggagaggagggctagttatcaccaatgtgtgcaagattggtgagtgtgtctgacagtgttcatagatttaattacaaaaagattcatggttagctgagctcaggtaaataacagtttgactacattatgtacagatacaaatgatgtcctaaagaggttgtgtaataatgcacgtgacacctcttttgaccagtgttacttaatgtcagttgatgagtgtttcagtatttctatgcctggcaggttcttctttttatttctaactaagtgtcttgctctgtgctgttatttctgaatcagtaggaagttgtaggggtatgagaaacattagacaccctaagggagatgaaggtcaaatgaaattttaatgttttgtatttcttcatcctaaagatgctatctatttatctggtctatctttacatctttcttttttcttcttgtttggaaaggtgtcaaagggcacatcctccaatccctggcttgagaccagtttgcgtgacaggccctgctgacaggtggagggttgaggacagtgcctggtggcttgggctctgctcactgttctactggcatcacgaatgcatgtggctcgactctgggaatcttggagcaacgcagacggcaagttcacaataggtgtttgcccttcaataggccagaactaaaactttatccccttcacagtggggcctcctaattagatataaataaatccatcaagcaaaaatcaaatccttccctttccattcatttttttttcctttggcatttcaacccataatctaatatatggggaagagaaggcactgtagaggttgaatgacctgggctagggaggtaggtgagaaatgcctcctttctcagaccagcacctgactcgcagtttgggggcctgggtggggaaggaggaggaaagacagggagcatggtgtgaaccaggagcctgcccagtgcccagaccaaaagggaaggggctgaacattgagaggacttgaaattaacagagctttaccagccagtcaataggtcctggctgcaggaagctgaagctgctaatggctctgtttttttctccttctacagccacggtggttccccctgtggagttcccttcaatgcgagacagagaccattttactgactgcgaaaattcaattagagtcttatgtcagggtggggagaacttatgcgaagcccaacattctggtggctctctttttgatctgctttaccgtggtaccttcacaggaagtgagttccatgaatacggaacatatgggtgcagctggagggggtgtgggctgttggagacagaggttcctcagttttcatatacatgaaatgattgatgagtttcttgcttctgtttagaaagcaaaaaaggggaggctgaggtgggcggatcacaaggtcggatcaaaaccatcctggccaacatggtgaaaccctgtcactactaaaaatacaaaaattagccgggcgtggtggcgcgcgcctgtagtcccagctactcgggaggttgaggcagaatcgcttgaacccgggaggcagaggttgcagtgagttgagatcatgccactgcactccagcctggtgacacagcgagactccgtcttaacaacaacaacaacaacaaaaaagcaaaaaagatgtcttgtctgtagacaagcataatttctttggtttctgtgttgtccctgtcacccatcagaacctcagaaatgctatctggggtcagctgtgcatttttctttgttggtggcccattggacaggcaggtcacttctcgtcctccgaggagtagatggaaaaaaggtcagtttgaagctcaaggacagctgaggaccgaggcatgccatttaaggggagtttggtacttggacccaagtattcccagagtggacgcacttgggcttggagaccctaaacaaagaaaccttagaaatgctctacttttcctttgttagtagcaaaatagccagctcgctgggttctcggccacacatgggcacccggaagccatctacaggcgctcccacggcaggaatgggaggagggggctcctcagcttttcttgctcagcccctcctcccatgagctgcccaggcctgtgtcctgatggaaggactccaatccctctccttcctcccttttggttctcatgctagccctcagtgcctccccgataggctgggtctctgaggcactagagtgctgccactgtcctaaaacacccctgcaaggggtcacatgtcctcctggccttaccacctctttctgggctgacaaacccaggcctagctacactggacttgacctggttcctcccctagacctactctcacgcagttcatcccagggacctcagttcctgtccaccttgtctctctcatgtccacctgggggccacctggaaaatgcctccttgtgcttcatggctcagttcaaatcctgcctcccctgagacacctctggtagacttaggtgtctttccccctcagctttatccctgtggtctctctgggagagggaggatctccctgctcatgcactggtcttcccagtagacttgggggtgggggtgtcagggcctgacttatgccttgctggatctccagcagctatttcagtgtgtttactgaatgaaagggaaggaattctgtgctaggaatagtttgtgattagcaatttgaagtgggtcactaaccaactgctgtatttagcacctctctttttttttctagaaaatataccaacttggacagccatcctcaggggcctgctgttgaaatatttcctgaatgttcacaaatttcctggatgttcaaaacatgttgaattctactctcacagaacctccagtagcccacgaattggtctgaaggcccttgctggatgaaccagaagtgggtcctctctacctagctacatcgaggctccccagtcttactgagaatgaggcccagaacacaagagtttgtatggttcttgctgacgtacaatagatttcaggggttggggaactgaggacatcatctcaaaagtaccacaattgatgagtagccctatgaaatgcttttgtgttaaagcctgtttaggaaatagaatggggacatgagcaggtatgatatacctgtgtccacctgcttacacctgctgggaggggacagcagcacacacctggaagcatggagtggcttgccgtccaagctgaccagaacgcagggcctgtgctggagtcctgggcctgctgctgacctacagggtcttggcccagccacactgggcacctcagctcctctgtctgccccatgtgatgcccctacttcattcagtccataagcactcaccaaggcaggtgcggtgcgggacactggacagtgacagatgaataacataggtcttggccccccgagcccatgagctaccagagataataagcatcctcactgaggccactgctgggtttatggatgcagatggctgccagggccctcctgaggtaggaggcacccagctgccctggtaagaaatacaggactgtcttatcaaaataaccctcctgtgttcactctttcatcaaggacttgagtctgtgacctcaaaggcatgaggtggccttggggcattctgtggggctccatgttggtctctgagctcttacaaaggccagcttgacccccaaccctaggaggcactcttggctgggttctccttcccacctggctccaggctgaggccgtccattgccagtgtccagggctgctggctgagcaggacactgctgcactgggcctggcacgcacctcctctgtgcagagatcgagttgctctggagaggtgtgacatatgatggtgaaacttggcaagagtggcttcagtgacagaaaaatacatgccaggtccctaagcccaactctgccgaaggccttcttccagccagaaccctagtgcctagtggtgcaaagaccttctctccactccacaccttgcaggagctgcagggccaagaactgcacctgggttctcaatttgttttgcaaatgagccctaaggctcacgtatatggtttgccttgtcacttttggacgtttccatcatcctcaacagatagtgatgggttatgcaaaaaaaaaaaaaaaaaaaaaaaaaaaaaaaaggcgtgcgtgagaggaagtgctctgtactcttccaacttctgcaagcccgaatctacagtgtcgccatgtttccttcctgccttctccaaggagttccttgatggcagcagggagccagcatcctgcattagggtggcctggtcttgcagctgcttggagggtgttggctacggcactgatgtgcattattgtattcaaaactgacagacgcagtcacatccttagccgagatggaaggctgagtttaccagtacaaggagaaccaagctcgatgctaaatgaggctttgaagcaacaggaacaggtccttgcccctcaggaggggaaggggagccccccccagaaacacaaggtgatttggaagaactcaatttacacccttggctcccgtgggctgggggatcagcagagggcaggataatcccagcttctcgagcagatggtttctgactaccgcttgacccagttccctcccagcagatgactggcagcggggctgacagctcctccactaggggagcaaagtgtggaccctcctcccaacctcctcttccctcctcccaccagcaaggacacggcggcttttgcccctccctggtgccaggtcaatgggcaggatgctgcatcttcttgaaggcttgaaggcagggaaacctcacccatattctctccctttccacagccctgtccagcccaggtggggctgacaatgagaagggctggccaggaacactcctgtgagggcttgtgttggggagtgggggttgtgaactccttcattggctttatggcttctctcatttcttcattcaatcattacttcaataagttctccctgatcatctgccaggtctggcaccagatagggcccaggaagtctgcttcccatgcaggagacagacaagggaggagataacagccaggcactgggctgagagcctcactcaggtaaaaaactatacagggcacaaccgggtcagggaaggcttcgccaaggaggagagactgggctgactctgagagcctgagaatgagtttgtcaagtagctggtggctgtggtgacggagacagccgggtgggcagatgcaagcaaaaccaggaggtggccagcctggctcaaggccaccatgcaggaggtgcttcccaggaggcagaagctcccgggccacaggctcccaggcagggcaagggcaacctgatgggagagcagagactctggccctggtggagattctaaggaggcagaagggctgccatctcggggatcctcctggatccctgcttctgacttcggtcggcaaactcacacccgccctagttttgcccgccagcttcgggtcggttcctccgattgggagggagggggcgctcggcttccagacttgcaggccgccgcgggcctgcggtcccggccgagctccacggtggcagggctggcccgagagactggcggtgggaggcgggggcaggaggccacgctccgcctccgacgtccccgattccccaatatcctgggaaagccaggatgaactcccatcgtgcttctgccttgagtctagcccgttgcgagggaacggggtacggctccgtgtcctgtgggcattgtcatgcggccccagacccgggtgggggcgtgaagaaggacagaggagcgcattgcacttggggccccggacgggtctgaaagtcaagtttccactgacagtgttccttgtccggtggcctgagaacggtgaccctagaaccatcctttatcgggttgtgtgaagagcctggcccagttgcctcgctgggcctcccacccagcccctgtgatacaggtgttactgtcccttcacagaagaagaggtaggcgataggaaaggtgaggactctatccaaggtcactcctgcaaagctggcagtggctgagcccgagtggaacccgggtctgagtgaagccaaagtttgtctgctggcgaaagtgggaattccctgggggtgggggtgggggtggggtactgtagaccctgccagcccctcaagccctgaggctcagtggcctccgggccgcgcgcctgggatcccgcacaatcggggcgttcctcctggcccagcagacgcagccgctggccaggcctccagtggctactgccttcccgccctccagctcgcagggtccacgcctcggccagtgcgacggcggcccggggagctgggtgagggcactgcagccccagagcggcagccgccggcggagcctgcctctggcatcccaggccgcgccgcaccccgctcgcctcgccaggctcggccgcgagggagcgccccgggagggccgggggcggccacggcggcgggagtcgcctctgctggttggggagggcggcagctgggacagaggcagggcctgcgcggcggcggggaggcgggagtgggccgggaggagcgcctgggtccagcgcctggaacccgtcggtgccgccggccgcccagctgggcaagggtccggggcgcccacgtggtgggaaagtttcgaggtagcaaaagtagcccggcattgcggggggtgggaggggagaggaggggaggggagagggccggctcgcccctccttctcgggaaggcagaaaggaaaaaagcggtgggaagcaggggtgagcgcggggagcgggcagccccaacctgaacagattccgctttctcctcctccccccaccccgggaagctcgagcggggaggtacggaccgtctcctctcgcacgggcaggacgacaccctccctcccccccttttttctgccaacgtctatctcaacgcgcgcgcacatacggagattgtgcggcttttttcccccttgggagaaaaaacggggagagtaaaagaagagagaccaaagagaagaactcctcctcggcgagctccgcactccgtgccgcggcccggcgcggggacgccgccgccgcccgcccgctctctcccggccctgcggcgggtgccagtacgagcgcgagcgagggcactgcacccggggacgctgcgagacttttcggcgctcgagccgacctcgccgccgccgcggcaggcagaagagacaggagcgagaagggccctgcctccccctcgccttcctcgcccggcgccccgcgcccggccgggccgcgcaggcaggcggagggaaggagggaggctgcgaggaggcgggcggagcagaggccccggcgaagcgcgctgcggccgcccgcccgtggatgcggcgcccagggatcctggagacaactttgccgtgtgacgcgccgggaggactgcagggcccgcggccgagggctcggcgccgcctgtgagcgggcccgcgcggccggctctcccgggcaccaagcttgctccgcgccactgcccgccggcccgcggcgaggacgacctgcccgtctccgccgccggcggcccttcctggcgcgaggcagtgagggcgaggcgctcaggtgcgagcgcggggccccgccgcagcgcccgccgcagcgccgcgccaagccgcgcccggctccgctccggggggctccagcgccttcgcttccgtctcagccaagttgcgtggacccgctctttcgccaccttccccagccgccggccgaaccgccgctcccactgacgctgctttcgcttcacccgaaccggggctgcggggcccccgacgcggaaaggatggggagaaggctgcagatgccgaggcgccccgagacgcccgtgcggcagtgacccgcgacctccgccccgcccggcgcgcccctcgggcccccggggccctcggcgccccttccctgccgcgcgggaacccccgaggcccggccggccccctccccctgcgagccggcggcagccctcccggcgggcgggcgggcggaggcccgggcgggcgcgggcgcgggcgggggcggggcggggcggcgcgcccggagcccggagcccggccctgcgctcggctcgactcggctcgcctcgcggcgggcgccctcgtcgccagcggcgcaccatggacgggctgcccggtcgggcgctgggggccgcctgccttctgctgctggcggccggctggctggggcctgaggcctggggctcacccacgcccccgccgacgcctgccgcgccgccgccacccccgccacccggatccccgggtggctcgcaggacacctgtacgtcgtgcggcggcttccggcggccagaggagctcggccgagtggacggcgacttcctggaggcggtgaagcggcacatcttgagccgcctgcagatgcggggccggcccaacatcacgcacgccgtgcctaaggccgccatggtcacggccctgcgcaagctgcacgcgggcaaggtgcgcgaggacggccgcgtggagatcccgcacctcgacggccacgccagcccgggcgccgacggccaggagcgcgtttccgaaatcatcagcttcgccgagacaggtgggtccggccctccggctgtctgccgcggtccccgctcgctcccgctctccctctccttgctagctccggctgccaccgccgccaccgcagcccgcgcgccctggggcagcctggactcccggcagagctccttcggccgtggccctgcgcgctccgcccgggttgcagtcctcttcccccaggccgcagacccttgcctgctgcctcaaccccccgccgccgatcgcctggccctccacccctgctctccggaatcgggccccagcgcctctgggcgcgcgtccccctcccggcagatgcgcgcggccctggctctgcgggcacttgcttggtgattgcttaatgtttttgtttcccacgatcggagtgtaggcttagcagtgtggatggagatgtgtgtgcttgttgatatacgtgggccggaggagagagagagtgtgtgtgtatctgtgtgtgtgtctgtgtgtgtgtgtgcctgcgtgagaggcccctggggccgcttccatcaccggcggcgtgggcttgccaggattgctgaagcctcgctggggagagctaggcaacctctcttccgattgtgtgggcaccggaatcgggcggaaggcaggcttctcaacaggtccatcatttacacagagaaagccgcggttcggggacagccccgtgcctctcggcttgcctggcagctgcagcagacccctcgcccgagaggcagagtcgtagttaacaaagggtatggctcctttctggaatccgcccccccccccggccccagattgcaaatctctaacactgtctaaatataaaaatcagggagagaaaaatctttcggaactttaaaagaaggagaaaaatgtgcccgcgccaaaatgctgcaagtgctttcgactccgctgtccttttcaggacttgaatgagccaggctggcttttgtgcctggagctcggccccatttgtgccgaggggactgcggagaaggtcgcagagggggaagccccggtgcagttagggcgggggcaagcggggagcctcggtggggggagcggttgtgcccctggctgcaaatgccccccaccccaccaggcagcaggcagcccggggatgaaaagggatgaaaagttttgcatggccgggtgtggagaaaagcagagacaatcggggctggtttgtgcttagaaagaaatgcattgccgttttagctgtccactaaagtgagtcagggaaagctcgccatgcaattagagggctcggattaaaaggtgctttggggcccagagttagaaatgtgattctggaaggtcgaggaggccttttggtcccggtggcacaaaatgacagcgggggctgttatatttctggtccgtttcacggagccagctctttgacttataaataacagattcaggtcacaggcagctcgtccaagaccagcttttaaggctgcagtttcccccatttcaaagtcagatgtcagtgttattagaggagccaggcgaggcctgaggtaggggcttgggaggggcatggtgggaggtttgataaaaccagccctgaccacagagtttcattatttgttcttcctgaaaaaaaaaaaaaaaaaaaaaaggaaagaaaaacgtagattgtcagaggcaagggtcaccggaatgtaggatgagaggggagtcatctcttgattggcacagcctccttcttgttgagctgaattattgagaaaattaactagccagctcccctactccttggggattttgaacgtgccattaacagggagccagagtcttgtcaaaggattggacctcaagttttaaggctgaatgtcctgtcccttgaaactattctataagggctaggctctgcagcctgcaaagcacacgttcctatgtcagaaacctgagcagagcctgcttgtttgcagtggaggttccactgggggttggatcacatcatacttaggtaaacactggaaagaggcggtaggtggctcagcttgattttgcaatgcgctaagttaaccaaaaaaaaaaaaaaaaaaaaaagccctactaaaaccacccaccccaaaatcctccctgcgatcctggttttgtttttcagatttcacagatacccataacaacttgttaagatcttggccccctgacaagttcttctgttgtgctttgaggcctgacagcctgtctccagggagccctggcctgggagaggtgaggcaggattttataggcgcggaccctccagccccagcctggtccgggtttctcaatgagaaacgattttctctgcctctcccaggttacagtcagaggccctggccccaagaatggtatttctggtcagtaacgttttccagctgtgtggcgagttgcattccagcatcctgcagcagagagtgtgtttcccccattgccttgtgttctccttgaattaacttggctcgcccttccccttttccgcagatggcctcgcctcctcccgggtccgcctatacttcttcatctccaacgaaggcaaccagaacctgtttgtggtccaggccagcctgtggctttacctgaaactcctgccctacgtcctggagaagggcagccggcggaaggtgcgggtcaaagtgtacttccaggagcagggccacggtgacaggtggaacatggtggagaagagggtggacctcaagcgcagcggctggcataccttcccactcacggaggccatccaggccttgtttgagcggggcgagcggcgactcaacctagacgtgcagtgtgacagctgccaggagctggccgtggtgccggtgttcgtggacccaggcgaagagtcgcaccggccctttgtggtggtgcaggctcggctgggcgacagcaggcaccgcattcgcaagcgaggcctggagtgcgatggccggaccaacctctgttgcaggcaacagttcttcattgacttccgcctcatcggctggaacgactggatcatagcacccaccggctactacgggaactactgtgagggcagctgcccagcctacctggcaggggtccccggctctgcctcctccttccacacggctgtggtgaaccagtaccgcatgcggggtctgaaccccggcacggtgaactcctgctgcattcccaccaagctgagcaccatgtccatgctgtacttcgatgatgagtacaacatcgtcaagcgggacgtgcccaacatgattgtggaggagtgcggctgcgcctgacagtgcaaggcaggggcacggtggtggggcacggagggcagtcccgggtgggcttcttccagcccccgcgggaacgggggtacacggtgggctgagtacagtcattctgttgggctgtggagatagtgccagggtgcggcctgagatatttttctacagcttcatagagcaaccagtcaaaaccagagcgagaaccctcaactgacatgaaatactttaaaatgcacacgtagccacgcacagccagacgcatcctgccacccacacagcagcctccaggataccagcaaatggatgcggtgacaaatggcagcttagctacaaatgcctgtcagtcggagagaatggggtgagcagccaccattcccaccagctggcccggccactctgaattgcgccttccgagcacacataaaagcacaaagacagagacgcagagagagagagagagccacggagaggaaaagcagatgcaggggtggggagcgcagctcggcggaggctgcgtgtgccccgtggcttttaccaggcctgctctgcctggctcgatgtctgcttcttccccagcctgggatccttcgtgcttcaaggcctggggagcctgtccttccatgcccttgtcgagggaaagagacccagaaaggacacaacccgtcagagacctgggagcaggggcaatgaccgtttgactgtttgtggcttgggcctctgacatgacttatgtgtgtgtgtgtttttggggtggggagggagggagagaagagggggctaaatttgatgctttaactgatctccaacagttgacaggtcatccttgccagttgtataactgaaaaaggacttttctaccaggtatgaccttttaagtgaaaatctgaattgttctaaatggaaagaaaaaaagttgcaatctgtgcccttcattggggacattcctctaggactggtttggggacgggtgggaatgacccctaggcaaggggatgagaccgcaggaggaaatggcggggaggaggcattcttgaactgctgaggatggggggtgtcccctcagcggaggccaagggaggggagcagcctagttggtcttggagagatggggaaggctttcagctgatttgcagaagttgcccatgtgggccccagccatcagggctggccgtggacgtggcccctgcccactcacctgcccgcctgcccgcccgcccgcatagcacttgcagacctgcctgaacgcacatgacatagcacttgccgatctgcgtgtgtccagaagtggcccttggccgagcgccgaactcgctcgccctctagatgtccaagtgccacgtgaactatgcaatttaaagggttgacccacactagacgaaactggactcgtacgactctttttatattttttatacttgaaatgaaatcctttgcttcttttttaagcgaatgattgcttttaatgtttgcactgatttagttgcatgattagtcagaaactgccatttgaaaaaaagttatttttatagcagcaaaaaaaaaaaaaaaagaatacagttaaatgtattatacataattttggaaccaaagaggccaacagatcagttttaattttattagacggtgaggccatctgagatgaggtggacgttctgagcagtcccttgagtggcctgccaacgtttcagggtatgaatggattttgtttattcggtttgatgtgtcttttccatccttacacacccagaaggtagagtaaaaatgactatgatagaatgcaggtgtgtatccttaaatcctcatctttatgtttatttaataaagctccccttagattctgtttcataataatttaaaaccaaacaattttcccatagacttgctgttaaagtattgtacgtttgtgtacagtttaagaaaataaaagattgagtgccacgggcctcctgccttgcgtgatgtctggggcagggaggcctgggctggaggtgggcagctgggaggaaggccagtccaggtgtccaggttggatgccagcagcttccacggcctgctcctggcatctctgcgtccttgccatgagatgtatgtcgggcagagattccaggaaaaatggctgaagatcaaaatgaaggacaattagcaaattcatgaattacacatttgtttatcctgctagtcccaagattgattatgtttcaccaaggccacatccattaccatttgcaagtgctgggtaagcccccgtccccaggtggaaatgtaaaaccctgaaggctgaagtccagctaacctctgctcacctctatttggaggtgactgggacctagaagtggcttggtatcttgggatagaagggtaaacagagtcaggctgtgagtgtacgaaggagcccttcctgagggggttttcccggtggagagtggtggtaggggcggtgtagtaataatggcccactgcgcaggtgtaactgggatacccgccgagtcctgctgttaccatgcagcatcgcatctttgtggaaagtggctttgtctgcatttcccagagtttgaaaatctgaggcttagagagttcagagcctgcctgaggtcagacatccaggacagggaccctggtgtttgagcccacccgtttccttggaggactgcagccctgtgcccttgcctttgtctgaggccctgcagggctgctggggctccgccctggggtttgggtagcatgtggtcttcccagagcacatggcactttagagagcatgtaacctcatcaaggtagtgggaaaccgagggaggcccagacagctagaggggtatagctcaatcagcacagccagctggtggcaggaggcagccttctagccttttctttttccattctttgcccaaccaagggagctactgccctgccaggctttcagcccgaggggaagactggtcatctgtgaagttgtgagacagtattactgtaattcacaggggcaaagaagaaagtgtcataaagacaggtctggcctgtgcatttcaggcagtgagtcacgacgtctctgccctctgctctgcggggggctgggcctagctgctggtggcactaggccctcagcccagccctgcctccccgctgccctgggacttttttcaggtagcggccaggaggtgcgatgtgagccactgagttgcttctgctgtttggacattgagcacctaccaaagcccttctggactgagcatcccaggatggccccatgagtagccccaggaagggcctggggaccccaggggcacaaggccttggggctggctgacctggtccctgagtgactttgctgccctatgctggctcctgtccctgtggggtctggcccccgggggcactggtgggcagcagttcctgttgctgagagaggcagtgaggacaggcactggtctcctgtcccagctgggtgtcccctctccagcagggccctgcagcctcctgtgctgctgtggtcaccgctccccttgctctgcttccccccactcgatgctccagcctctcccgtctgctcttcttatatccccagtggcccggcccaacggccctgcctttctctgaaaatgtccctggagcccagctctgcccccaggtccagttcctctggctggactccccgctgctggacttcaaggtccccagcccttcttccctccagccctccctgcctcttccggcttccaggctgctggcttctcatactcatccccagccccacctgggaccagtgggacaggaagggcctgcctgagccggaaggccgccatccccacccacctcaaatgcctcccccacctatctaccaccatgcctgggatcccaccatgcgggggtcaccctggccttcaaacatgccccaagtcctcagcgactcagtggagcccatggcctgggctggggcactggggtcaggacagcacccacacctgcctcacctctgctccccccatttcccagacaggcggctgaggggctcagtacttggaggctccaactgtatgctctgtctgtgttttctctcccagccctccctcccagggtctggcttagagtggggcacacagggtgccctgtggcgcagcccagaggtggggccagcatttaggaggggctactaggtgtccgagctttatacctgttacctgtgacatggcgtgatactattgcctcgggctttaccagagctccaggccatggtgtccctgcagcctcttgcgctgtggccgggctcctgactcacctggagctcaggccagcccagcatcacgcctgcccagacccgccgcaagggacttgtaggccatcacaacttggagaatcctgcagctgcctagagctcccttgaggaccaagagcgaggataggaatgggggtgggaggtcacaggtggccaccaagccatgaaaactgctgagggcttaagaaagtgtggctttgcaggcaaaaagtagaactcaaacaccgttctgcggggagaggccctgggagcgcccccagccctgtttctaggctttcgatgggagcaaatgacaaattaacggggtaggctttgaaagacctgctgatggtggttggctgtagatgaggcgtggagtgtgagcatggtggctgtgggggctctgtgtcgtgtggggactgtgggcgggcagtcactggtgtgtgaggctgtgcgtgtgtgaggtgggcgttgctgctcatgggtgtggcctgggtatcgtgggtgtgtgagtgttggtgatgcactgttttgtgattgtaggtgttactgtgtatgctgagccacgtggggcttgagactgtgatcgtgggcgtgcgcggttggctgtgagtttgtagtgtacggttggctggccttgaggttgtgaggctgcgtgggtgagtgtgtgagactgtgtgtggggtttgagactgtgattgtaggggtgtggttgcatggctggctgtgtgcgtgtcttgccatgttcgttttcttccttacggagaggtgatgcacctagccagttatgtacgttgtgattggggtagttatcatcttgcagttagaatctgtgatcaccctcaaacccggcagatcctgagaaggtctggtgcaggcactatttctgtggtctgtgcagttgtcctcagtatggtttcacagtacctgatgctctgctctgtctacacagtgtgctaggggtcacctcaaagccagagcactttaaagggagaaaggtaccatctggtcagtcattcagtcactcaacaaacattcccacggtgcctgctgttatgtgcagggcttcatccctcatctcagtgtagtgctcacaacaacctggaggtgggggagcaggtatcattatccccattgtgtaaatgagaaaacaaaggccgagagcaaggcagccgttcactgaaggttgcgcagctctaggacttgtccccagccagctgtttccagagtcactcacagcccccgggctgcccaggaggagggataaggggaggggcagctgttctggggtctacctggaagacaggggaggctgcggtcccgggtgttctcagcgttcttttgggaggggcctgctccccaactcctgcccttggctctggcctcaggcatcagtggcaactgtgcactgagacgttcttctctgcggctgtggggaagccaaacacccagccgtccatgcaccatctctggccaggtggatgagatggctgctgcacccagggttggggggtgggggctgaacaactgtcattgtgactagtcactgggagcatgggctgtgggtcggcctccctggctttgcgatcgtagcctggtccagcctctcagagtcatcctctgtaaaatggagcaatgacagtgcctaccttaagggggttgttagcattcacctggttagaagggccatgctcttgagttgttttgctgttttctggcacattctctgtgtcaggaatagtgctgggtgcccagccagagccctgcccttcctctgagaggccctctttcattctcagctattcattcaatgaatattcacagaggtgcagcgatgatgatgttgactaccatttattgtttactgtggtcagatacagcgctttgcagcagctttgtagttaatctctataatctccctcttgggcaggtgagatgtacccattttactgatgaggaagttgaggctcagggaagttgagtatcttgcttgaggcctcatagctattcgaggggaagacccgggcctggctcttcttgagctcgcaacccagttttgaggccactgggaaagtcacgtacccagaggggagccaccctaggccctcagaggagcaggccctccagatactgccttctctcccttcaatgtttccaagaaactcgtggttccctgaaccctgggggacttggggtaggagagagagctgctgtcatggcagaggggacctgggagctgctggggttgccctggggggagcctttcagagcccctcagctgccctgcagctctcctcctaccccatccccataggggcccctgagggtctggctaccttcagaatcaggtgtgcacacctgcaggtcccaccaggtgagaatggccattctgccagcaggaagagggaactgtctgaggtcatggcagacctgcagggaatctgatgagggtgaggaccctctgagtgtctgagaaaaacactgaccacattttcaagtgggatttcagggaagggtttttggactacttgggatacataaccatgtgtggggaggagtaggggagtggggcggagacaggcattgtggaatgaaccaactactccctcccagggaggagcttctcgtgaccttctctcctctgggggaggggctgccagggtggggacagcggtcttcgctcgggaggcagaggcagatgggcagctggacgtgccaggctgcctgcgcctcccctcctgtgcagagcagggtcttgttctgccctcttttcttctggcgtctcatctccctctttccttataccttccatcccacctctgctcccggggtctgctctgcccagccccagggacagaggtgaggcatggggtggggtgggtttcccagtgccagttccagcccttgcctggaatgatgggggcttggtttgcctgctcagccccctccccacctcttcctgtggggtctgtgtgtggagcacaagtcaggccccagggtccccaggggccagggtcaggcagggagggagactcttcctggccaccctgggcacctgtgtgtgtgtgtgtgtgtgtgtgtgtgtgtgtgtgtgtgtcagtgggtgtgtgtgtgtgtgtggatctggaggattctcctaggcagctcccggtctcatggaaacagcgctggctcttcttgagctcacaacccagttttgaggccaatgggaaagtcacatacccagtggggaaccactccaggccctcagaaaagcgttgtgagcttgtccagccttcgaggggctttctgggtgtcctctcactcctcacaggaaccacagaagggagataagttagaactattatccacatttgcatgggaagctcctggcgggcgactctcctggcagggccgcagagcttaaccccactctgcgacagctctccctgcctgggaggggccctgagtggccttgctcttctagggaggggtttcagtgaccctctcagcacaaatagcctgacccccagccctcaaccgtgatggcctgaagttgtagaaaccggttcttttgggaaccttactccttcacctgctttacttgctttactcctgggaaggatgatgcctcagacgctttttaggcaagtcgtgcctattagaatggctgggaatgggagcgtggaaggggcacagcccaggtcctgctctgggctgcactgcagctgggggatcgcagaagatccttttccaaaacatgcctgtggcattctcctgccccttccgggtcatgctgtcagtgaccctgtccctctcatccatgcacctgggaagaaggagtctgatgtcccctgggctgcccacggcccccggccctgcttacctccccacttggagctggtggatccctcctcctgaaaaccaggcttgggcatcgggtcccacccacagctcaccatcctccacctctgcacctttcaaatgcccttcctttccctgaactcctttcccccacctttgcttggctgattgtgatttatccttcagggctctgggctagaagccctgactcccacagctcgtggaacccgtctcctgtcttgcctgcaagatcacttgcggtgtgcacacccgctcccctgagagtctgcaggcctggattttaggggagctagagtctgtgttgctcaccacaccagtctcctgagactggggcagatgaagtgctcaatacaaattttaaaaatttgtttctgcttttatagttttaaagtcttagatctttttgtattactttagatctggggttggggggtgcgagacacgtgcagatttgttccatgggcgtttgcaggtagtgagtgtggtcaccaataggcagtttttcagcccactcccccacaccgccccctgctcccccgacgctggtcatcctcagtgtgtgttgttctgtgtttatgtccatgtcaatacacacttattcaatgaacgaaggcacatccatctcagggtgagaagttaacacccctcacccattttcctgctggagcaactgaggctgagggggtcagcaggacccagggagaggctcagccctggctaagaccaaagccagcactctcgaccacgcctttgctatttttctttcttttaggagcacctcatgccccgcaggtgattcatgtaatagcattttcaaaagcctataatttgcgccagcgtttgcgcttcatggtgaagctcagcctcatccgtgccgcaggcaaaggcaatgccaatccaaacgggtggcaagctgggcccgggcaccagggaagatcagccttcccgcttcctccctgcacctcaaggaaggcagcccttcccgccggcatcttccaccttcaggagagtgtggtttgtcacccgagggtgtctcatagaagctcagcttaattaatcaatcgccgactgatgcattggttaacgcggggccccactcccccgtgaatgatgggcgcattaatgaatgccaattatttcagcattaataattaatctccaaccatgccggagaaggagtggaaagtacacaagcctcgagtcagctccacgagccagcctgccaccccgtgctgctcaccgccttgcccagagtatctgagcggggcctctttgctactgcggggcgaaaaagcaccttggactgggcgtccggggcctggactctggttaggagcaaggctgtgagctccatgggggcaggggctgggcctgcttgtgcattgctctatgccagcactgggatcagtagctggcacacagcaggtgctcaagagatgcttgctggtggctggctgtacccaggccctgcccctcagtggttgtgtgatctcaggcaagtttttcaccctctctggcctatagttttctcgtttgaaaagtgagtgggttggactagagggttcatttatttgttcattcatttctctagtaggcacagagtctgttccctacacagaaggcagcatccctttccctctgaggacagttatctgcagcccataaggatttgtgctgtggctgctggtcattcctgtaggagaggctgggcttctgccggcctgggagggcatcaggagtggccagttgtcctgagctggcatcatgtcaacttcaggtcccaggcgagacctcggtgtgctcactggcccgcacctacaggattatgctgtgggccttggtggctggggtggtgactccagccatggtggtgggacagactgttggcttccacacagcatttcccctcttctgagctccagtccaggatggtccctcactgcccagggcctggcacctgtcccaggtaggtagggggtggtggccagcacagcgagatttggaaagggtggtggtctcgccagcaggggggctcttctgggtaaaagtttaaaaagaaagcttctgtcctgtcatcgatgagttgtgggaaggcagacactccgaggtttagtggctttgggggtggggtgaaagtggaagacctttcacaggctggttagatctgagaactatggagaagcccatctcacctcttttctctaggtggggaaactgaggcccagagaggagacttgcctgagggcccacagctaacgggcacaggactacggggcccctcctaagcagaggcggaacccccaggtgtcatcctcacctggcatgtggtccacatgagtgtgaacttggctctagaggatgagaggtggtcaccaggagggcttcctgggggaaataggcctctgctggatgaccttcaggcaccttcctgcagggtctgtcccgggcccgggctccctgctcctgggcctgctctatggcttcccaagagggtgcacaggccagggtctaagagggtgggtctgcccatggaccagacatggctctgcagaccccaccctgtcctagctgtgggccttaaggctggtgacttaacttttctgtgcctgagttcgctcatcatacaatggagctaaaaatagtattcacctcctgggtttgttgttcagattagatgaactaataatacccacagctactactgagtcagtgctcaccatgtgccaagaatctttctaagctctttacgtgttttaatccacctgacccacacagctctgggagctgttggcatttctgttccacagatgaagaaactcaggtgcacacagaggaagcgacttgcccagggtcacacagcatggcagggaggggctagaattaaatcccctgcgtcctgggtcacatgctgagtccccagccctggtctttggggtctgtaccctgctgaccttgtgaggtgggctcgccccagggagggagggggtgcaccctctctctcctcccgcctgtcctctcagggccaccagagtgactgtgatcctccttccaggacaaagctgagacagggctccggagttgttttaggaaatagtgaagcaagccgacagcactgattcctccggagttcatgtcatcttattccctatctttggcccaaagatccttctgcatcagcgggtgcgcatggattctgtctgccgacaccagagccgcagagccagacacagattggtgagcagtgcttatgcgttgaaggcactcaggttccatcatggaaccaggtcgcccgaggatgctgaccccatggaggcaatcaggctgcagagagctcgaggaacgcctgtccctgtgagctgctcagggacctaagctctcagagtgtcactgccgttgattctggaacagagtttgcaggccaagtccacaagctaagaatagttttttacatttttaaatggttaaaaacaaatcaaaagaagaagaatattgcatgatgtgaaaatgatatgacattcaaactaaatgcctatacatacagttttattgggatgcagtgacctcattcatttatacgttagttaggacagggacccatatggcctgcaaggcctttagggactttggctgaccctttgcagaagaagtttgctggccactgatccagaggcttccttggctggcagatgtcccagcagaccaccactgctccccttctgtcctcctcctgggactctctcctgggtggccatgctgcttccatgaccctcctcagctgacgggttcacctgtggccctgaccaagaccatcacagtttcctgaacatcaaaatgcattatcagtgagtctgttgaagacatttagagagtgaggatctggaaggctgagggtggcactctgtgattcttcagagcccttctcatgcccagcacaggacaggactaaataaataagggaaacagatgggcattaagaccagcaataccggccgggcactgtggcttatgcctgtaatcccagcactttgggatgccgaggcgggaggatcacgaggtcaagagatcgagaccatcctggctaacatagtgaaaccccatctctactaaaaatacaaaaaattagcctggcgtggtggcaggcgcctgtagtcccagctactcgggaggctgaggcaggagaatggcgtgaacccgggaggcagagcttacagtgagccgagatagggccactgcgctccagcctgggcgacagagcaagattccgtctcagaacaaacaaacaaacaaacaaagaccagcaataccaccttacaccccttagggttggctactatcaaaaacatagacagtaacaactgttggtgaggatgtggagaaattgggacccttctgccttgctggtgggagtgcaaaatggtacagtccttgtggaaaacagtatggaagttcctcaaaaaattaaaaaaggtattactatgtgatccggcaattccacttctaggtatatatccccccaaaactgaaagaagagccttggagagagatttgtacgctgatgtgcgtagcagcattcttcacgtaaccaaaaggtagaagcaacacctttgaacacagtgtccctcagcaggtgaacgaataaacaaacgtggcatctccatacaacagaatatgattccgccttcaaatggaaggcattctgtcaactgctacaacatgcatgacccctgaggacattatattgagtgaaacaagccagtcacaaaaaggcaaactgcatgattccacttgtgtaaggaagtcaacgtggagtagtgagattcacagagatgcaaagtagaatgacggttgccgggggtgtgggcaggggaatgcagagttgattttaatggtacagaatttcagttttgggaacatgaaaaaattctgaagcaagatggtggtgatggttgcacgacgatgtaaatgtgtttaatgcaactgaagaatacactcagaaatggttaagatggtaaattttatgttaggtatgttttaccacaactaaaaattttaaaaacaccataaaacgcagcagcagaagcgccttcccccgcgggcagccccgtctccagcctcactggcggccgccatccatgtcctctagccccacggtcctcatcccttctccagggtggggtgctccagagctccctcaccttccccagcccatgaggttcctctgtgagtgagtgggtgtgtgtgacctcttccctgagatgccaggcctcacctgaggcagagctggaggcaggtgtcataaccaccccagaaaccttaaaaacggtgcccaggatggtccctgagagagtaggctgcctcaggagcctctccagaaaaggttgacatgctcagctatgatgttaggccctggcctaaggctgggccacctcaaagagcagtctggccagctcacctggttgggtacagtcctcaggactcagagactcacgtgggccacatctagaatggccaccacctttcccttgcaggcccacagcgagtgtgaagcaggactttgagcgtgttctcttggccacgcatggaacaggcactctctcatctcatttcattcttacacagctgttcagtgagacctgggcaccatgagtgcctgcccagccttggattgctgccaggcttcagaccgaggggcttggggggatctggacaggtctggagcctggggccttgccaattggggctctgagacccaagggctgatgtgggggtcaggagggcaccagggcctgccaggaacacttggcttttttccctaaatgtttttctgaaactgctctgcttgggccttgcatgtcggccctttgtaactgatgggtagaacccagaggagagggcagtgcccaggccagagccggtagctgcaggaacatcagtggacacacacggcaggggtgcccaggtgagtggggaataggacgagaactgtggtcctctcaggggctggtgactgaggggtcctgtgtgctagacaaagccatgacgcgtgtctgaaacatcttccatcacatgttcacagttctttgtagggcgcccaagaggttattgcgggagcccagtgttctgggggtgggggtatctgagaggtcttcctggaagaggtggtccctgagccaaatcttgcaggacagatgggagttggtcagaaaagaagggcagagggaaaggtattttcggaagtggacacagctgcggcaaaggcccagagcatgtggccttgacctgcagtgccccccactccccaaatgtccccccaagccaggcctctgggaggtgcctgtgctgcccctgcccctcatacctgcttcacgacacatcccctcctcccactctcccacctcaaggccttgggaagcgtctgaaacctcatttgcaaggcccttcagcggatgaattgaatgtgagcatctgtttaaagggacactcacattttcatttttaaataagaatatcattcattggtggcttcactatcatgattgtaaggcatatccatggagagaattaggaaaacccaggaaagtaaaaggaaacaaaaaatcacccataatcccagcaaccataaggtgcccacagttaacatgttggtgaatttgcacacgtgtgcgactgccgtacgtgactgtgtgtgcgctgctacgcttgtcttctccatataatattacagtatgagcgctgcccctgtgccgtcattcttcaaaaagagcattttggtggctgtcttttaatttaggaccctttctccttattgttggatatttaggatatttccagtttttgcccttgataaacaacgctgcagtgaccatctttgtcaattgcaccattgatgggtatgcttgctgaccgccaggaatggtactataatggtgaggagaggtgcctggacaagcaggctggagattttcaagcttgactgtgacacagaagccctgggtgtcttgctaaagcagattaaggctttgtgggtctgggctgggctggagagaacatttctaacaagctcccaggggaagcagagatgctgggagaaccatactttgagtagtgtgacctctttgaaaagtcttccctgaggtgaccaccaactggggtgtgggctctggggagagacttgccggtcaggacttctgtgccctgggcacttggaaagtgcaaaccactggggcttacctgagggcaccaggcagtttgcagccaattggctctgccctgagccctgcaatggctctctcagagctgcacggaggtccctgactctcagccgtccttgggggtccctgagacttctgtgcggccagcctcattctggcttcaagccgtggtctgcaacacagaggttggccagccagggtcactcttctctagccccttggtcccccctgtgcctctgtgccttggcctgctctgtggctgccgggggctacggggactccttcctctgctaagggttgctcttctgtgacagaggtgcctcttttttcccatcagcaaagtgggctaataatagctcccacgtcacaggaacagtgtgtagattgacaaggcgatccgagggtggcgggtggcccgtggcagcactcagcactgtggactcttattcccatgagcagtgagcaggtggccaagggggctgggacaggcagagctgactccagtgctggcttcccatttgtgacttcgtgtctgtgttcatctgtgagaccctctgttcattccacagctccttactgaatgtctacaaggtgtccgttctgtagtagggactgggtccatagtggctgatgaagcagacatagttcctgttcttacagagctcattatctagtgagagtgacagatacggacaagtaaatcgacgctgcagtcagggaggcctgcttcagatggggtagtggggaacgccgagcttcagagggaacaattcagctgagtgctaaagaaggagctgattatagaagtggctgtgtcagggtgggctgggtcaggcattccagacagaggggacagcatgtgcaaaggccctgaggtagtaaagggcttctctagtggagaaactgcagaagcctggtagagtcaagctggggtgatctaggagaggacacaactgtcacaggtcacaggggcagcggcctttgtggggaggaacactgaggggactttggcaagggtgtgggaatctgacttattctttcaagggatcccctggctgctgtgtagggaatggaccttggcagggggagagaggggcagcgagcccagccagaggctcctgcaatgtccaggtggtgtggagatgtgcagaagagcccagacttagctggactccaaagacagacaggcagggcagcgaggggcaggcaggctcagggccacatagctgtgggctgtgctatggaggggcgatagggaggtccaagcaggagactgaccagggtctctggggcaggccagaactgaatggctaacctccaagggctgaatgtgggaggctgtgttgctgccctccagggtgacatgtgggacctacctgcacagccctgaccttccctgcccaggctgccctggagccatgccacagaatcagctggggctctttgtctttgccgtcttaggcctcttgtccttggggctgggagatgggggacagtctccattaggtcatgaagtgggtttacaggtcttgtcccattgcttcctccccatggcctcatttctcatgaaagaggatacagagccgtctatgggccagaactcccggacacctgcggggctagttcccatgagtggaggctggcatgtgcgtgtgtgcatgctcatgtgtgtatgcgtgtgtgcatgtgtgtgtgtgcacgcttgtgtgtgtatgcgtgtgtgcatgtgtgtgtgcatgtgtgtgtgtgcacgcttgtgtgtgtatgcgtgtgtgcatgggtgtgtgtgtgtaggaggatgctctgggggatgctgcatggggtggggcaagccgcatgctgggagtgagctggctgaagctcatccttcccagatgagggccccacaggcgtcagcacagcctccaaactcacacaatgatgagagccattggatttcccatgctcaggctatggttaaggggctgaagtctgcctgccagcagcctgggtcaccaggggaatgggatgggcagggggagccatgagtcaatgaagtggggaatttgtagaaactgtgcatgggggtcggggggaggttctagatgcaagcagactgggaaactggcagttctggccaagcgtcctgaaggtctgaagggcagggagtccccatgccctacctgagcaaatgggcccagtcccatgggttgcctcgggggtggtgttctccgagccactctcctgcatcttgtgggctgcctggcaagaatgtcggcaggtgacaatgggtggggagggagatggctgtcaagaggaggtccaccttgctggctcccagattctcagaaggctttgcaaacgcccctgttcctgggatcgcatcactgaagtctcaggaggtatgcaagggccgaatcttacttactctaaccttttcactggctgccagtgaaaggaggtccggagacactgcttacttccccaaggtcacacagtgactaggagacaagcaagagtaaactcagccaacaaatgcaaggacgctcaatgaaccaggggcctctggaatctctcctccctctctccctccctgtcttccttcctctctccttccttccttgtcactcaagaaaaatttatttgactatcacccaaggccggctgtgccctcagaaattcctagcccatgatactctcttcctgggggtggggggccctccgccctcaggagggcttgtgggttaactgttgtgatgagctatttccaaggtaggaaaagagaaactagatcattgagccctggggaagggctgtggttggcacagaaaatgacagatcccgtcagcaggcaggcggggccaggggctcctccccatggctgggattgggggctggtcctggggggtttgtagggtcccagggacaggagcagggcttgtcctcagaacctaattcctgagcatgtgagctcagacaggtcctgcataggacccaaggcatctgcggtctgaggaccatgcactccagctttcatgttctgcctgtctgtctgtctgtcagtgtgtctgtcaggctgcatgtctgccttgcttatctgggccctgaatcacctcatatcaaaatgttgcccgattcctagaacacagctgggcatcagggggtgggcctgagtcatttctgccttgtggacctgcctgccctgtgaacccaggaggcactgaaggcctgaatggtgcagccccatggccacctagaagcctgaggggattcagggtctgtttcagccttaaaagagtatagataagggcccggagggctttcagggtgagggaagagtcggggaggaacagccagggtggacactcgggaggagaacccatgccaggcagtggctgggtgaggggaagagggaggagggtggagggaggctggaggggtggccaaggggatgagttgagtgttggagtgtgagaacccagcatggcgcttaaaggtgtgggccccagcgccagctgcctgggtttcaatcccgtctcctccatttcccaggctgtgtgtctttgggcaagtgacgccccctcttttagtctcagtttccttatctgtgaaatgggatataagtagcagtgttggccgcttcgggttgtggtgagcattcaatgagataatgcatataaagggacttggtgcataataaatgcccaataaatgttagcaagcttcgacatcaccatcatcatagtcacggtctccatcatcgtcattgtccttgtcattgtgatcagaagagatggaaatgggcctggcacccagacactcaggagagaggtcctggatggaaggagggaactggaagctttctgcacactgggagcatataggtgggagtgcaggcgaggagtgtctaaaacttacaacttcatcccctactcctccctcaccctgaagcctttgggccctgaggtcacctggggtgactgtgtgcagaggagcagaggcaaggctgaggaagagactccccagaaggtgaacacgtaagggtcaggtggattgacaggaggccagaaagggtggtgtacaactgaagagtcttgtgcccacctccccagctccaatgccaggctttatgagtccacagctgctttgtttttcaattacaacagagaaattgaaatataattcacatcccatccaattcacttatctaagtgtacaattcaatggtttttaatatgttcagagttgtgcaatcatcaccacaatttcagaacatttttgtcacccatgttcatcagcagccactcccttctcccgacccctcagcaacctccacacccccaggcaaccactcgtttattttctgtcgctgtagatttgtctcttctggacattttatggaaatgcaatcatacaatgtgtggccttttgtgtctggcttctttcacttggcatggcgtgttcaaggttcatccatgttgcagcaggtattaggccttcatttctttttacagctaaatcatattcccttgtgtggatagaccacgttttgtgtatccactcattcattgctggacatttaggttatttctactttttttgctattttgaagaatgctgcgtgagtattcatgtataagttttcgtgtgaacgtttgttttccattctcttggacatacacctaagagtggaattgccaggtcatatggtaactctatgtttaactttttgaggagccacctaactggtttccaaagtggctgtaccattttgcatctccaccagcaaagcacaaggatcccaatttctccacattttcttcaacgcactcattagaatctttctttctgatgatagtcatcctagtgggtatgcagtggtacctcatggtgtttttgatttgcattctcctggaggctggcgatgttgttcattcttcctgtgcttcttggccacttgtatattttctttggagaaatgtctattcagatcatttgcccatttttaagttagattatttgtctttttattaccaagatgtaagaggtctttatatagtctgatgacaagtcccttatcagaggtataatttgcaaatgctttctccccttctgctttttttcctgcttttttgataatgttctttgatgcatgaatgttttaaatttgtgtaaaatgcaatttatctgttttcttttgttcttttgttgcttgtgctactggtgtcatatctaagaacccattgcctaatccaaagtcatgaatatttatatgtatgttttcttttttctttttttttgagatggagtctcgctctgtcacccaggctggagtgcagtgatgcaatgttggctcactgcaacctctgcctcccaggttcaagcgattttcctgcctcagcctcccgagaggcaggtgccaccacgcccggctaattttttgtgtttttaatagagatggggcttcaccgtggtagccaggatggtctcaatctcctgaccttgggatccacccaccttggcctcctaaagtgctgggattacaggtgtgagccactgcgccaggcctatatgtgttttcttataagagttttatagtttagttctcacatttaggtctttggcttgattttcctatccagcttcattcttttgcatgtggatagtcacttgccccagtaccatttgttcaaaagacaattctttctccattgaattatcttggcacagtttaaaaaaattagttgactggaaatgcgaaggtttatttctgaactttcaacttattccattgctctatatatctatccttgtgctggtaacaaactctcttaattgctgtagttttgtagtaagttttgaaatcaggaattgtgaaccctctaattttgttttggttattctagagtctttaaatatctgtgtgaatttcaggattagcctattactttttgcaaagatgccagctggaattttaatggagattacattgaatgtgcagaacaatctggggagtattgtcatctcatccatgaacataggatgtatttctatttgtttacatcgtcctttatgtcttttaacacatttttgtagttttcagggtatgatttttgtaatgttttggttaaatttattcataagtatactttgataccattgtaaatggaatgttttaaaatgtttattttcatattgttcattgcaagtgcatagaaatagaatagatttttgtggattgctcttgtattctacaaccttgctgaactcatttattagttctaatagatttttagtggattccttagaattttctatatacaagattatgtcagctgcaaatagagacagttttacttcttcttttccaaattggatgcctttattttaggcatgtctaagggccctggccggaaccttcagcacatccacttttgcacagaaaaggggcccacactccatctgtccacagattctagagcttctccactcagcttctggggccctcactcaattccctcccttttattgccgacctgtactggtgcctcctcacttcccttgactccaatgccatcctctgttttcccagaccctgtttcctcccaccccccagaatgcccctcttggttcaacccagctcctgcacccttccaccccaatcgtgccattgagggcagttacttcctcctcacttcccctggtgtggctggacagggctgctggtcaggaggcatgtagtcatgttggaaggcagcagtcccagagccaggaaaggggttaaggccatcacaaagttcagcaagaggcgggctctgtgtgggtctggggccaccagaactcgttgctcagaggtccccagtgctgggagcaggaggtaagtcctgaaatcagtagggcaggggtgagactgctgccagctggtcctgatggtgacccatgaggcaggcaggagtgaagcctccaccagcagaccgctgcctccccgtgtgggggaagcctggcccagcaggctgagaaccgcgcaggtaagctctggggactccccaggccaggagggcagccaggaggttggagatcagcaagagtcccaggttagaatgaagcaaataacccctgaaactaaatggggagaaatgcagtgttgcgctttgcagcttccagttctcaggcgaggtcagtgctttgagagaaagcaggagagagggaggtgaccaacgggagccagccagcggtcagcaagcacgaaccaagtggcctgactcgtgtttgctttcttcatgggttagcatggggacggccacggtgcggaggctgcgaggtgctttaggcaggacatgataaattatcctaaggcagccttgtgaacttgatggagaaacaaggagggtgagggactcagtttaaagatggtggcttcctttttttttttttttttttaatcagagaattc

SEQ ID NO: 113 - protein, 2700 aa, Homo sapiens
MLLDPKNARPGQKAVLLSPVSLSSGCLSFSFHYILRGQSPGAALHIYASVLGSIRKHTLFSGQPGPNWQAVSVNYTAVGRIQFAVVGVFGKTPEPAVAVDATSIAPCGEGFPQCDFEDNAHPFCDWVQTSGDGGHWALGHKNGPVHGMGPAGGFPNADVLTQCDFEDDAKPLCDWSQVSADDEDWVRASGPSPTGSTGAPGGYPNGEGSYLHMESNSFHRGGVARLLSPDLWEQGPLCVHFAHHMFGLSWGAQLRLLLLSGEEGRRPDVLWKHWNTQRPSWMLTTVTVPAGFTLPTRLMFEGTRGSTAYLDIALDALSIRRGSCNRGGHYIYLEADEFSHAGQSVRLVSRPFCAPGDICVEFAYHMYGLGEGTMLELLLGSPAGSPPIPLWKRVGSQRPYWQNTSVTVPSGHQQPMQLIFKGIQGSNTASVVAMGFILINPGTCPVKVLPELPPVSPVSSTGPSETTGLTENPTISTKKPTVSIEKPSVTTEKPTVPKEKPTIPTEKPTISTEKPTIPSEKPNMPSEKPTIPSEKPTILTEKPTIPSEKPTIPSEKPTISTEKPTVPTEEPTTPTEETTTYMEEPVIPTEKPSIPTEKPSIPTEKPTISMEETIISTEKPTICPEKPTIPTEKPTIPTEKSTISPEKPTTPTEKPTIPTEKPTISTEKPTIPTEKPTISPEKLTIPTEKLTIPTEKPTIPTEKPTISTEEPTTPTEETTISTEKPSIPMEKPTLPTEETTTSVEETTISTEKLTIPMEKPTISTEKPTIPTEKPTISPEKLTIPTEKLTIPTEKPTIPIEETTISTEKLTIPTEKPTISPEKPTISTEKPTIPTEKPTIPTEETTISTEKLTIPTEKPTISPEKLTIPTEKPTISTEKPTIPTEKLTIPTEKPTIPTEKPTIPTEKLTALRPPHPSPTATGLAALVMSPHAPSTPMTSVILGTTTTSRSSTGMSCPPNARYESCACPASCKSPRPSCGPLCREGCVCNPGFLFSDNHCIQASSCNCCYNNDYYEPGAKWFTPNCTEHCRCWPGSRVECQISQCGTHTVCQLKNGQYGCHPYAGTATCLVYGDPHYVTFDGRHFGFMGKCTYILAQPCGNSTDPFFRVTAKNEEQGQEGVSCLSKVYVTLPESTVTLLKGRRTLVGGQQVTLPAIPSKGVFLGASGRFVELQTEFGLRVRWDGDQQLYVTVSSTYSGKLCGLCGNYDGNSDNDHLKLDGSPAGDKEELGNSWQTDQDEDQECQKYQVVNSPSCDSSLQSSMSGPGFCGRLVDTHGPFETCLLHVKAASFFDSCMLDMCGFQGLQHLLCTHMSTMTTTCQDAGHAVKPWREPHFCRELSMACPPNSKYSLCAKPCPDTCHSGFSGMFCSDRCVEACECNPGFVLSGLECIPRSQCGCLHPAGSYFKVGERWYKPGCKELCVCESNNRIRCQPWRCRAQEFCGQQDGIYGCHAQGAATCTASGDPHYLTFDGALHHFMGTCTYVLTRPCWSRSQDSYFVVSATNENRGGILEVSYIKAVHVTVFDLSISLLRGCKVMLNGHRVALPVWLAQGRVTIRLSSNLVLLYTNFGLQVRYDGSHLVELTVPSSYGGQLCGLCGEFPGHLRGKAGTMSTRVTGNYNNNSLDDNLRPDRKLAGDSMQLGAAWKLPESSEPGCFLVGGKPSSCQENSMADAWNKNCAILINPQGPFSQCHQVVPPQSSFASCVHGQCGTKGDTTALCRSLQAYASLCAQAGQAPAWRNRTFCRECPPGSSYSPCSSPCPDTCSSINNPRDCPKALPCAESCECQKGHILSGTSCVPLGQCGCTDPAGSYHPVGERWYTENTCTRLCTCSVHNNITCFQSTCKPNQICWALDGLLHCRASGVGVCQLPGESHYVSFDGSNHSIPDACTLVLVKVCHPAMALPLFKISAKHEKEEGGTEAFRLHEVYIDMYDAQVTLQKGHRVLINSKQVTLPAISQIPGVSVKSSSIYTIVNIKIGVQVKFDGNHLLEIEIPTTYYGKVCGMCGNFNDEEEDELMMPSDEKLANSDSEFVNSWKDKDIDPSCQSLPVDEQQIPAEQQENPSGNCRAADLRRAREKCEAALRAPVWAQCASRIDLTPFLVDCANTLCEFGGLYQALCQALQAFGATCQSQGLKPPLWRNSSFCHECALLSPQTPPKPPFPLCFPESSLTLLPVPLECPAYSSYTNCLPSCSPSCWDLDGRCEGAKVPSACAEGCICQPGYVLSEDKCVPRSQCGCKDAHGGSIPLGKSWVSSGCTEKCVCTGGAIQCGDFRCPSGSHCQLTSDNSNSNCVSDKSEQCSVYGDPRYLTFDGFSYRLQGRMTYVLIKTVDVLPEGVEPLLVEGRNKMDPPRSSIFLQEVITTVYGYKVQLQAGLELVVNNQKMAVPYRPNEHLRVTLRGQRLYLVTDFELVVSFGGRKNAVISLPSMYEGLVSGLCGNYDKNRKNDMMLPSGALTQNLNTFGNSWEVKTEDALLRFPRAIPAEEEGQGAELGLRTGLQVSECSPEQLASNSTQACRVLADPQAPFAACHQTVPPEPFQEHCVLDLCSAQDPREQEELRCQVLSGYAILCQEAGAALAGWRDRTLCAMECPAGTIYQSCMTPCPASCANLADPGDCEGPCVEGCADPRLCLQWHPEPPLADCGCTSNGIYYQVRAGSRRPWGAEAPRRARPGMELERLLLALPFLAGQQFLTEDCSQRCTCASSRI

SEQ ID NO: 114 - DNA, 6714 bp, Homo sapiens
cctgtagaagaaaaaagaaattctgaaaaagaagtatcaagtcacttcagtcatttcaagatttcttcacagactcatgaatctgataaaacagaagtccaggggattcaatctccagatgttccagagcagttttcagatattaatttaagcaaatctcttcctcaagaacagaagccacttgaaattaaaccagcaccttttgtgaggagccgattcaaaagaccaaaaccaaactaagcaagagcagctttgaagagagagactacagaatcagaaaaatatatatatgagaagaaatcagaaaccaagaaaatggagactattgtgatgcaagaaaataatgaacaaactgatactctcccttctcaacatgatgaagcttccctaatgatatcaagagaaaaagacacattaggtcacaggaatgaggaggctgtgatattgccatgtacacagactgaaaggaacctttcaccttcaaattcttgtgaacctaaagaggagtctcagtcagcaccagtccagaaaaatgactcagttgtttctgtggggactaataatgtaaacactttccagcaagaaatgaaggaaagtgttatccaaactgctcgacaagtaaggggccgacttcagagaccgagaccaaatataagaaagacaggacagaggcaaatagtagacaaaggtgaagccaaaggcataattaaggaaggaagaacgatattaccaaaagatgaaactgaaaagaaagtcttaactgtgtcaaattctcaaattgaaactgaaattgaagttccatcgtccgcagttccagaacacagaatgtatgaaaatcaaagtcaggtggttcttgtagaaaaccttcatgttaacaaaacaaatgaaacaatcagacatgaaaataaaccgtatgttcctagttcagcacaaatgacaagaaggaaattccaaaaggctaagccaaatttgggaagagcacacagtaagaaagaggaaccagttttagaaaaagtcacaacagatcagagcaaggaaggcaagccagaagatcatttgctgcagaaaggagcttccaacacccagctccttctaaaagaaaaagctgagcttctgacatctctggaggtttcagcaagaaaagattgtgtaggttccaaagagtctgctttggcaaaaatagatgcggaattagaagaagttggaccatcaagaagggttggagaggaaactgtaggagataattcaccatcttcagttgttgaagagcaatatctcaataaactaacaagctgtccacaaccgttaaacgaaacaagttactctaaaattgccctggatgggaaaacaactatctcttctacatctgagtatgagagaaatcgtggtgaaaggagaagtcataaaaagttcaaaccaaatgtcaccagaggtcgtggatcaaaacgagttcggggtaagacctctaagaaggaacctagagcttccaaggccatgctggtgactcttcgggcttcccaggaagaagatgatgatgctgacgattttgagtctgactatgaggaagaaagctatcatcttgctcccgaagaagtaaacaaagctccagtatttgtacctgttggtctcagatctcctgaacctgtttctgctcagattgaggaaacaatggaagagcttgaaataactgtgaatgtcccagatgtaggatgcatagctgttgttgaacatgagctaccaaacacagatgtgactactgaagaaatgaaacaagaagaaaatttgagtgtaccgtttgaaatgaccacaagtgaacatatccaagatgaaccaggtaccaatgatggaagcaccgaagctgcaataactttacttacaatgggagatctagtattgcagtcagagatcagtagtgaacagggtgatgtaggagtatgtataattcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaacctcggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagagtatacaccaacaagtattccagaagtccaacaagagaatataatcaatcctcaagacctaacagtgaatctagttgctaatgtacctcaagatggagaagatgaacaagcctttattttaactctggtggaaatcccagccaatgcagtagaagaatttactgatgccactgcacagttcatgccaaaccctttactgccagctcccatattggtcaaatcagtgaataccgaagaaaggggtgacatgagtatttgtttaccagcaacttcagttggtcaagatgccatgggtttatctatttctggaagagataattctaaaaagccgcctgataatttggatcttgtatctaggaagagatttcaatgcaggcttgataaaaatgaccacattcctcctgccaaaaaacgttcactcactttaagagatgactgtcaagaatataccactgaggtgcactcaaaggaattaacaaatgtttttgaggaaacaggggagtctcacaagggacaagatatttttcttacctcaggaagcacactgacaactccagaacctcaaagacagcaagttgaagcagcttttcagagtagaggatctagatctcctgatgcatgcatggacaagaatgtgcctcagttacctcaggatgaaatgattgtgtctgataaggaagaaagaactgatgctgctcctaagtctcagcaaatggatagcagaacatcgtcttctaaagcctcactatccagacctggcagaagacccctgggatttttatctttaatatgctcaaagaatagtttggagtctgatgaacctatgcaagtccatagtaagaaacgcctaaaacctcttatacctggattaagaaagaaattgaaaagatctaatccattcaatgaaagccaggaaaaaaatcgagagtcctctgatctgcttccatctccaagtgttattactactcaatctgagaatattagcagctcagcaactcaggtttcttgtgatcagcccttactgaaagaaggatataaaagtgcccaaaagcgggcccctcaaggggaggcaaccacagtctctgaatatttcttcaatgatatcttcattgaagtggatgaaacagaataaaacaatcttttctctttttcttttttaaattaggtctaggatttccagagtcaattacatcaacaaaacagtatttagagcaaaatatcactgtcttatttttctttaggttgattttgaatacttaatgagcttgatttgaagcttttataatcagtggaaaacatttctgaggttcctttcattctgactgattcagcattttgcaaatagcaagcaattaagactgctttctcagacagaaataacaactcttgtttacattttgactcttcctgtgctaagcacacatggacatttgggaatgttgtggatatatgtctctgtatgaattgcagtgcagacagatttgggggttaattgtatcatatttaacatttagcaacttcttttgtgaagattttttatttttagggggagatgatgaaggatgaaggctttttcatttgcttctaagtacagtcatgtatcacataatgaagtttaagtcaatgatggaccacatatattacagtggtcccatgcaattaaaatggagataaattcctatcaactagtgacattatagccatcataacacagtgcattgcttttttatgtttagatatgtttagatacacaaatacttactattgtgttacaactgcctacagtattcagcatagtaacacattgtagaggtttgtagccgaggagcaataggctataccacatagcctcagtctgtacggtgtgtagcagcctgtaccatctcagtgtttgtaagtacactctgcgttgtttcacacaagatcacctaacaaggcaattcttagaacatgtagttaagggacacgtgactatatgtgaaaacaaattgtcaaacttcactttagtatggcaaatgttaaagaacttttctattatcagctgtttgtctgactgaaaaatacatatttttctaattcatggtgatgtaacattagtcctaattgaaaaactagtatttaaacataattatttataaagatgacacatcaaagggcttatttatttttaaattttttatttaaaaggatattcagttttagctatttttacccctcagattgtagataaagaaggcattaaatttatgtttgtctcctttttctgtttaattttaaagatatttaaaatgatataactaaaaatgtttagctggtgtatatgttttgaatacctttttcccctcagtttagtatattgactttgtactgtaaatttttctgcttttcttggataatctcaggattttcatgaggatagggggaactcaactttatttatgagacaaaatttccatacaaagctcaatctcctttatacacccacagacataatattagtttttaaaaagccaatttcttcatagttttttcccattaaattctcaaggaacacttggatctttaagcacggaacataatcatgatgttaaaaacagagaaaataaggctttataaagttaatgattatcatcagtatgaatttaaggtttgttttaatttcaagatttgattttttatacgtgtaattctattatctacccaagcagatctgtagtggttccaattagacttctcaaacagcaaatttatcctgattttatttgaaaagcctcttggattgatagtatagtagctcaggcattggaaactttctgcaaactgttttgggtttgcaggccagatggtctctgtggcagctactcagctctgcaatttcagtgtgaaagaagccatagacagtacttgaatgaaggactgtggctggattggccttttagtttgaccccctacattaggccccaaattttcttaccctgaggtgctgatatctgtatggatgagttatttgtcactaaagttatgagttgtgcctaaaagttaaaactgttgactgtattatgtaatgatcagtatttcagttgggaagatattttagagtctagataattatgtttgtatattgaaaaaatggtggccagtttttaagttccttaatagaagagaattatgtctcagcacatataacagtaatgctaatttattgaaactactgctgttagagcacttcttattcattgtcttttagtgaaatttatggcgtaacactttgtcagagaggaggctatataattcggagcggaaattgtctataagtaggcatttatttcatgattgatatgtcacagaaatcatggtagtaaatcacattgctatttgaataccctgtttttgtaagtttttaaaactcatattctgaaaagatttcattctcttagtgttagcttgggagttagattgccatgattaaactattatttatccttgtgtaatattagtttttaactttaacatctgtttctttttaatctataatgagctagttttatggaaaatggaatttcttactatataaagaatacagagactcattgtattagagaatcaagtcagccagctaaagtatcctactgttaaatccttaaacctaattttggaaaagagaaagttaatcaatgtatttaccttacatgttggaaagaactatgttaggtctgattcatgtgaagaagatgttgcaaaggatttatttcacaaattttaaaggagatatgagtaaaagtttttatcttttcttgactttttctcctgaacacttatgtcttagcaagtggtcaacatgaggatttgaacgcctaattgttggtaaatggttgaggcatgacaaaaatattaatatccactgtttaccatcatgttatttgaaacaaaagtgaccatgtatactatcttgcttgaagaagtctttgacagaaaaagcaatatcatgtcatttataaattttcttgttctaaagaaagcagttatatatatatataaattatgtaaataaaagttattttatatc

SEQ ID NO: 115 - protein, 840 aa, Homo sapiens
MSVVGIDLGFQSCYVAVARAGGIETIANEYSDRCTPACISFGPKNRSIGAAAKSQVISNAKNTVQGFKRFHGRAFSDPFVEAEKSNLAYDIVQLPTGLTGIKVTYMEEERNFTTEQVTAMLLSKLKETAESVLKKPVVDCVVSVPCFYTDAERRSVMDATQIAGLNCLRLMNETTAVALAYGIYKQDLPALEEKPRNVVFVDMGHSAYQVSVCAFNRGKLKVLATAFDTTLGGRKFDEVLVNHFCEEFGKKYKLDIKSKIRALLRLSQECEKLKKLMSANASDLPLSIECFMNDVDVSGTMNRGKFLEMCNDLLARVEPPLRSVLEQTKLKKEDIYAVEIVGGATRIPAVKEKISKFFGKELSTTLNADEAVTRGCALQCAILSPAFKVREFSITDVVPYPISLRWNSPAEEGSSDCEVFSKNHAAPFSKVLTFYRKEPFTLEAYYSSPQDLPYPDPAIAQFSVQKVTPQSDGSSSKVKVKVRVNVHGIFSVSSASLVEVHKSEENEEPMETDQNAKEEEKMQVDQEEPHVEEQQQQTPAENKAESEEMETSQAGSKDKKMDQPPQAKKAKVKTSTVDLPIENQLLWQIDREMLNLYIENEGKMIMQDKLEKERNDAKNAVREYVYEMRDKLSGEYEKFVSEDGRNSFTLKLEDTENWLYEDGEDQPKQVYVDKLAELKNLGQPIKIRFQESEERPKLFEELGKQIQQYMKIISSFKNKEDQYDHLDAADMTKVEKSTNEAMEWMNNKLNLQNKQSLTMDPVVKSKEIEAKIKELTSTCSPIISKPKPKVEPPKEEQKNAEQNGPVDGQGDNPGPQAAEQGTDTAVPSDSDKKLPEMDID

SEQ ID NO: 116 - DNA, 538 bp, Homo sapiens
gctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaaat

SEQ ID NO: 117 - protein, 2799 aa, Homo sapiens
MTSIHFVVHPLPGTEDQLNDRLREVSEKLNKYNLNSHPPLNVLEQATIKQCVVGPNHAAFLLEDGRVCRIGFSVQPDRLELGKPDNNDGSKLNSNSGAGRTSRPGRTSDSPWFLSGSETLGRLAGNTLGSRWSSGVGGSGGGSSGRSSAGARDSRRQTRVIRTGRDRGSGLLGSQPQPVIPASVIPEELISQAQVVLQGKSRSVIIRELQRTNLDVNLAVNNLLSRDDEDGDDGDDTASESYLPGEDLMSLLDADIHSAHPSVIIDADAMFSEDISYFGYPSFRRSSLSRLGSSRVLLLPLERDSELLRERESVLRLRERRWLDGASFDNERGSTSKEGEPNLDKKNTPVQSPVSLGEDLQWWPDKDGTKFICIGALYSELLAVSSKGELYQWKWSESEPYRNAQNPSLHHPRATFLGLTNEKIVLLSANSIRATVATENNKVATWVDETLSSVASKLEHTAQTYSELQGERIVSLHCCALYTCAQLENSLYWWGVVPFSQRKKMLEKARAKNKKPKSSAGISSMPNITVGTQVCLRNNPLYHAGAVAFSISAGIPKVGVLMESVWNMNDSCRFQLRSPESLKNMEKASKTTEAKPESKQEPVKTEMGPPPSPASTCSDASSIASSASMPYKRRRSTPAPKEEEKVNEEQWSLREVVFVEDVKNVPVGKVLKVDGAYVAVKFPGTSSNTNCQNSSGPDADPSSLLQDCRLLRIDELQVVKTGGTPKVPDCFQRTPKKLCIPEKTEILAVNVDSKGVHAVLKTGNWVRYCIFDLATGKAEQENNFPTSSIAFLGQNERNVAIFTAGQESPIILRDGNGTIYPMAKDCMGGIRDPDWLDLPPISSLGMGVHSLINLPANSTIKKKAAVIIMAVEKQTLMQHILRCDYEACRQYLMNLEQAVVLEQNLQMLQTFISHRCDGNRNILHACVSVCFPTSNKETKEEEEAERSERNTFAERLSAVEAIANAISVVSSNGPGNRAGSSSSRSLRLREMMRRSLRAAGLGRHEAGASSSDHQDPVSPPIAPPSWVPDPPAMDPDGDIDFILAPAVGSLTTAATGTGQGPSTSTIPGPSTEPSVVESKDRKANAHFILKLLCDSVVLQPYLRELLSAKDARGMTPFMSAVSGRAYPAAITILETAQKIAKAEISSSEKEEDVFMGMVCPSGTNPDDSPLYVLCCNDTCSFTWTGAEHINQDIFECRTCGLLESLCCCTECARVCHKGHDCKLKRTSPTAYCDCWEKCKCKTLIAGQKSARLDLLYRLLTATNLVTLPNSRGEHLLLFLVQTVARQTVEHCQYRPPRIREDRNRKTASPEDSDMPDHDLEPPRFAQLALERVLQDWNALKSMIMFGSQENKDPLSASSRIGHLLPEEQVYLNQQSGTIRLDCFTHCLIVKCTADILLLDTLLGTLVKELQNKYTPGRREEAIAVTMRFLRSVARVFVILSVEMASSKKKNNFIPQPIGKCKRVFQALLPYAVEELCNVAESLIVPVRMGIARPTAPFTLASTSIDAMQGSEELFSVEPLPPRPSSDQSSSSSQSQSSYIIRNPQQRRISQSQPVRGRDEEQDDIVSADVEEVEVVEGVAGEEDHHDEQEEHGEENAEAEGQHDEHDEDGSDMELDLLAAAETESDSESNHSNQDNASGRRSVVTAATAGSEAGASSVPAFFSEDDSQSNDSSDSDSSSSQSDDIEQETFMLDEPLERTTNSSHANGAAQAPRSMQWAVRNTQHQRAASTAPSSTSTPAASSAGLIYIDPSNLRRSGTISTSAAAAAAALEASNASSYLTSASSLARAYSIVIRQISDLMGLIPKYNHLVYSQIPAAVKLTYQDAVNLQNYVEEKLIPTWNWMVSIMDSTEAQLRYGSALASAGDPGHPNHPLHASQNSARRERMTAREEASLRTLEGRRRATLLSARQGMMSARGDFLNYALSLMRSHNDEHSDVLPVLDVCSLKHVAYVFQALIYWIKAMNQQTTLDTPQLERKRTRELLELGIDNEDSEHENDDDTNQSATLNDKDDDSLPAETGQNHPFFRRSDSMTFLGCIPPNPFEVPLAEAIPLADQPHLLQPNARKEDLFGRPSQGLYSSSASSGKCLMEVTVDRNCLEVLPTKMSYAANLKNVMNMQNRQKKEGEEQPVLPEETESSKPGPSAHDLAAQLKSSLLAEIGLTESEGPPLTSFRPQCSFMGMVISHDMLLGRWRLSLELFGRVFMEDVGAEPGSILTELGGFEVKESKFRREMEKLRNQQSRDLSLEVDRDRDLLIQQTMRQLNNHFGRRCATTPMAVHRVKVTFKDEPGEGSGVARSFYTAIAQAFLSNEKLPNLECIQNANKGTHTSLMQRLRNRGERDREREREREMRRSSGLRAGSRRDRDRDFRRQLSIDTRPFRPASEGNPSDDPEPLPAHRQALGERLYPRVQAMQPAFASKITGMLLELSPAQLLLLLASEDSLRARVDEAMELIIAHGRENGADSILDLGLVDSSEKVQQENRKRHGSSRSVVDMDLDDTDDGDDNAPLFYQPGKRGFYTPRPGKNTEARLNCFRNIGRILGLCLLQNELCPITLNRHVIKVLLGRKVNWHDFAFFDPVMYESLRQLILASQSSDADAVFSAMDLAFAIDLCKEEGGGQVELIPNGVNIPVTPQNVYEYVRKYAEHRMLVVAEQPLHAMRKGLLDVLPKNSLEDLTAEDFRLLVNGCGEVNVQMLISFTSFNDESGENAEKLLQFKRWFWSIVEKMSMTERQDLVYFWTSSPSLPASEEGFQPMPSITIRPPDDQHLPTANTCISRLYVPLYSSKQILKQKLLLAIKTKNFGFV

SEQ ID NO: 118 - protein, 459 aa, Homo sapiens
MLKLIVPTIMLLPLTWLSKKHMIWINTTTHSLIISIIPLLFFNQINNNLFSCSPTFSSDPLTTPLLMLTTWLLPLTIMASQRHLSSEPLSRKKLYLSMLISLQISLIMTFTATELIMFYIFFETTLIPTLAIITRWGNQPERLNAGTYFLFYTLVGSLPLLIALIYTHNTLGSLNILLLTLTAQELSNSWANNLMWLAYTMAFMVKMPLYGLHLWLPKAHVEAPIAGSMVLAAVLLKLGGYGMMRLTLILNPLTKHMAYPFLVLSLWGMIMTSSICLRQTDLKSLIAYSSISHMALVVTAILIQTPWSFTGAVILMIAHGLTSSLLFCLANSNYERTHSRIMILSQGLQTLLPLMAFWWLLASLANLALPPTINLLGELSVLVTTFSWSNITLLLTGLNMLVTALYSLYMFTTTQWGSLTHHINNMKPSFTRENTLMFMHLSPILLLSLNPDIITGFSS

SEQ ID NO: 119 - protein, 1522 aa, Homo sapiens
MKAVRNLLIYIFSTYLLVMFGFNAAQDFWCSTLVKGVIYGSYSVSEMFPKNFTNCTWTLENPDPTKYSIYLKFSKKDLSCSNFSLLAYQFDHFSHEKIKDLLRKNHSIMQLCNSKNAFVFLQYDKNFIQIRRVFPTNFPGLQKKGEEDQKSFFEFLVLNKVSPSQFGCHVLCTWLESCLKSENGRTESCGIMYTKCTCPQHLGEWGIDDQSLILLNNVVLPLNEQTEGCLTQELQTTQVCNLTREAKRPPKEEFGMMGDHTIKSQRPRSVHEKRVPQEQADAAKFMAQTGESGVEEWSQWSTCSVTCGQGSQVRTRTCVSPYGTHCSGPLRESRVCNNTALCPVHGVWEEWSPWSLCSFTCGRGQRTRTRSCTPPQYGGRPCEGPETHHKPCNIALCPVDGQWQEWSSWSQCSVTCSNGTQQRSRQCTAAAHGGSECRGPWAESRECYNPECTANGQWNQWGHWSGCSKSCDGGWERRIRTCQGAVITGQQCEGTGEEVRRCSEQRCPAPYEICPEDYLMSMVWKRTPAGDLAFNQCPLNATGTTSRRCSLSLHGVAFWEQPSFARCISNEYRHLQHSIKEHLAKGQRMLAGDGMSQVTKTLLDLTQRKNFYAGDLLMSVEILRNVTDTFKRASYIPASDGVQNFFQIVSNLLDEENKEKWEDAQQIYPGSIELMQVIEDFIHIVGMGMMDFQNSYLMTGNVVASIQKLPAASVLTDINFPMKGRKGMVDWARNSEDRVVIPKSIFTPVSSKELDESSVFVLGAVLYKNLDLILPTLRNYTVINSKIIVVTIRPEPKTTDSFLEIELAHLANGTLNPYCVLWDDSKTNESLGTWSTQGCKTVLTDASHTKCLCDRLSTFAILAQQPREIIMESSGTPSVTLIVGSGLSCLALITLAVVYAALWRYIRSERSIILINFCLSIISSNILILVGQTQTHNKSICTTTTAFLHFFFLASFCWVLTEAWQSYMAVTGKIRTRLIRKRFLCLGWGLPALVVATSVGFTRTKGYGTDHYCWLSLEGGLLYAFVGPAAAVVLVNMVIGILVFNKLVSRDGILDKKLKHRAGQMSEPHSGLTLKCAKCGVVSTTALSATTASNAMASLWSSCVVLPLLALTWMSAVLAMTDKRSILFQILFAVFDSLQGFVIVMVHCILRREVQDAFRCRLRNCQDPINADSSSSFPNGHAQIMTDFEKDVDIACRSVLHKDIGPCRAATITGTLSRISLNDDEEEKGTNPEGLSYSTLPGNVISKVIIQQPTGLHMPMSMNELSNPCLKKENSELRRTVYLCTDDNLRGADMDIVHPQERMMESDYIVMPRSSVNNQPSMKEESKMNIGMETLPHERLLHYKVNPEFNMNPPVMDQFNMNLEQHLAPQEHMQNLPFEPRTAVKNFMASELDDNAGLSRSETGSTISMSSLERRKSRYSDLDFEKVMHTRKRHMELFQELNQKFQTLDRFRDIPNTSSMENPAPNKNPWDTFKNPSEYPHYTTINVLDTEAKDALELRPAEWEKCLNLPLDVQEGDFQTEV

SEQ ID NO: 120 - DNA, 3278 bp, Homo sapiens
agttcagtttagaaactgccagtcttggtatagaacaacctaggcttatctgtttaagtcccataggtagtattattagagaataacccaggctttgggaactgtataactctgagatcgtttgaaattttcgttttgtttttcttttggctccaaccaggcctctgttgttagactaatggggtttcccctgcagagattggtcagccctgcagtctatcatcccggaaggtgttaaatacacatgaaagccagcctcggcgggcagaacctagcccgccgaaagggcgggcattgctaaagtgttttcaaaaggtcttcccaatcctctgctttagacagctcggaccttagatagaagaacacaacggatcctccagtgactgacgacccaaaggacggatgatgtcacagtcatctggatcaggagatgggaatgatgatgaggctactacctctaaagacggtggtttttcttcccccagtccctcagctgctgctgctgctcaggaggtcagatctgccactgatggtaataccagcaccactccgcccacctctgccaagaagagaaagttaaacagcagcagcagtagcagcagtaacagtagtaacgagagagaagactttgattccacctcttcctcctcttccactcctcctttacaacccagggattcggcatccccttcaacctcgtccttctgcctgggggtttcagtggctgcttccagccacgtaccgatacagaagaagctgcgttttgaagacaccctggagtttgtagggtttgatgcgaagatggctgaggaatcctcctcctcctcctcctcatcttcaccaactgctgcaacatctcagcagcagcaacttaaaaataagagtatattaatctcttctgtggcttcggtgcatcatgcaaacggcctagccaaatcttctaccaccgtctctagctttgctaacagcaaacctggctctgctaagaagttagtgatcaagaactttaaagataagcctaaattaccagaaaactacacagatgaaacctggcaaaaactgaaagaagcagtggaagctattcagaatagtacttcaattaagtacaatttagaagaactctaccaggctgtagaaaatctctgttcttacaagatttctgcaaacttgtacaaacagctgagacagatctgcgaagatcacatcaaagcacagattcatcaattcagagaggattcattggatagcgttctttttttaaagaagattgatagatgctggcaaaaccattgcagacaaatgatcatgatcaggagcatttttttgtttctggatagaacttacgttcttcagaattcaatgctaccctccatttgggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaaatttatcaagattcttttgaacaacgatttttggaagaaactaaccggctctatgcagctgaaggccaaaaattaatgcaagaaagagaggttcctgaatatctacatcatgttaacaaacgtctagaagaagaagcagacagacttattacttacttagatcagaccacccagaagtcattaattgctactgtagaaaaacaacttctaggtgaacacttaacagcaattcttcagaaaggtttaaataacctccttgatgaaaaccgaattcaagatttgtctcttctgtatcagctcttcagtagagttcgaggtggagttcaggttcttttgcagcagtggatcgaatatatcaaggcatttggcagcactattgtaattaatcctgaaaaagataaaaccatggttcaagaattgctggattttaaagataaggttgaccatataattgatatctgctttctgaagaatgagaaatttatcaatgccatgaaagaagcatttgaaacgttcattaacaaaagaccaaataaaccagctgaacttatagctaagtatgtagattcaaaacttcgtgcaggcaacaaagaagctacagatgaagaacttgagaaaatgttggataaaattatgatcatatttagatttatctatggcaaggatgtttttgaggccttctataagaaagatttagccaagcgcctgttagtcggaaagagtgcatctgtagatgctgaaaaatcaatgctgtccaaacttaaacatgaatgcggagctgctttcaccagcaaacttgaaggaatgtttaaagacatggaactttctaaagacatcatgattcagttcaaacagtatatgcagaatcagaatgttccgggaaatattgagttaactgtgaatatcctgacaatgggctattggccgacatatgtgcctatggaagttcatttaccaccagagatggtaaaacttcaggagattttcaagacattttacctaggcaaacatagtggcaggaaacttcagtggcagtcaaccataggacactgtgtgttaaaagcagaatttaaagagggtaaaaaggaactccaggtctctctttttcaaacactggtgctgctaatgtttaatgagggagaggagttcagtttagaagagatcaagcaggcaactggaatagaggatggagagttaaggagaacactgcagtcattagcctgtggcaaagctagagttctggcgaaaaatccaaagggcaaagacattgaagatggtgacaagttcatttgtaatgatgatttcaaacataaacttttcaggataaagatcaatcaaatccagatgaaagaaacggttgaagaacaagcaagcactacagaaagagtatttcaagacagacagtatcaaattgatgctgcaattgttcgaattatgaagatgagaaagacacttagccacaatctccttgtttcagaagtgtacaaccagttgaaatttccagtaaagcctgctgatcttaagaagagaatagaatctttaattgaccgggactacatggaaagagataaagaaaatccaaaccagtacaactatattgcatagaatgttggccttgcagcatttggtgtcatatgcagtagccagtggataaactaacctgttgattcaatattatttgactccttttttactaccgatgaccaaatgaagcagtgtaattaaaaaaaaaaaaaaaa

SEQ ID NO: 121 - protein, 1216 aa, Homo sapiens [sequence omitted]

SEQ ID NO: 122 - DNA, 13990 bp, Homo sapiens
gagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattggcggccgctccctggccgacttggcccaagcttgccatctccaccatcctctcgagcgtctggaagtctgaccgtcccgatggtcttctccccaccgttgtcgttgatgagcacgacactgctctgggtctggtctacagcagtgccgagagtgtgaacgaggccctcaggacacagactggtgtctatcagagccggaagcgcggtctctggtacaagggtgctacttccggagacactcaggagctcgtccgcatctcgcttgactgcgataacgatgctctcaagtttgtcgtgaagcagaagggtcgtttctgccacctcgatcagtccggctgctttggtcagctcaaaggccttcccaagctcgagcagactttgatttcgaggaaacagtctgcccccgagggctcctacactgcccgtctcttctccgatgagaagctagtccgggccaagatcatggaggaggctgaggagctctgcaccgctcagaccccccaggaaatcgcctttgaggctgccgatctcttctactttgctcttaccagggccgttgctgccggcgttactcttgccgatatcgaaaggagccttgacgccaagagctggaaggtcaagcgcaggactggagatgctaagggtaagtgggctgagaaggagggcatcaagcctgcggcgtccgctctcgctgccacttcggcccctgtcaccaaggaggccgcccaggagaccacccctgagaagatcaccatgagacgtttcgacgcctccaaggtctctaccgaggagctcgatgctgctctcaagcgtcctgcgcaaaagtcgtccgatgccatctacaagatcattgtccccatcatcgaggacgtccgcaagaacggcgacaaggctgttctgtcgtacactcacaagttcgagaaggctacctctcttactagccccgtcctgaaggcgcccttccccaaggagcttatgcagctccctgaggagaccattgctgccatcgacgtgtccttcgagaacatccgcaagttccacgccgcccagaaggaggagaagcccctccaggtcgagaccatgcccggtgttgtctgcagccgtttctctcgtcccatcgaggccgtcggctgctacatccccggcggtaccgccgttctccccagcactgcccttatgctgggtgttcccgccatggtcgccggctgcaacaagattgtgttcgcctctcctccccgcgccgacggaaccatcactcccgagattgtctacgtcgctcacaaggttggcgccgagtccatcgtgcttgccggcggtgcccaggccgtagctgccatggcctacggcaccgagagcatcaccaaggtcgacaagattctcggccccggtaaccagttcgtcactgctgccaagatgttcgtcagcaacgacaccaacgctgccgttggtattgacatgcccgctggcccgtccgaggtgctggtcatcgctgacaaggacgccaaccccgcgttcgttgcctcggatctcctgtcccaggctgagcacggcgttgacagtcaggtcatcctgatcgctattgacctcgacgaggagcatcttcaggctattgaggacgaggttcaccgtcaggctacggagcttcctcgcgtccagattgtccgtggctccatcgcccactcgatcaccgtgcaggtcaagaccgtcgaggaggccatggagctcagcaacaagtacgctcctgagcacttgatcctccagatcaaggaggccgagaaggctgtcgatcttgtcatgaacgccggtagtgtcttcattggcgcctggactcctgagtccgttggcgattactctgctggtgttaaccactcgctgcgtaagttacatatcataaatagccccgcttcacagattcttctgctaacgtcaagacacatagctacctatggctttgccaagcagtactctggcgtcaatctcgcctcgttcgtcaagcacattaccagctccaacttgactgccgagggtctcaaaaacgtcggccaggctgtcatgcagttggctaaggttgaggagctcgaggctcacagaagggcggtcagcatccgtcttgagcacatgagcaagagcaactaaacggaaattcttttcgaagtagcaaaaaaaaaaaaaaaaaacaagaacaaaaggatgtagtgggttgatgtatatctgggtcattttgggcacatagagtaatgataacgagttttggacattgtactgttctgtacaggctgaagatcagtacatgaatctgttggtaagtgtagagacccaaacgtccctttagtttttctccctattccagaaggggtgctcgtccctgggtgtttattttcattattacatcaactttttttttttttttttttttttcagatcatgcgtacatgaacggggaagcacagacgatcgaaacgtggatgtcacaatgtcgctgcagtgatgctgcattgcatgaagcgcccatctcaatatacttgcagtcttgcacgttgcatgtgaacctcccaaacaaccgaataaaagacggcgaaaaatgaagataaaaaaaaaccataaaaaaaatcagagggagtgtgggaaatggtgtcttttagcattcagaccccatagccgtgcacgcccgggtacagacaggttcatcgatgttgacattgactgggacaccaggtctatctattttatctcctgtcctctaccatacatcgggacatcggacatcttgctgtaccccccacacccacaaagcctcataaaagcgccacacccgaggaggttcggtcggccccacgaactctgtgcctccctgcctgtttacagggaccgaacgctggagaatcttactagtttcctgacatccggcctacccgagcaggaaaagggacagctcataggcgaggagggatttgaagatgggaacattttgggtgattcgagaggaggaactaggtactgcatcatgatagttcggggcagcatcttggctgggacattgttaatacctcgatatgatgaagtaggagggagtttttgcgtgtcttgccgaagtccagagatctgttttattttattttttatggatgtagtgtatcaacacccaagattcggagaatagtactaggattcgcatttacaagtggaagtcttgagaatcgttgtatatccttgtcttcctcggaatgttaacaatcctacagcgagcgagcgagcggtcggatgcgctgatctgataggcgcaatatacggccgctttctccggtcgtgtagtgtaagctctgtgggcatagtacactaaaaaaacccttgcatttcatgatctgcctgctattcattccgagctatttcagtggtcacatttcgaggaagaaagaaagcaactaagattcacagccatccatccatccatatggaagaataatccattcccatgttccctcccccccactatgtatgtgaccacacgctgctgtcagaatgccaacggtctcaggtaccctcgtccgactgtttggcatggagttacatacactactagtgtagccccgggccaagctaccccgtcaaatctatacatatctataacgggtttcaggggtttcgttcgctgtcaatcaagtttgaaacatcactggggccgttggacggtgtattagaccattggctccctcagctgtttggcggctgggcggctgggtcaaacggcaataacgggactcgagagggacgaggagagtcggttggctggctgcaatacaagcgttcccacctaaccaacgagtcccgttttccatttgtgtgcctaaccatcatctagggatgtcagggtttggccggatcagggtatgtttggttgactgttgtcatgtctgattgggtacatattatggtaggtgtctcgagaacagtagagtactcgggcctagcgtttggatgattacgcgagatatgagttgtgggccgccatgcagttgcttgtccataagcagaagttgctttgggatatatttctcgtctttcaaaggtcacgaggtcctgggacgaacggcatcgccatccaaagggttgaacatgagaaacctgaatggcctttgcgttgaaatacaaaaagtcaagaacaaaatcgcttgaggatagggacgtggaagcaagcaaatatggtaagagaggtatacatcaaccctggttcaattgttagcgtggttcttcctccacgtcctcgttcatgacggttaacagtaccaggctaacaattaaaccagggttgatgtgtactgatatgtaggtgctcagcaaactgccaatttcttggccccaagcagcagtttgctgtcagtgctgctcgtgtcagccttggtagtggaacctaaactgctaacacagcgcaagtgcgcatgtaaagatattgtgggaggatctgtatggatggatgagattactgcttggtgttggttgcgaggcactgcggctgttaggctttgctgtgccccgttcgacgaagaaatacgcggaactataaattggatacctagacttactgcctatgggaggtatctaccgacgtagccgacggattctagcaacatcccgactttgcttgtagtgtactatgatagcagcacagtgttgctccttgtgagaatgggctcttttttttttttcccccttccctagggcgttgactggacttgctctattgttcccaaggtaggtgcccgtcatcgattttcccaagtctcccgccagattgtcgtcatagtgtcatgatgacctcggtcgctggggctgcgtggttacggggagctgggaccgctaggcctcagtggttgtgccattcagcgtgggtgtgtggagtagcggtagaggcgcttggaagttgtgctagcggaaaccctggaatatcttctaccctcgattccttctcgggctgcccatgtgctgaggtgatgccggggatctggcgccaatcatccattgaggttcccgcagcttcccggtgccgcgcgcgggcgcagttgctcacaggacacacctagacgcaggggcacaggggcaccgtttggtgtgcaactgggtacctagctgtagcaagcactccaccgtctgtgcaatcccccaatccacggcaggaacttcgcaccgccgcggcaccgagtgagcgaatccatccgcattggatctcgatcccgcgaaattaatacgactcactatagggagaccacaacggtttccctctagatcacaagtttgtacaaaaaagctgaacgagaaacgtaaaatgatataaatatcaatatattaaattagattttgcataaaaaacagactacataatactgtaaaacacaacatatccagtcactatggcggccgctaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgatgatccggctgctaacaaagcccgaaaggaagctgagttggctgctgccaccgctgagcaataactagcataaccccttggggcctctaaacgggtcttgaggggttttttgctgaaaggaggaactatatccggataaactctagaccgaattcaaaataccacgggcgcaggtggtattggaggcttgttgcagtccagcacatatttgtatgtaaagtggttcttcttatctcgttttcgagtgtcaactgcgccagttcagagttgggcggctgtggacgaccttgctggtgaacatgtcttggactccatgccccttcttcgtttcctcaaatcaagaagtcgaggaccgtgaccgtaaatcgctaacgcaactctagggccggactttctggtggtggctggcttgtcggcagtttgttctccaacaacttcagcagcattgagaccctgctgagcgagaacaaagtctgggactttgagaactccatctttaaagggcccaaggaggctggccttagtactgtcaaccgcattcagtactggtccgaagtggcaaaggaagttgccaagaagaaggatgctggcttcgagacaagtataacagactactggggccgagcattgagttaccaactgatcggagccgatatgggcggcccggcttacaccttctccagcattgcccagaccgacaacttccagaaggccgaaacgccgttccctattctggtagctgacggccgcgcgcctggagacaccatcatctccctcaatgctaccaactacgagttcaacccgttcgagacgggtagctgggacccgaccgtctatggctttgcgccgaccaagtacctcggcgccaacttcagcaacggcgtgatcccatcgggaggcaagtgcgttgagggtctcgaccaagccggcttcgtcatgggcaccagcagcacgctcttcaaccagttccttttggccaacatctccagctacgacggtgtgcccgacgtgctcatcgaggccgtgacttctgtcctcaaggaaatcggcgccaagagggacgacgtctcccaaatcatccctaatccgttcctggactggaacaaccggaccaaccccaacgccgacacgctcgagctcgacctggtcgacggcggcgaagatctgcagaatattccgctcaacccgctcacccaacccgtgcgcgccgtggacgtcatcttcgctgtcgactcgtccgccgacgtgacaaactggcccaatggcaccgccctgcgagccacctacgagcgcactttcggctctatttccaacgggacactcttcccctcgatccccgacgactggacgtttataaacctaggcctcaacaaccgcccctctttcttcggctgcgatgttaagaactttaccttgaacgccaaccaaaaggttccccccttaatcgtctatgtccccaacgcgccctataccgcgctgagcaacgtgtccaccttcgatccgtcatacaccatgtctcagcgcaacgacatcatcggcaacggatggaactcagccacgcagggaaacggcacgctggattcggagtggcccacttgcgtcgcctgcgcggttatcagcaggagcttagatcggttgggcaggcagacgccagccgcgtgcaagacttgctttgagaggtattgctggaatggcacagtgaactcaaaagatacaggggtttacatgcctgagttcaagattgcggatgcgcatgccctggactcgggtgctgttgctatcggaaagatggtgaatgtctggtcgtcggttgtggtgggagttgtggcggctactttgttgttgtaggggtaggggagacgtgatgatattccagtctgatgaagttgagactggactggagatcgccaaggatgcggagggaaaggaatgcgtggtgttaatgtcatgatggatgaagggtcatggatcatggaacgacggggcggggatattggatgatggatataccacactgcatgcatgctctattgatagtatgctttggcatttacgtttaacaatcaattgctccatcctgatgttctatctttttcgacactggattgatactactcctgttgcttcgctcttgaggttggaaggaccttgaggttggaaggaccttgaggttgtttgttctgagggaggttatcgaagtatcatctgtgctgatgccgatcgatagactgccctcttcttcgaggcaacgaacggtcggatgagcctctaatcatgatgctcagtgccacaaaaaggctccagcacagctgcccacaccttttttgcctcgtcgctccttcctttttttccccccctttcttcctttccatctcatcccgtaccagagtgcccaccgggtatatatattacctccttggccgttctcctttgaccaataaatcgcttggtcgagtggcgtaaccgtttaccgtctacacttatcactcaaaccaaaccaaaccatcgaagaagttacctatcggttcgagggaacggtgatgttcttacgttcaagtaacccaaagagcgttccacatcgttgaccgtctcctccagttcttggatctgtttaacttccgcagcgactgaagaaggtaatcactttttttttttttggttcaaaaaaaaaaaaaaaaaattacacgaaaaggttagaggcgtttcgatggttaaactcgatcgagcggttgtttgtagccttttcttttgtgtcttttggcagtacttcctttggaggtggaaggagggttagaggccgcgtcaacctaagtaagggagggagctggttgcattcgaaccccggatgggacttgtgttctgttgttgtttttttttgcactgatgatgattctgggcgagtgcgcttttgataactacagtcccacgtcatcaacttcacgattagtccttgactcttttttttctttttctactaaaagcctggtcttacccaagtgttcacggtatatggagtatgcgatagagggcgatatatcttctcaacaactcgtttcttctcgctcagcccacaatagggtgcttgtaattcttccaccgagagcaagtgggagtaatcttcttcgatggctacagccgtcagtcagaccacctacatccacgtccaggcaatatctctgggacttcacaacaacaaaagcgcactggaatgaaacaggaaatttctcgagataagtgcctgattgtagtcttgcggttcatgtacatctgaccttttcttgagagcccccgtttctggtccaaaatcgtctgactttcacctagcctgcccccacgaaatccagtctccccttgatgtcgtcgggcaacgtcgagagatactcctcccaaatgtcctgatttgcacccgcgggcacgcggaacgtgtaaataagtcctcctgttcctccttttcttccactagcttcgtcatctccagccatcaccgccaactctcggtttatcttcggtgccagaatgatgcttgatgtcctaggactgcccgcaaattgcagatacaagggaacaggaggacagctactaagcggcggcgacaatgacattccccccacgcccgagccgagcagttcctggactctagcccccatggtcaggggaggggatgttgtcactctagcatgaagatcagcgatcgagatgccccccaaaagctt

SEQ ID NO: 123 - protein, 670 aa, Homo sapiens
MSHLPMKLLRKKIEKRNLKLRQRNLKFQGASNLTLSETQNGDVSEETMGSRKVKKSKQKPMNVGLSETQNGGMSQEAVGNIKVTKSPQKSTVLTNGEAAMQSSNSESKKKKKKKRKMVNDAEPDTKKAKTENKGKSEEESAETTKETENNVEKPDNDEDESEVPSLPLGLTGAFEDTSFASLCNLVNENTLKAIKEMGFTNMTEIQHKSIRPLLEGRDLLAAAKTGSGKTLAFLIPAVELIVKLRFMPRNGTGVLILSPTRELAMQTFGVLKELMTHHVHTYGLIMGGSNRSAEAQKLGNGINIIVATPGRLLDHMQNTPGFMYKNLQCLVIDEADRILDVGFEEELKQIIKLLPTRRQTMLFSATQTRKVEDLARISLKKEPLYVGVDDDKANATVDGLEQGYVVCPSEKRFLLLFTFLKKNRKKKLMVFFSSCMSVKYHYELLNYIDLPVLAIHGKQKQNKRTTTFFQFCNADSGTLLCTDVAARGLDIPEVDWIVQYDPPDDPKEYIHRVGRTARGLNGRGHALLILRPEELGFLRYLKQSKVPLSEFDFSWSKISDIQSQLEKLIEKNYFLHKSAQEAYKSYIRAYDSHSLKQIFNVNNLNLPQVALSFGFKVPPFVDLNVNSNEGKQKKRGGGGGFGYQKTKKVEKSKIFKHISKKSSDSRQFSH

SEQ ID NO: 124 - DNA, 6942 bp, Homo sapiens
ggcatggaacctaaagactagaggcggttgtgtgagtcaggaagaggggccagatatctgagtgttcctctttagtttcttcaattgcagataatatggtgtctaattttatgttgttcaggaaagacagtggttcctgactcaggaagacagtctcagaaacatgtggaatgatattgagctgctaacaaatgatgataccggaagtgggtacctgagtgtcggttcaagaaaagaacatggaactgctttatatcaagtagatttgctagtgaagatctcttctgaaaaggcctcattaaatccaaagatacaggcatgcagcttaagtgatgggtttattattgtagccgaccaatcagtgatattgcttgacagtatttgtagatcacttcaattgcatcttgtctttgatactgaagtggatgtagttggcctttgtcaagaaggaaagtttcttttggttggcgagagaagtggcaacctacatcttattcatgtaacatcaaaacaaacactactcactaatgcatttgttcagaaagctaacgatgaaaatcggcggacttaccagaatcttgtcattgagaaggatggttcaaatgaaggtacctattatatgctacttcttacatacagtggatttttttgtattacaaaccttcagcttttaaaaattcaacaagcaattgagaatgtagacttcagtacagcaaaaaagttacaaggacaaatcaagtccagttttatttctactgaaaattatcatactcttggttgtctcagtcttgtggctggagatttagcaagtgaagttcctgtgataattgggggaaccggtaattgtgcattctcaaaatgggaaccagattcttccaagaaaggaatgacagttaagaaccttattgatgcagagattattaaaggtgcaaagaagttccagctgatagacaatctactttttgttcttgatactgataacgtgctgagtttatgggatatttacactctaactcctgtatggaactggccctctcttcacgtagaagagtttcttcttactacagaagcagactctccttcatcagtcacgtggcaaggaattacaaatctcaaattaatagctctgacagcttcagctaataagaagatgaaaaacctcatggtttattcattacctacaatggaaatactatattctttggaagtatctagtgtttcttctctggtccaaacaggaattagcacagataccatataccttttagaaggagtttgcaaaaatgatccaaaattgtctgaagactcagtctctgtgttagtactcagatgtcttacggaagctttaccagaaaacagattgagtcggttacttcacaaacacagatttgctgaagctgagagttttgccattcagtttggactagatgttgagcttgtttacaaggtcaagtcaaatcatatattggagaaactggcattgagttctgtggatgccagtgaacagaccgaatggcaacaacttgtagacgacgctaaggaaaatctacataagatccaggatgatgaatttgtggtgaattactgcctgaaagctcagtggataacctatgaaaccactcaagagatgctgaattatgccaaaaccaggcttttgaagaaagaagataaaactgctctcatttattctgatggcttgaaagaggtgctaagagctcatgcaaaattgactactttttatggagcatttggaccagaaaaattcagtggcagttcttggattgaatttctaaataatgaagatgatcttaaagatatttttttacagctaaaagaaggaaaccttgtttgtgcacagtatctttggcttcgacatcgggcaaactttgaaagcagatttgatgtgaaaatgctggagagcttgctcaactcaatgtctgcatcagtctctttgcaaaagctgtgtccatggtttaaaaatgatgtgattccatttgtaagaaggactgtgcctgaaggacagataattcttgcaaaatggttggaacaagcagccaggaaccttgaattaactgataaggcaaattggccagaaaatggacttcaattggcagagatattttttacagcagaaaaaacagacgagttgggattggcatcttcctggcattggatttccttgaaagattatcagaacacagaggaagtatgtcagctaaggactttggtaaataacttgcgagagttgatcacgttgcataggaagtacaactgcaaattagccctctctgattttgagaaggaaaatacaaccaccatagtgttccgaatgtttgataaagtgctggccccagagcttattccctccatcttagagaagtttataagagtttacatgagagaacatgacttgcaagaggaggaacttctcttgctgtacatagaggatttactgaatagatgcagctcaaagtccacatcactctttgaaacagcatgggaagcaaaggccatggcagtaatagcgtgtttatctgacacggacctcatatttgatgccgtgctcaagatcatgtatgcggcagtggttccttggagtgcagctgtggagcaactggtgaaacagcacctggaaatggaccatcccaaagtcaagttattacaggaaagttacaaactaatggagatgaaaaaacttttacgaggctatggaataagagaggtaaatctcttaaacaaggaaataatgagagtggttagatacattctcaaacaagatgtcccatcttctttagaagatgctttaaaggtagcccaagcgtttatgttatctgatgatgagatctacagtctaagaattattgacctgattgatagagaacagggtgaagactgtctccttctgttgaagtctttgcctcctgctgaagctgagaaaactgcagaaagagtcatcatatgggcacgactggcattacaagaagagccagatcattctaaagagggcaaggcctggagaatgtctgtagcgaagacatccgtggacattcttaagatactatgtgacattcagaaagacaatctgcagaagaaggacgaatgtgaagaaatgttgaaactatttaaagaggttgctagcttacaggagaactttgaggtctttctttcatttgaagattatagcaatagttccctggtagcagatctccgtgagcagcacattaaagctcacgaagttgcacaggcgaaacacaaacctgggagcaccccagagcccatagctgctgaggtgaggagcccaagcatggaatcaaagctgcacagacaggcactggccctgcagatgtccaaacaagagctggaggcagagctgaccttgagagccttaaaagatgggaacatcaaaacagcactgaaaaaatgcagcgacttgtttaagtatcactgcaatgctgacactgggaaattgctatttctgacatgtcagaagctttgtcagatgttggctgataatgtcccagtgacagtgcctgtgggactgaatcttccttccatgatacatgatctagcaagccaagctgccaccatttgcagtccagattttttactagatgctttagaactatgtaaacatactttaatggctgtagagctttccagacaatgccaaatggatgactgtggaatcctcatgaaagcttcttttgggacacataaagatccatatgaagagtggtcttacagtgacttcttcagtgaagatggaattgttcttgagtcacagatggtgcttccagtgatttatgaactgatttcatctcttgtgcctctagctgaaagcaagagatatcccttggagtctaccagtttgccatactgctcccttaatgaaggagatggccttgttttacctgttataaattccatctctgccctgcttcagaatcttcaggaatctagccagtgggagctagccctaagatttgtggttggttcatttggtacctgtcttcagcactctgtgtcaaacttcatgaatgccactttgagtgaaaagttatttggagagactacattagttaaatcaaggcatgttgttatggaattgaaagaaaaagctgttatatttatcagggaaaatgctacaacactactgcacaaagtatttaattgtcgcttggtagatcttgacctggcgttgggttactgcactctcttacctcaaaaagatgtgtttgaaaatctctggaagctcatagataaagcatggcagaattacgacaaaatcttggcaatatctctggtgggctctgagctggcaagtctctatcaggaaatagaaatggggcttaagttccgtgaactcagtactgatgcccagtggggcattcgtcttggtaaacttggtatttcttttcaaccagttttcaggcaacattttctcaccaagaaagacctcattaaagctcttgtggagaatatagatatggacacaagcctcattttggaatattgcagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataagttggatccttatgactatgaaatgattgaagttgtcttgaaagttatagaacgagctgatgaaaagataaccaatattaatattaatcaggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctgatattcatgcagcagctaaagaaatagccgaagtcaatgaaattaatttggaaaaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagc

SEQ ID NO: 125 - protein, 476 aa, Homo sapiens
MAGRGGSALLALCGALAACGWLLGAEAQEPGAPAAGMRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWEDNKNSLISYLEQIHRGVKGFVRDLQGNPIANATISVEGIDHDVTSAKDGDYWRLLIPGNYKLTASAPGYLAITKKVAVPYSPAAGVDFELESFSERKEEEKEELMEWWKMMSETLNF

SEQ ID NO: 126 - DNA, 1105 bp, Homo sapiens
gcgggggatgacgccacggacatggtggccgagaccggcggggtgggggacgtgtcgcgcggccgggtggcctcggtcggtaccctgggcgcggagcagctgcctcattagtattcgtacccacgaggcggcgcagcgggccctcggggacagcgagcgtcgcggccatggcttatcactcgggctacggagcccacggctccaagcacagggcccgggcagccccggatccccctcccctcttcgatgacacaagcggtggttattccagccagcccgggggatacccagccacaggagcagacgtggccttcagtgtcaaccacttgcttggggacccaatggccaatgtggctatggcctatggcagctccatcgcatcccatgggaaggacatggtgcacaaggagctgcaccgttttgtgtctgtgagcaaactcaagtatttttttgctgtggacacagcctacgtggccaagaagctagggctgctggtcttcccctacacacaccagaactgggaagtgcagtacagtcgtgatgctcctctgcccccccggcaagacctcaacgcccctgacctctatatccccacgatggccttcattacttacgtgctcctggctgggatggcactgggcattcagaaaaggttctccccggaggtgctgggcctgtgtgcaagcacagcgctggtgtgggtggtgatggaggtgctggccctgctcctgggcctctacctggccaccgtgcgcagtgacctgagcacctttcacctgctggcctacagtggctacaaatacgtgggaatgatcctcagtgtgctcacggggctgctgttcggcagcgatggctactacgtggcgctggcctggacctcatcggcgctcatgtacttcattgtgcgctctttgcggacagcagccctgggccccgacagcatggggggccccgtcccccggcagcgtctccagctctacctgactctgggagctgcagccttccagcccctcatcatatactggctgactttccacctggtccggtgaccccctggccccagatggcactgagtttttcattcattgaagatttgatttccttg

SEQ ID NO: 127 - protein, 750 aa, Homo sapiens
MGKSESQMDITDINTPKPKKKQRWTPLEISLSVLVLLLTIIAVTMIALYATYDDGICKSSDCIKSAARLIQNMDATTEPCTDFFKYACGGWLKRNVIPETSSRYGNFDILRDELEVVLKDVLQEPKTEDIVAVQKAKALYRSCINESAIDSRGGEPLLKLLPDIYGWPVATENWEQKYGASWTAEKAIAQLNSKYGKKVLINLFVGTDDKNSVNHVIHIDQPRLGLPSRDYYECTGIYKEACTAYVDFMISVARLIRQEERLPIDENQLALEMNKVMELEKEIANATAKPEDRNDPMLLYNKMTLAQIQNNFSLEINGKPFSWLNFTNEIMSTVNISITNEEDVVVYAPEYLTKLKPILTKYSARDLQNLMSWRFIMDLVSSLSRTYKESRNAFRKALYGTTSETATWRRCANYVNGNMENAVGRLYVEAAFAGESKHVVEDLIAQIREVFIQTLDDLTWMDAETKKRAEEKALAIKERIGYPDDIVSNDNKLNNEYLELNYKEDEYFENIIQNLKFSQSKQLKKLREKVDKDEWISGAAVVNAFYSSGRNQIVFPAGILQPPFFSAQQSNSLNYGGIGMVIGHEITHGFDDNGRNFNKDGDLVDWWTQQSASNFKEQSQCMVYQYGNFSWDLAGGQHLNGINTLGENIADNGGLGQAYRAYQNYIKKNGEEKLLPGLDLNHKQLFFLNFAQVWCGTYRPEYAVNSIKTDVHSPGNFRIIGTLQNSAEFSEAFHCRKNSYMNPEKKCRVW

SEQ ID NO: 128 - DNA, 1408 bp, Homo sapiens
atttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaaaaaaaaaaaaaaaaaaaaaaaaaaaaa

SEQ ID NO: 129 - protein, 416 aa, Homo sapiens
MASSSGSSPRPAPDENEFPFGCPPTVCQDPKEPRALCCAGCLSENPRNGEDQICPKCRGEDLQSISPGSRLRTQEKAHPEVAEAGIGCPFAGVGCSFKGSPQSVQEHEVTSQTSHLNLLLGFMKQWKARLGCGLESGPMALEQNLSDLQLQAAVEVAGDLEVDCYRAPCSESQEELALQHFMKEKLLAELEGKLRVFENIVAVLNKEVEASHLALATSIHQSQLDRERILSLEQRVVELQQTLAQKDQALGKLEQSLRLMEEASFDGTFLWKITNVTRRCHESACGRTVSLFSPAFYTAKYGYKLCLRLYLNGDGTGKRTHLSLFIVIMRGEYDALLPWPFRNKVTFMLLDQNNREHAIDAFRPDLSSASFQRPQSETNVASGCPLFFPLSKLQSPKHAYVKDDTMFLKCIVETST

SEQ ID NO: 130 - DNA, 4079 bp, Homo sapiens
ccacgcgtccgggcggcggcagaggaggaggaggaggcggtgctcgcgccgggcggtagagcggcgctgggacccatgcggccgtgacccccggctccctagaggcccagcgcagccgcagcggacaaaggagcatgtccgcgccggggaaggcccgtcctccggccgccataaggctccggtcgccgctgggcccgcgccgcgctcctgcccgcccgggctccggggcggcccgctaggccagtgcgccgccgctcgccccgcaggccccggcccgcagcatggagccacccggacgccggcggggccgcgcgcagccgccgctgttgctgccgctctcgctgttagcgctgctcgcgctgctgggaggcggcggcggcggcggcgccgcggcgctgcccgccggctgcaagcacgatgggcggccccgaggggctggcagggcggcgggcgccgccgagggcaaggtggtgtgcagcagcctggaactcgcgcaggtcctgcccccagatactctgcccaaccgcacggtcaccctgattctgagtaacaataagatatccgagctgaagaatggctcattttctgggttaagtctccttgaaagattggacctccgaaacaatcttattagtagtatagatccaggtgccttctggggactgtcatctctaaaaagattggatctgacaaacaatcgaataggatgtctgaatgcagacatatttcgaggactcaccaatctggttcggctaaacctttcggggaatttgttttcttcattatctcaaggaacttttgattatcttgcgtcattacggtctttggaattccagactgagtatcttttgtgtgactgtaacatactgtggatgcatcgctgggtaaaggagaagaacatcacggtacgggataccaggtgtgtttatcctaagtcactgcaggcccaaccagtcacaggcgtgaagcaggagctgttgacatgcgaccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaagtgccctaaccatttctaatattcaggctggatctactggaaattggggctgtcatgtccagaccaaacgtgggaataatacgaggactgtggatattgtggtattagagagttctgcacagtactgtccgccagagagggtggtaaacaacaaaggtgacttcagatggcccagaacattggcaggcattactgcatatctgcagtgtacgcggaacacccatggcagtgggatatatcccggaaacccacaggatgagagaaaagcttggcgcagatgtgatagaggtggcttttgggcagatgatgattattctcgctgtcagtatgcaaatgatgtcactagagttctttatatgtttaatcagatgcccctcaatcttaccaatgccgtggcaacagctcgacagttactggcttacactgtggaagcagccaacttttctgacaaaatggatgttatatttgtggcagaaatgattgaaaaatttggaagatttaccaaggaggaaaaatcaaaagagctaggtgacgtgatggttgacattgcaagtaacatcatgttggctgatgaacgtgtcctgtggctggcgcagagggaagctaaagcctgcagtaggattgtgcagtgtcttcagcgcattgctacctaccggctagccggtggagctcacgtttattcaacatattcacccaatattgctctggaagcttatgtcatcaagtctactggcttcacggggatgacctgtaccgtgttccagaaagtggcagcctctgatcgtacaggactttcggattatgggaggcgggatccagagggaaacctggataagcagctgagctttaagtgcaatgtttcaaatacattttcgagtctggcactaaagaatactattgtggaggcttctattcagcttcctccttcccttttctcaccaaagcaaaaaagagaactcagaccaactgatgactctctttacaagcttcaactcattgcattccgcaatggaaagctttttccagccactggaaattcaacaaatttggctgatgatggaaaacgacgtactgtggttacccctgtgattctcaccaaaatagatggtgtgaatgtagatacccaccacatccctgttaatgtgacactgcgtcgaattgcacatggagcagatgctgttgcagcccggtgggatttcgatttgctgaacggacaaggaggctggaagtcagatgggtgccatatactctattcagatgaaaatatcactacgattcagtgctactcccttagtaactatgcagttttaatggatttgacgggatctgaactatacacccaggcggccagcctcctgcatcctgtggtttatactaccgctatcattctcctcttatgtctcttagccgtcattgtcagttacatataccatcacagtttgattagaatcagcctcaagagctggcacatgcttgtgaacttgtgctttcatattttcctaacctgtgtggtctttgtgggaggaataacccagactaggaatgccagcatctgccaagcagttgggataattcttcactattccacccttgccacagtactatgggtaggagtgacagctcgaaatatctacaaacaagtcactaaaaaagctaaaagatgccaggatcctgatgaaccaccacctccaccaagaccaatgctcagattttacctgattggtggtggtatccccatcattgtttgcggcataactgcagcagcgaacattaagaattacggcagtcggccaaacgcaccctattgctggatggcatgggaaccctccttgggagccttctatgggccagccagcttcatcacttttgtaaactgcatgtactttctgagcatatttattcagttgaaaagacaccctgagcgcaaatatgagcttaaggagcccacggaggagcaacagagattggcagccaatgaaaatggcgaaataaatcatcaggattcaatgtctttgtctctgatttctacatcagccttggaaaatgagcacacttttcattctcagctcttgggggccagccttactttgctcttatatgttgcactgtggatgtttggggctttggctgtttctttgtattaccctttggacttggtttttagcttcgtttttggagccacaagtttaagcttcagtgcgttcttcgtggtccaccattgtgttaatagggaggatgttagacttgcgtggatcatgacttgctgcccaggacggagctcgtattcagtgcaagtcaacgtccagccccccaactctaatgggacgaatggagaggcacccaaatgccccaatagcagtgcggagtcttcatgcacaaacaaaagtgcttcaagcttcaaaaattcctcccagggctgcaaattaacaaacttgcaggcggctgcagctcagtgccatgccaattctttacctttgaactccacccctcagcttgataatagtctgacagaacattcaatggacaatgatattaaaatgcacgtggcgcctttagaagttcagtttcgaacaaatgtgcactcaagccgccaccataaaaacagaagtaaaggacaccgggcaagccgactcacagtcctgagagaatatgcctacgatgtcccaacgagcgtggaaggaagcgtgcagaacggcttacctaaaagccggctgggcaataacgaaggacactcgaggagccgaagagcttatttagcctacagagagagacagtacaacccaccccagcaagacagcagcgatgcttgtagcacacttcccaaaagtagcagaaattttgaaaagccagtttcaaccactagtaaaaaaaaaaaaaaa

SEQ ID NO: 131 - protein, 934 aa, Homo sapiens
MSSDEKGISPAHKTSTPTHRSASSSTSSQRDSRQSIHILERTASSSTEPSVSRQLLEPEPVPLSKEADSWEIIEGLKIGQTNVQKPDKHEGFMLKKRKWPLKGWHKRFFVLDNGMLKYSKAPLDIQKGKVHGSIDVGLSVMSIKKKARRIDLDTEEHIYHLKVKSQDWFDAWVSKLRHHRLYRQNEIVRSPRDASFHIFPSTSTAESSPAANVSVMDGKMQPNSFPWQSPLPCSNSLPATCTTGQSKVAAWLQDSEEMDRCAEDLAHCQSNLVELSKLLQNLEILQRTQSAPNFTDMQANCVDISKKDKRVTRRWRTKSVSKDTKIQLQVPFSATMSPVRLHSSNPNLCADIEFQTPPSHLTDPLESSTDYTKLQEEFCLIAQKVHSLLKSAFNSIAIEKEKLKQMVSEQDHSKGHSTQMARLRQSLSQALNQNAELRSRLNRIHSESIICDQVVSVNIIPSPDEAGEQIHVSLPLSQQVANESRLSMSESVSEFFDAQEVLLSASSSENEASDDESYISDVSDNISEDNTSVADNISRQILNGELTGGAFRNGRRACLPAPCPDTSNINLWNILRNNIGKDLSKVSMPVELNEPLNTLQHLCEEMEYSELLDKASETDDPYERMVLVAAFAVSGYCSTYFRAGSKPFNPVLGETYECIREDKGFRFFSEQVSHHPPISACHCESKNFVFWQDIRWKNKFWGKSMEILPVGTLNVMLPKYGDYYVWNKVTTCIHNILSGRRWIEHYGEVTIRNTKSSVCICKLTFVKVNYWNSNMNEVQGVVIDQEGKAVYRLFGKWHEGLYCGVAPSAKCIWRPGSMPTNYELYYGFTRFAIELNELDPVLKDLLPPTDARFRPDQRFLEEGNLEAAASEKQRVEELQRSRRRYMEENNLEHIPKFFKKVIDANQREAWVSNDTYWELRKDPGFSKVDSPVLW

SEQ ID NO: 132 - DNA, 161273 bp, Homo sapiens
gaattcatgaatctagacaatgatcatcaatggctattatttgtgatgggaagaagaagaagaagaacattcacagaatattaaatatatttcattgcatcctgggctctcttttctttcttttgtttttcaatttttattttagattccagggtacacatgcaggtttgttagaaaggcatattgcatgatgctggggtttggagtatgattaaacccaccacccaggaagtgagcatagaacccaataggtattttttcaacctttgccccccttccttcccactcttgtatttccaagtgtctattgttctcctccttatgtccatgtgtaccccatgtttagctcccacttataagtgagaacatgtgttatttgattttctgtttcttcattacttcagctgcatccatgttgctgcaaagaacatggtttcattcttttttatggctgtacagtaatccatggtatataagcattaataccacattttctttatccaatccactgttgatgggcacctgggtggggtccatgtctttgctattgtgaatagtgctgcaatgaacatacaggtgcatgtgtctttttagtagaatgatttattttcctttgggtataaactcagtaatgtcattgcttggttgaatagtagttcaattcttatttctttgagaaatctccaaactgctctccccagaggctgaacaaatttgcattcccagcaacaatgtgtaagcatttccttttctccacagccccaccaacatctgttattttttggcattttaacaaaacccattctgacaagtgtgagatggtatctcattgtggatttgatttgcatttctctgatgattagtgatgagcattttttcatgttcgttggctgcttgtatatctttttttaagaagtgtctgttcatgtcctttgcccatttttaatagggttatttgttttttgcttgttgatttaagttccttatagattctgcatattagacttttgtcagatacatagcctgcaaatatttcctgccattctctaggtcatctatttactccattgatagtttctcttgctattcagaagctcctcagtttaattaggtcccacttgtcaattttagcttttattgcaattgcttttgaggacttagtcataaattctttgccaaggctgatgttgagaaggatatttcctaggctttcttctgttatagtttcaggtcttacatttaagtctttaatccatcttgagttaatctttgtatatggtaagagataggggtccagattcactcttctgcatatggacagccagttatccagacaccatttattgaatagagtccttttcccactgcttactagcggtagatgtgtggctttatttttgggttctctattctgttccttccattggtgattttctatttttgtaccagcatcatgctttttttggttaccatagccttgcagtacagtttgaagtcaggtaatgtgatgtctctgactttgttctttttgcttaggatgctttggctatgtgagcttttttggttccatacaaattttagaatagtcttttctatttctgtgaaaaatgaagttagtagtttgataggaatagtgggctcttttttctatttatattcacctccagatgatcacatttggtcccagccttttcatacatctagccattgacaacttccacatttttatctccagagctattaattccagtgaagttctggatttctatattcaactgcctcctcaaagtctctacttggctgtctaaaaatttctcaagtttaacatgtacacaacagaactctttacttctctccaaaaacctcctcccacagtcttccacatgtgagcagatgaatctaagccaccatcatatctcatccagtgatagctgatgtccatataatgagttcttcacacaacatctagggtgcatgaacttttcaaaattcaaatcagataatgccacttccctgtttgaaacctttgtacagctttctgatacactcaaaaaaattcaaacattttttcatggcctcctccttcttggctgctctgacttcattttctaccacactttccaatgcacacgcttctcaaatcttcttattgttccttgaaagaagcaagctcattcctgcctcagggcctttgtatttgctattcccctgcttggaactcggttctaccatctacttatggctttgtcctgcacttcattcagacatccttaagaaggcttgtccaatctatcaaaaatagcaccttgcatcctcccactgtccctgcccatactcttactctattttatttttttctttgaagttattactatttgatattacgtatttgctcacttgccagaatggaagcttcatgaatgcaggaattttgtttgccttgtccattgctgtttcttcagtgcatagaagagtcattaccaatgagtgggaactcaatacgtatttgttaaataaacaaattgattaatggattattgttgtgggaagtcagggaccccaaactgagggactggctgaagccatggcagaagaatgtggattgtgaagatttcatggacatttattagttccccaaattaatacttttataatttcttatgcctctctttactgcaatctctaaacacaaattgtaaagatttcatggacatttatcacttccccagtcaatacccttgtgatttcctatgcctgtctttactttaatctcttaatcctgtcagctgagaagaatgtatgtcgcctcaggaccctgtaataattgcattaactacacaaattgtacagcatgtgtgtttcaacaatatgaaatctgggcaccttgaaaaaagaacaggataacagcaattgttcagggaataagagagataaccttaaactctgaccgctggtgagccgggcggaacagagccatatttctcttctttcaaaagcaaatgggagaaatatcgctgaattctttttctcagcaaggaacatccctgggaaagagaatacgcgcctaggggtataggcctataaacggccccccaggtgtggtcgtcttttatggtctgtagactgtaggggtgaaatagaccccagtctcccatagtgctcccaggcttattaggaagaggaaattcccgcctaataattttggtcagaccggttgctctcaaaaccctatctcctgataagatgttatcaatgacaatggtgcccaaaacttcattagcaattttaatttcgccccggtcctgtggtcctgtgatctcgccctgcctccacttgccttgtgatattctattaccttgtaaagtatttgttgtctgtgacccacacctattcacacactccctctccttttgaaaatccctaataaaaacttgctggttttgtggcttttggggcatcacggaacctaccgacatgtgatgtctcccccagacgcccagctttaaaatttctctcttttgtactctgtccctttatttctcaagctggccaattcttaaggaaaatagaaaagaacctatgtgactattggggcaggttccccgatagattataaacaagtgaccataaaaccttccaagtttgactcaatcacagttatgagccacatttaggaaaccctgacatacaagcattctgtcatttattgactgggtaaacttgagagagatgcctgatctccctgtgcctcagttttttcatctgtataatggaggaataatgtcatctgtttcataagagtgcaaggcttaaataaatgaataatgaagttcttagactagaacaatgcatagtataatacatagtaggtactcaataaatgtttgctgacattattattattacagaattccagattttcagtgtttaaattaagaaaatagaggaaagggccatttttcacattaaaggaatttttaaagtcataaacaataaatatgtattgggatttacaaagcaggccttaactgcatgagaggtaagaagtagcagagaaacttagaatgaaagtattaaaaatcgcttccaattacaaatcactatgaaataaaaataattatgaaaatatgaggtagtcattcagatttgattaacaaccaaaataaatcagtttatatacaacttttcaggaatacacctacagggtaaattaaaagacatctgaactcttcaatacttaacgtcaccataatcggcaaagacagatggagccctttcctcctgcccttgccccctctattccacataaccattatatccctctcttactaacaacttctatcttgaaggcagcaacatgattcatgctatagcccaggcttatcatattagggcaagaccaatatacttagcctgaaaacagggttccacaaatgaaggtgcttgattagctaagctacatgttaagaaatcacttctgcactaaaagtaaagccaaaaattgaagccaaacctgaataattttgataacacttgcttttaagtaagttgtttctgcatttatctcagcttcatttcctacacgtcactgaggggaatttttcctctttttatcatccacaattattgttctggcattttgttgttgtgttggtttgtctgttcatttgctttcttgctttgcttgcatcctgacggattaaaaccatcagggtgagattctgctacaatcttcttcagccaaacttacttgccaagtatgtagcagtcttcctgttcccacatagcaacctcccatcttttcttagtattttgaagcatgccaaagaaagaaaatgatactgggtgtctcaacataccttaagatttggccctcctgtccctcaaacaacctaacaaacaaaatatagccatttacagagcccaccacagctcagcaaggcctactacctctgttgactccacctctgggggcagggcatagctgaacaaaaggcagcagaaacttctgcagacttaaacatccctgtctgacaactctgaagagagcaatggttctcccagcatggcatatgagctctgagaacggacagactgcctcctcaagtgggtccctgaccctagtgtagtctaactgggagatacctcccagtaggggctgactgacacctcataaaggtgggtgcccctctgggatgaagcttccagacgaagaatcaggcagcaatatttgctgttctgcaatatttgttgttctgtagtccccgctggtgatacccagacaaacagggtctggagtggacctccagcaaactccaacagacctgcagctaagggatctgactgctagaaggaaaactaacaaacaagaaaggaatagcatcaacatcaacaaaaaggacatccacaccaaaaccccatctgcaggtcaccaatatcaaagaccaaaggtagataaacccacaaaaatagggagaaaccagagcagaaaagctgaaaattctgaaaaccagagtgtctcttctcctccaaaggattgcagctcctacccagcaacagaacaaagctggacagagaatgactatgacaagttgacagaagtaggctgcagaaggttggtaataacaaacttctctgagctaaagaaggatgttcaaacccattgcaaggaagctaaaaaccttgaaaaagaggttagatgaatggctaagtagaataaacagtgttgagaagaccttaaattacctgatggagctgaaaaccatggcacaagaactacgtgactcatgcacaagcttcagtagccgattcgatcaagtggaagaaagggtatcagtgattgaagatcaaattaatgaaataaggcaagaagaaaagtttagagaaaaaagagtaaaaagaaatgaacaaagcctccaagaaatatgggactatgtgaaaagaccaaatctacgtttgattggtgtatctgaaagtgatggagagaatggaaccaagttggaaaacactcttcaggatattatccaggagaaattccccaacctagcaaggcaggccaacattcaaattcaggaaatacagagaacaccacaaagatactcctcaagaagagcaaccacaagacatgtaattgtcagattcaccaaggttgaaatgaaggaaaaaatgttaagggcagccagagagagaggtcgggttacccacaaaggaaagcccatcagactaacagcagctctcccagcagaaactctataagccagaagagagtgggggccaatattcaacattcttaaagaaaagaattttcaacccagaatttcatatccagccaaactaagcttcttaagtgaaggagaaataaaatcctttacagacaagcaaacgctgagagattctgtcaccaccaggcctgccttacaagagctcctgaaggagcactaaacatggaaaggaaaaaccggtaccagccactgcaaaaacatgccaaattgtaaagaccatagatgctaggaagaaactgcataaactaatgggcaaaataaccagctaacgtcataatgtcaagatcaaattcacacataacaatattaaccttaaatgtaaacaggctaaatgccccaattaaaagacactgactggcaaattgtacaaagagtcaagacctatcagtgtgctgtattctggaggcccatctcacatgcagagacacacataggctcaacataaagggatggaggaagatctaccaagcaaatgggaagcaaaaaaaagcaggagttgcaatttcagtctctgataaaacagactttaaaccaacaaagatcaaaagagacagaaaggccattaaataatggtaaagggatcaattcaacaagaagagctaactatcctaaatatatatgcacccaatacaggagcacccagattcataaagcaagtccttagagacgtacaaagagactgaactcccacacaataataatgggagactttaacgccccactgtcaacattagacagatcaatgagacagaaggttcagaaggatatccaggacttgaactcagctctgcaccaagtggacctaatagacatctacagaactctccactccaaatcaacagaatatacattcttctcagtaccacatcacacttattctaaaattgaccacatagttggaagtaaaacactcctcagcaaatgtaaaagaacagaaatcacaacaaactgtctctcagaccacactgcaatcaaattagaactcaggattaagaaactcattcaaaactgcacaactacatggaaactgaacaacctgctcctgaatgactactgggtaaataacgaaattaaggcagaaataaagatgttctttgaaaccaatgagaacaaagacacaacgtaccagaatttctgggacacatttaaagtaatgtatagagggaaatttataccactaaatgcccacaagagaaagcaggaaaggtctaaaatcgacaccctaacatcacaattaaaagaactagaaaagcaagagcaaacaaattcaaaggctagcagaaggcaagaaataactaagaccagagcagaactgaaggagatagagacacaaaatacccttcaaaaaattaatgaatccaggagctgttttttttgaaaagatcaacaaaattgatagactgctagcaaaactaataaataagaaaagagagaagaatcaaatagacgcaataaaaaatgataaaggggatatcaccactaatcccacagaaatacaaactatcatcagagaatactataaacacctctacacaaataaactagaaaatctagaagaaattgataaattgctggacatatacaccctcccaagactaaacaaggaaggagttgaatctctgaatagaccaataataggctctgaaattgaggcaataatcaatagcctaccaaccaaaaaaagtccaggatcagacggattcacagccgaattctaccaaaggtacaaagaggagctggtaccattccttctgaaactattctaatcaatagcaaaagagggaatcctccctaactcattttatgaggtcagcatcatcctgataccaaagcctggcagagacacaaccaaaaaagagaattttagaccaatatccctgatgaacatcaatgcgaaaatcctcaataaaacactggcaaaccgaaaccagcagcacatcaaaaagcttatccaccgcgatccagtcggcttcatccctgggatgcaaatctggttaaacatatgcaaatcaataaaggtaatccatcacataaacagaaccaatgacaaaaaccacatgattatctcaatagaagcagaaagggccttcgacaaaactcaacagcccttcatgctaaaaactctcaataaactaggtattgatggaacgtagcttaaaataataagagctatttatgacaaacccacagccaatatcatactgaatgggcaaaaactggaagcattccctttgagaactggcacaaaacagggatgccctctctcaccactcctgttcaacacagtgttggaagttctggcaagggcaatcaggaaggagaaagaaataaagggtattcaattaggaaaggaggaagtcaaattgtccctgtttgcagatgacatgattgtatatttagaaaaccccatcatctcagcccaaaatctccttaagctgataagcaacttcagcaaagtctcaggatacaaaatcaatgtacaaaaatcacaagcattcttatacaccaacaacagacaaacagagagccaaatcatgactgaactcccattcacaattgctacaaagataataaaatatctaggaatctaacttacaagggatgtgaaggacctcttcaaggagaattacaaaccactgctcaatgaaataaaggaggatacaaacaaatggaagaacattccatgctactggataggaagaatcaatattgtgaaaatggccatactgctcaaggtaatttatagattcaacgccatccccatcaagctaccaacgactttcttcacagaattggaaaaaactactttaaagttcatatggaaccaaaaaagagcccgcattgccaagacagtcctaagcaaaaagaacaaagctggagccatcacattacctgacttcaaactacactacaaggctatagtaaccaaaacagcatggtactggtaccaaaacagagatatagaccaatggaacagaacagaggcctcagaaataacaccacacatccacaaccatctgatctttgacaaacctgacaaaaataagaaatggggaaatgattccctatttaataaatggtgttgggaaaactggctagccatatttagaaagctgaaactggatcccttccataccccttatacaaaaattaattcaagatggattaaagacttaaatgttagacctaaaaccataaaaaccctagaagaaaacttaggcaataccattcagggcataggcatgggcaaggacttcatgactaaaacaccaaatgcaatggcaacaaaagccaaaatagacaaatgggatccaattaaactaaagagcttctgcacagcaaaagaaactaccatcagagtgaacaggcaacctacagaatgggagaaaatttttacaatctacccatctgacaaagggctaatatccagaatctacaatgaactcaaacaaatttacaagaaaaaaacaaacaaccccatcaaaaattgggcaaaggatatgaacagacacttctcgaaagaagacatttatgcagccaacagacacatgaaaaaatactcatcatcactggtcatcagagaaatgcaaatcaaaaccacaatgagatatcatctcacaccagttagaatggtgatcattaaaaagtcaggaaacaacagatgctggagaggatgtggagaaataggaacacttttatgctgttggttggagtgtaaactagttcaaccattgtggaagacagtgtggcgattcctcaaggatctagaactagaaatatcatttgacccagccatcccattcctgggtatatacccgaaggattatagatcatgctactataaagacacatgcacacgtatgtttattgcagcactattcacaatagcaaagacttggaaccaacccaaatgtccatcaatgatagactggattaagaaaatgtggcacatatacaccatggaatactatgcagccataaaaaaggatgagttcatgtcctttgtagggacatggatgaagctggaaatcatctttctgagcaaactatcacaaggacagaaaaccaaacaccacatgttctcactcataggtagaaattgaacaatgagaacacttggacatagggtggggaacatcacacaccggggcctgtcatagggtgggggactcggggagggatagcattaggagaaatacctaatgtaaatgaagaattaatgggtgcagcaaaccaacatagcacatgtatacctgtgtaacaaacctgcaggttgtgcacatgtaccgtagaacttaaaagtatatatatataaaaaatagcctttaagaaagatggctcttaagatataaaggaaaattgaaaattagtaaagttaaatatggcattatgattatcatactaaataggcctactgcatattcctactgtgattctttttagattgaaaatgaaaaaccatagatgtggattaaagtactgcttgagacattatgtcttttagggactcactggtaataacatatcttccctatccacctattggagaaaatgctcccgtaaaacaattgttaaacccttaaaaaaattgtttaaaacaattctactgaaacctgaatgttccttcttagaaaggtcgaataaaaattatgctttccaactgagaaattatatttcattttatgacagtaattgtctgcaggctatttgttttaaatatattaaccacatcagatttaatctggaaagctctgcaatttaagtgttcaaaaagcgtataagctaaaagcttaaatcaaggccatccatggatgggaactttttgttgttaaagagaaagatcttttgtgctattttaagaatctccttgttgaaagatcttgaatgcagtaagaaaatctataaacctcgaacacttggctgaaccaaggtcaggttaaggttacgagagggatttatccaactcatcagtctgagaacataaatatacttaaataataaaagaaacaacattgaatataagtaacctagctactcagattactatcacagtgcaaaaattcaagatatctccaatgcacttcacattttcatcactagcatcagttaaagttagttgaatatatacatacatattcaaccagaacgtaatacatttttcttccctacagagtatattttctacatcaatctaaatgtctctcttcctcctctcttatgaagacgtataatattggagatattttatacttcttcttttccttattctgtcactatatgccgtaagttgcccggtcttattgattctacttttacaataacctctcgtgagccccctcctctctaatctcctgatagtattataattcagggcctcatagcaacctatcatctgcatggctgtaataactagcccaataactggtccctgcatttagcctctccctaccccaacatatcttaaatacttctgtcagattaattttcctaatgaacaactctgatttttcatccccttgcccaaatgccttacaatctacaacataaagtctagaatccccagcccagcatttaaaagcaggatctagccacaatctatgtttaaaatcggattttcctctactttttcacagctattttttcctttgttttaactcacattcttctcctccctaattttgtgctttcctgactcggaaacagcctttccttccttctctgctgttgcagattctacacttccttcaaggctcaaggtctagctcagtgccacatcctccacaaagccttctcttaatgtctcatttggaagtaactgcttccacctccaaagtactctgaaggacattttgaaaatgcctctttctcaactttcttctgtttcttattttctttatcaactccttaagaagacaatccaactcttatttgcttttgtattttccaattgaatggcacagcaatatttgcatgctggttgactaaataaatagttgaagaaataaatatgtgtatatccaacaaacaagaggcgacatcacatcagttttatgtaaaagaagacatgatctaacacatagaaaaatactgtacttgatactgtagctagacatcagcaaaaaagaaaaaagtacattgaaaagtaataaatatttatatctaggtaaaaatataaaagaatcttttctaaggaagatctcagagtatttactttaaccaatatattttattgtaaagcgtgtgcacagtttttaatggccaaatatacccaattctttaatttttactttatttattactaatactaggatgatttggctctagaaagttgaaataacatttgaaacaccatcaattctaaatatggccaaagtgaacccagaatctggtaattcatttcctgaaaaatagagttaaagtcgatgtttcactatgaacctttgaaatcatcatcaaattcatttttttcatgtgtgtctagtgaagttcttggtatataaacactcataaacaccacatattggatgaatgaatgaatcaatcaacaagagtgctgatggtagttgtagctactaccctctgagtgataatcctataccaatacattgagctgacaaacagctgcacagaaataggtgctcagtaaatatttgttgagtttaattcacataattttagagctggccagtcacagtggttcatgcctctaatcccagcactttgggaggctgaggcaggagaatcacttgaggcccagagttcaagaccagtctgggcgatatagtgagacccccttctctaattttaaaaatagatagatagatagatagatatcatgtacataaatagagattcataaatacataaatattaaaatatatatttaatgtataaatttatatatttaaatatataaatatatatggatgtataaatttatatatttaaatatataattatatatgaatatatattcataaatatatggaatacctctgctatccaatgttttaatatataaatatgtttaaatatatgaatatataaatataaatacatataaaatatacagagatatacatatgaatatgtatatctatgtatacatatgaatatgtatatctatgtatacatttttagatctatctaaatatttatctaatatatatagatatagatatacaaagatatgtatatctatatacattttaatatatatttatatttatatattcatatatttatatatttaaatatatttatatattagaatattggatagcagaggtatatccatatatatttatgaatatatatccatttagatctatctaagtatatatctatcgaatatatatacatagatatagatatacatagatatgtggatatatagatgcatatatatctatagttacataattttagagctggagaggaccttagaaatgatataccttctgtttattgctctctcctctatgagtacgcacagctttttgcatatgcttattgaagcacatgtactagcaaagtacttagttttcttcaagttaactccttgaagacaaagatgttgtgatgacacaccttccccacctagccagatgcttgcttggcagattgcaggcacttgaatgcttgctaagtgagtgaatgagagtgaatctaggcctctgctatccaatatagccattagccacatgtgggtatttaaattaattagaattaaacaaaatttaaaaatcagttatttagtcacacctactgcatttaaagtgttcagtcaccacatgtggctagtgactaccatattggacagagcagagaatatttccattattgcagaaagttctattggacagtgttgatctagagtatttctctcactttgcacaacagaatgagctcagggaagttgtcacttgctcaaaattaaaccatcagaagcagaactgagattaaaactgggaactcctagatcaatatccattgttgttgagtcatacctctgattcatttcagaattctaactgtatgtggccctaacttaaagctccatatgagcttatggtatgatattaggggaaacatcgtctttgtgttatgattgtcatagaagtgattttatttttgtattttacttgatcaatttgcatgtttgataaaaatatatataacaggttaaaaaaatgtacctggaagttctgtacctctggtatagaaagaaaaaataatgctaattttaaaaatactttccaggtatctaactaaataaaatattatagtattctggtcttgtgaccatttacttagaaaaggcacagcataggctctggtcaaatgtgctttttgctttggttttttaaaagcattcctctttggtttattaatttttgaaaattatttggatccaaatcaacaagttacttttttcaaaaaacaaaggggattttttaaatttaaaaacaaaggccatattttaatacaacatcaccagctattgagtgcgtaccaaagaactgcaagaaaattggtcttaagaaagaaaaaagtacaatgacagaaaacatgatatagtgcacctctaaggagatgggaaccagactaattggaaaaaaacacacatctcccaagcatttccacatacacatatgtacaggttatataagcaaagtaaatcaacaaattactaagattttccagatttggaatttaaggtgggtttggtttaaattcttaaaagattttcgcaactgttttagaaagcatcagtattttctaaaatgctctttcttagagaaagagcctactttctacaacttccataaatgtatgtgtttataaaattagtatttagtatttcccagaaagagctatccagttctgcttggcgggacaggaataattatatgaggttaggaagtgatcatccccatagctatcctaacattagaatgtgaaggaggcaaggaagtggggggcaaaattggagttgagatcacccacatgctatcagtctagagttcttagagatattacaattactcaaagaacactttttgatccactctagatatgtcttgactggaaagaagttatagaacaaatattgtggtttctgatagaaaagtatataatctagtgttgcttttaagaattacaaaggcaatttgccatcttcccatagaaatttgaaaattagatgaaaaagaactagttatgaaagagatcaagttttagaattaaaggaggtgcctcagaaagtatctggttctttccttgaaagcctttattctcctgtcagacagactagtaatcaagatgataaaatgtcagtatttaggtatcaataacatccctattcaaccataggccaaagagagaggcttttttttgttgctggttttttttttttaactgtcatattccctttgatgtaaactaaaaaactttttgcttggctgggaatgtaattattcaagctcctaggtcattatctgataatgaatcctcaacaactctagtcaagtttggttttaggcaatggaaaattaaagcaagtacttgattcagttttcttagaatatatgctttttcaaacaacccaatatagcagtttttcccaaaaataaatgatgtatggggtaaaaagtcatggactcctgatgttgatttaaattatcataattataatgttacctaagtgtatattacacataaaattaaatatcttataacttttatatcattataaaacaatataaatttataaattaaatacaacataatgtcctaaacatatgtttcaaattaacaatatttgaatgttcacttactcagcaaacatttatttgaggatctgctctgttccaggcatacagtatgtaattctagctgttataacaaacacatcccaaatttcagtggcttaaaagattaaatgtttaagtgaataagccagttacagaaggacaaatattgtgtgattccattcatagagacgcaaggtagaagagtggtttccagggaatggggagttattgttaaatgggtacagaatctcagttttgcaagatgaaaagacttctggagaaggatgggggtgatggttgcacaactatgtgactgtacttaatgccacagaactgtgcacttaaaaatggttaacatggtcaattttatgtcatatgtatttttccacaattttttaaaacagtaatgtttaaaatcacacacagcaaattaaatgctaatttctcacttaacctcacagatcgatttcctggttataaattgccaatagggacccaggcaggtagaggcttttctatcttccacatctggcgtctagcatcatccttgacgtcaacatccagctatcagatgggagaagagtgaaagggtcatatgcaagaggtttttatgggccaggcctggaagttgcacacattccactggctggaactcagtcttgcagcagcacctaattgcaagggaaactggaaaacatagtcgaactgtgtactcaagaaaacaggtttggtcatgacctagtcatctatgccatagtccatccatctgataccaaaaaaaagccatttcactcttcttcccaaataaataatacactcattattgtcaccaaatgagataacctaaaatccacccagtcactgcatcaagttcaaagtgcaggatttccatgtaatgcacagaattctcagtcagatctgaatataattccacatcgtcctgtaacccagttattctcaactaagaatgattttgtcccccaggagatattaggcaatgtctgaagacatttttgattaacacaactgggagtgagggggatgatactggcaactgatgggtaggggccagggaggctgctaaacctcgtacaatatacaggacagccccactgtaaagaattgtccagtctaacatttcaattagagctgtggcttatgaactaataaaatatcttccctcactcacacacaatgtataatgatagaacaaatatagtaaatacttccaggtaggaaagggggaaaagtgggaccctggcccatcacaaaaatgaaattttgcagggaggcattgtgatggctctgagctggcagtgggagctgtttctcagctacaccctgtttccattatctgtgaggaatctgcttatctgttgtcctctgtggtccctggctctgccctctggaaatttttcctctaagcccacatttaaaatgagtgtcgaggaacgtgactttcttgaggagagtacaacttttaacgcaggctcatgatttctttagcaatacagtagttcaaaaactgaaaagtatttgatctttttgcttccagtcagttccatatgccagaaacactgaggtttcctagagataattctcaatcctgattatctctttgcttcttcactcctctcttcctctcaatttaaggaggctactttgagaacatcagacttaaatgtgaagaccacaccctaaatataatctttgtttcacggctgagtcttaatgggcccttgttgctcaagagctttttcaatcttatttcctattctttgaggtatagagcagttagtttttcccatcccttgaggctccaaatttctggactctctatattccttttaatttatgcttgcaaacctgctaattattgcatgagttcatcttatgtttccaatatcttactgaatgcagccataaatataacctactaacattccatttttcaacctcttatagaactatgggtttcatagatatcttactttcttaccaaattattgtaggtataagattgatgggaaagcttcccctctgccttctgaagctttgctgaaatgactgacaatagacagattaacaggagaaaaggcatacaaatttatcagtgcacatggacagagtagtcctgcgaatatgagactcaaagaaagaccagagggttgagacttaaatatcctttttgtaggggagaggtaaagggggagtgtacgcatttttaaggggtagtaaatgcttttcaagggaattgaataaacctgtaagaattgtcacacctctggcagtaagcagtcttagcacatgtctattcactctgttgttttacctgagagttaacacacttaggataggtctataaattcaggtcatttcaagaaacatgtattgaatacccactaggtactgggctatttagaaaagatacaaagatgatcagcaaaccatccctgcctttaagaaacttgaattataagtactggagtagatacttagcctcaacattcattccaccatcctatctgaagaagttggaaagctgaaaattacatttctcagactcctttgccactcaatttttgggtgcaaataaggcctgccaaataaatttccttatgaaaacacaggtgcaagtgaaatggaggctctcttcttactgctgtgtcacttgcaagcaaggtgtgatgacatgcctgtggcattcagactcctcatagtcttgacaggtgtgagccagtggtggtggcagcagcagtagcagtgttctagtgtcagcttcccatcccagctgcagtgtatgttagtcagaataaactagacttatgctgtagtgacaagcatcccccaaaatctcagtggcttcatataataaaagttgctttctcacagacaaaatgtttcctgcaggtgtgggcagttgctctccatgtgctgacttaagaaatctgggctgcttcaatcttgtggctgctacatcttaacccaaggtctcctctataactattgtggcagggaagaggtagtctagagaactgctcaaaggcttttcactgtttcatcctggaagtgacgtgttacttctcacattttattggctagacctcatcacaaggccccactaaccgcaagggaattgggaactgtaaactcccatatgctcagaaatcaaggaggaccggatactagtgaacactagtaatgtttaccacaaagcatgtgactttgaattcgacagtctgctgacctcaaccccttcagcccttccacagatttcagaagcagtgaagtgcctgaatgaaatccctttttttttttttttttgaaacatccagagtggtttcagcttcctatggtgaaccctgactgtatcctttgtgtgctagtggctttccatccccttacctccaaccattctctacctttcagtgccctactttgtgccccaggagtctgtcctgtatgaactgcatgttccgagcccctctaccctctggccttggttggttttggatcatgggaagcaccaccaagagatcagaaagtaggaggtgagagaaatcaggatatttatcccttcttcctttcaacttctcaccagactgtgggtcccttaccctgtcaactctgtgaagagtcctttcattaaattttccccatttaaacacattgaatatgatatctgtttcctgccttgactatgactcctatcaggggtttaataatcaaaccatgagtctaaaaaacagtaacagactgtctcctatcttccattttataaagtagaagagctttacaaaatgtaaatctgaatatatcatgcttcttctttaaaacttcaatggctctttgttaacccctgtcactgtacccaactctaagttgcagccagacagaactaatttcagttccctctgcaacatggtctctcttcctttgagcctctgcacagacactacctccttcctggaaactgctccccacccatgctcattattcaggcctcagcttaaaggcctgaattcaggcttcacttaccctagaaggcattccataaacctactacttatccctgttagcttttatagtctcccacagcagtctccactcaccatcatacacagacagcactcagtgttacattgtactgcaactgcctgcttacttctctgtgtcctccagtagaccgtgagatctaagacagggacggcatttcaaatccataggacctattaaggtgcttggcacctaatagacactcaataaatattggatagttcctgaatgttattgaaaaagattgaactgtcctcctctggtcaccattctctctctcttttcattcgctgacaaaaaaatcagaaaaacatcaataaaaatataatttttatttacccacattactttgtcactatcttacttttcactgtcatcttttcacttactttgtcacttttcatcttactttgtcactatcttttatgatgacttctcttgccaagattaccaatgacctcctagaccttcaattcagtagcttcttttcagtccaaatcctctgggactgctctgcagcactctcttgaaatggtcctctgtcctacatggatcacagattgctctctctctttctttctctctctcttctctctctcacacacacatactcacataccacacacacacactttagttgatctgtttgcatatctctgtttttctccattcctttataagcccctatgtcttattcatttgcatctctagtacccagcatagtgcctggcacacaatagaactttgtaactacgaatgttacatgattaaaaccgtctgggcttccaggccatctctttcttcatctcctttttctcttgactgcttgttcttaggcaccttcacgatctcctctttgcctaccctttaaatattcttcagagtaactcatccttatccaccttttgggcttcagccatcagcgattacctcaattcccaaatgtatattttcaattgccaatgcatttttatgagctaaggctgcctctctctccctagatgtactgcaagcagatcccataaagactcattatctcttccattcccaacctgccctcctcttgctttcaatgttcagtcaatgaaattaacattcatccagtgctctaaatgacaaatctcaaagtccccaaatgcatctcactgtctttgccccctgtcctgcagggtaagaagctttatccattaccaaatccccacccccgaacctgcctctgaatctttttttttttttaatttatttctcctagaacaacttaccccactttgtcccaaatcattttcatcctttgaaattcagaaaactgattaacttcaattaattgcttctctgagttctacatagcttggtgctaggttgtgtttttttaatgacctgtctaaacatgtcttcctcactagattgtaaaattcttgagggcagttattggcttttggttatggggtctagccgatgattgacattttaagcaatttttttatatgaatgaatgagtaaacgagtaaactgagaaagaaaatattttcaattaaaccctttcagaattactgtggcagaatctgagtgaaaatgacaataactcagtttaaaaacatgaacatcacgtaaccaactttgtaacattcattgtaacaatacatgcatgattacagaaggcaggtaattgttattcccctagggagatttttttttaagcctgctctgaagattttgttttgtttttaagacaggggcttgttctgttgcccaggctagagtgcagtggcgcgatctccgatcattgcaagctccgcttccccggctcaggctaacctccctcctcagcctcccgagtagctgggattacagcgtagccatgccagactgcctgcagaatttgattttaagcatttcagttctcagtatagacagacaaatttttaaagggagggtattattttaactgcttctttgctcttttatcttttgtcctgggtgacaggaactagataagctataccccagagaaagcgcctgcagcagtacggtgcctgggcccttgatagtccctcagcacatcattttcctttttcctaccttatcttccttttatatttgaaggctcgtgaatttagagtacctaacggaaattttagttttaggatttcaatttgaccaaaacaacgctgagattttaattgcctctattaacccatggctctcaaacccaaaggaaagaaaccactggagggggtgggggagaaaggaggcggtgcaaaaactgaaaagaaaggcggagaggaagcggtagaaggaagctttctctgtcgggtttgtctttttttaaccccagaaaggcgtgacgtgctaactgccgtcgcgggttagagtccgcggccaagcccgcgcccgcccacaaagtccccgccctccctccggcttccgccccgccgtgcgctgcaggccgcggccgctgggggcgcccccgacccccgaggcgctgaggcggcggttcctcgagcctcgcctctcccgactcccagacgggcggcagcggcggcggaggcggcggcggcggcggcggcgagctgagcaccaaaagggcgctcacctccccgggcgagctgcagcacgaccgctccccgcgggcggtcggggtccgcgccgcagctgccgccgcgttccggcccaggctgccgcgagaggcggcggcagcggccccggccgcggccggcctgcggcgccccccggccgcgcccccgcgcacagctcgcggccccggccatggggctgggctgatccggggctcggccaagctgaggcggcggcgcccggccgtgcgcccagcttgcaggcgcctggctctcacgatgatgaagaagaagaagtttaagtttaaggtggacttcgagctcgaggagctctcctcagtgcccttcgtcaatggggtcctcttctgcaagatgcggctgctggacggcggcagcttcaccgccgagtcctccaggtaactcgcctcccgcgccgcctcgcccctttctgcttggccagggcttgttggatgggcagcatctctccttggcccatttgctcgcctttccctagggaccgctctaaaatcagtcgaatttattgatctgcaaagtgctttgcaaatgggttcttctcagctggccttggttcctgcgctcctgactccagatggtgcctggtatctgctcttccctcccaaatcctctaggaatgggagcaatggccagagagggaggatgcttctgttttctcttaagacatttccatatttgtgaaatgcaaagtagaacttgagctgttaaaaactaaaataacccaaactgcaggagttccaagagcccagctctgaacagaaacctgtgcttagcacaattccttctcccttgtagattacaaggggacttggccacccactctgaggctggggtaggcctggccaggcttgacttgagtcaagtgctcctggcagacgagacaacggtctgtgcctcatcagagagcggcgtctccagttaggcgctaatgctggatgaattagtcttgaagtggccactagtaggtctccttgtgggagggcttagagccagatggggagcccaggccctgccctcattttaaaatgagcccctgggcactcccagagagaggcattagcaggttacagaatgaagctattaaataataggtgtggcattaataataggtgtggcagtgtttcttgagtaatttcagagctactcacaggttgacagatgtaccctaaggtgctttctttaaaatatatacatagagagagaaaacaattttttaaatgaacttttgagttcctgagatcaagaagggttaaaagttaatgttattttgcccatatatactggtcttaggctttatttctgccctaaaaatattctacttaaaaaaaattccgtcatcccatttatagtataaaggaaataatgtcactggattgtggaattggggctagaaacttgtctttggggcaatattgaagcctatggaagccagaaaatgtctagttggctaaaccaaaggatatatgaaattaatagtttgccgaagacagtttttaaaattaaactgtggtgacacatcagtggatattcagctaagtattttaaacacctgtaagagaagaatgtaacctattttggtgcaaaaaaaatattggaccatctcttacttgttgaaaagcctaagccgattcgtgaaggtcctgttggtgcaggtgacagtcttgccctgaggcctagactgttttgctgcagggtgccacccccgacgccaggcagttagactggcgctcctgggccagtggtgacacctggtggtcagggcacttgtctacggggcttccttcctacctcagttatgtttatttggcttacttcccacaagtcacttattctttcgttgtaggcagtcatttattcagcaaatatgtgttggcttctaaatatattatcttatttaattctcatagcaagtctataaggtaggggttccatttcgtagataaataaactgaggctcagaaagcataactaactttcctaaggtcccctcagctggtaagtgcgatgccaagattctgatcaggtctgtgtaacttcaaacagggtggtgccagataaaggaataaatcgtgtgccatatatgaaagtttctgaatagggagcttcctaatgactttaatgagcaaggggtatactccgcaagacttagaaatgaaaaagttgagtatcttgggttaaactcacccctttttcttccaattaaaatttgactttgatcaatttgattttaagtaagattaggaatagtgctctgtgtagccaaaccaaaaagccatatagtatgggggaaatgactcacaataaggagcctgtgcctttgacattaggtagagatagttggtgtaaagctaagagcaaggatttggaatgcggtgagtctaagcctaaaccccagttccactgtggtaaacctggatgggttacttagagtcccaaaacttctgtatgtaaaatagaaaccatcactgacatgtggtggtgtgaggatttagtgagatgatgtgcccaaaacacctaaacagtgccttagcacccagttggcatttaaagaggagaccaggaacttgtccaagaaggtccatttgcttgagatgttatatttgattcctttatcctaacaactacaaaattgttggtttgagaaagagacctcattttacaagaaaaaaaaaaaagaaaatctgaaatatctaaaggaagtgaattatttcaaaatcacagaacttttaattagtgggtgccagtcaaggcagtgcatctctaattgaacgctagattttaacttctaaaaaattgctgtatgtgccccttaaaagtcaggtgtagttaacactgtaacatttctcctgtaaaaatatgaaatgaattacatagaaaagaggtaatatagcaggcccaagactgctattcttagaaaggcctatgtacaaggctggcccttggctggcatctgggagcttgaatggtaaatggttccatacatgatacaaaactttacgtaaatgataagagtggctcactgtgcctagactgtacggagtggtttatgctaaattccatctggaattttggttcttgctaggcagcctacgtgaccagccctaatacaaattttgggcattgagtctctaatgagtttccctggtagacagcacatcacaatttaattctagagaagttaagtgtgtgctgattcgactttgtatcttttcattgtaataaaccttagccatgagtaggactgtatgctgagtcctgtgagtcctaatgaatcaccaaacttaggattggtcttggagactccctgatggatgaacctttataaaataatactcatcttgctacagaaaagccttagaggcacacagaaaattgcatatatagatataaatagagagacccaaatatatataggtcatatgtatttgatatatatattaatatatttggctttgtacaacaactaaacatgcagatcatttattcttggccaagtattagttgagcatttaccaggtttctattaatagctctccatctgggattgtgagaagtacaacaaatataaggatccacaagggaattacttctaatgaaattagatcatagatgtataattgcttgacagtagaagacagtgtgacttagtgcccaatcaatggatcagacaatatattgagtgttgttgaaattctaaagcaaaagagttaatttacaactgtaatggttactgacaaccacattggcatttctgtggagcactctgggaggatgagtttgcattgacaaagtgaggatgggaggacagcttgagcaagtcatcaataggagttgataatagatcagcctgattgcagagcgttcatgttgaatggaagcagaagataagattagagaaagactttgaatactgttgtaaagagtttctttctactctctttctataaatgagagttgctttctactgctcatagggtaaaattaaacctaagattcttgaactgagttgttgtgtggttaaagtggcgtatcacctggctgacaggctgatgctatctgtattcaaggttgggtgggggggaaattagagatggggagacaaattaggaggctattaaaataacccaggcaggagctaatgagaacctgaactccgaggtgtctcatgtaagtgactgataaatgataatcttatgacagatgccttgacgccaccacagaagtaaagaagtcaggaaaattatttgttttgtttaaggggaatattgcatatggtggtggaagatatagtgggttaagttgtatgcttagcatgctacatttgaggtgacagcctgatgagtagtgggaggcatttatgcggtatgtggatttcttagatgttgtctattggagccatataggcctgcttactaaacttatttagaatttccttacattgtttttacccttttaaagattattagtgaaaaaaggccaggcatagtggctcatgcctgtaaatcccagcactttgggaggccgagacacgcggattggttgagctcaggagtttgagaccagcctgggcaacatggcaaaaccccatttctacaaaaaacataccaaaaaattagctagatgtggtggtgggcacctgtaatgccagctactcaggaggctgaggtaggaggatcgcttgaacccgggaggcagaggttgcagtgagctgagatcaccaccactgcactccagcctgggcaacagagtaagactctgtctcaaaaataaataaataaaaataaagattattagtgaaaattaattttagaagccagtttttcttggtattgttttcaatgaagagattggaaaaatataaagactaaaaggtaattatttgtaataaatattattaaaatggtcagggtaaattgtcagatttttacatgccatagttaataaaatatttggaaaatacattgtacgattatggtggtctattcaactgaggctaaattgttgtctaataaaatacagtcatgtatcagttaacaatgaggatctgttctgaggagtgcatccttaggcgatttcatcattgtgcaaaagtcatagagtgtacttacacaaacctagatggtatagcctactacgtgcttagactatgtcgtatagcctgttgctctgaccacatcgtgtatttggtctgttgttgaccaaaatgtcctcatgcagtacatgactgtatttctgaagatgtttcaaaaggacagtattattgtatttaaatcttttcaccgtacttcctttgcaaaagcatttaaatcacttttaaggtttattaaaactggcatggcaggtttaattctggcctacttaaacaaaggaataataggaagaaattttttctatatcttttagaattccctagtttgccttattttgttcatctttttttttgtgctgatagccaaatagttttctaagtttcacatgaggctgtggcagaaacacatgtgaatttggggagtgtctgggaagctgatgagcacatctatgtattggaccttttactctaaacaagcggaaaggatttctttcttttggccagagtacatccttctgttttcaagattttagttcactgcacattgtgtatttctttttagtaaacatttctttattgaaaaagtaatacagattcatatggacaacttagaaaatagaaaggcagaaagaaaggaacaaaaattgcccataaatgaaccacccagggataatcactattataaatattttagtatagaaattaggagcctttattgatctgtacacatacatgtatgaccacactcccccacacaactatcacataccctttttaagccaaaatgagattatactatacttagtatggttttttacttcatgtatcttttcatatcattaaatattcaattacaagattattttaatggtgcatattattctattgtatgagtttccatgacttattgaaccaagtcacttttgaaaggctttctcctttcctttcttttttgttaatagttttataaataaactacaataaacatccttataaccaagcttggtatacatccattattatttatttaggattaacacttagaaatggaattatagagtcacagggcatgcagatttttaagggttttgatatatattaccaacttgcccttcagtgcattaaattgattttttaagattagtaatcactaataagcagcaaattatcaaaagttactagtagtagaaagtactgtctgaccatatggcacagaattatttatacactagatccagcaaccccacttctgggtatacattcgaaggaattgaaatcagtatgttgaagagaattctgtactcttattgtctttgcagcattatttacaatagccaagttattgaaacaacctaagtgtctgtaaacagatgaatggataaagaagatgtggtatatacaatggaaattattcggccttttaaaaaaaaaaaaggaaatcctgtcatttgtgacaacatggatgaacctggaggacttttgtttaaaatgaaataagccaggcacagaaaggcaaatactgcatcatctcacatatatgtgggatataaaaaaggtgaactcatagtgggtgagggcacggagagatggggaactgttggtcatagggcacaaagtttcaattaggtggcatggatatgttcagatctgttgtacagaatgctgactatagttaataataatgtattatacttgaaaattgctaagagaatagatcataagtgttctccaacagcaaaaaaaataaatatgtgagttgatggctatgttaattggcttggtttagcaatttcacaatatatacacatatcaaaacattacatagtacacagtaagtatatacaatttttgtcaactatattttaatatagttaagtaattaaaataaaaaattttttaattaaaaaattccttataccctgaccagaaatggagtcatcaattcacattattataatacctgtaataatagtagctgacatttatttgagcactttcccagtgcgtcaggaacttttctaagcctttacatttaatcttcaagatattcccgtgaggaaggtgctattattacgtcattaccattattagtgcccttgccattattgctgctattactctcattttatacctggggaaacagaagcacaaagagatgctaaaagttactcagctagtaagtggtagagctaggaggcattctagctccaaggaccactgttaatcactaaattctactgcctttcaggctttgtgttgtatgctttctcatttttatgttttataaaaatggtaggtaaatatatgtagtataactttttctgaatgtcagtttcagaaaactggttccaatatgtgacatcactaaacaggttacaagacctggcccctttagattttccctgaggcaattgtatatgaaagataagtaaaatgcagcgaggcatttttatgggctcatgcctgtaatcccagcactttggaagactgaagcaggagggtggcttgagcccagaaattcaagaacagcctgggcaacatagtgagaccctgtctttgaagaaaatttaaaaattagctgggtttcgtggcatgcacctgtgttcccagctactcagggagactgaggtgggagaatctcttgagcttgggagattgaagctgcaatgagccatgattacaccactgcactccagcatgggtgatggagcaggactctgtctcaaaaaaaaagaaaagaaaacaaaagaaaagaaaaatggtactcatgccactttttttttcaagatgtggctttgtacaactaagttcacaaaatttagtcacattattggatagtcatatcttataaaaatagtattaatgccattttacaccagtaagttaatattcaccactgtatcactgagccttacatagccagcattttgtaaatattgaaagaaagcaaatattgggagaaaagatctgttgtagttttgctaaagatgacacacatacagagatcactaaattaaatatatggggaagtagatcatgttttatctacacagcttgtaaaaaattatgttcggtttggggtgcaggcctttgagggttatcaaatggaggtccaaggaagatattcggattcttaagaatcttgaattatgctaataacaggagactggggttagtcttgagagaagataatggtcttcaaatactaaaaaattgacttgtatatatgtatattttacattcctaattttatttgattcttacaaaacccctttaatagaagtaggaaaccattgtcacctgtttttgatttagaatggatgtcaggtgctataacaaggtatttttaaaaaataactggcttaaccaagatagaagtttacttctctttcatatgaagtccaacctagtgtggtagctgtgctctgtccagttgtcaggggcctggactctttttgtcttattgctctcagggtattgttctcatccacagggactgacttggctcaccccacatccgaattccagccactgggaaggaggagaggggaagggaaggtcccttgtgctcacagtccattgaccagaacatcagcaccatgccacatccagccccaaggttgagaaatttagtttttgctgggtgcctgtatgcctaacgaaacactgaattagaataaagggaggagaggacagatatcaggataattagcctctgtcataccactcttttagacatgagaaagttgatccttagaaaataatttgttcaaagtcacatatcaactaatgaaagatatttgaaaaattgtgccataaagaaggaatagactatgctgggtgcagctgaggacagaactaggaccagtggggagatgttaaagaaggcatgtttctattcagtataacattaaaacaaataagttctaacatttaggagagtaaaatagtgagtagactacctcagtactactaacagttgaatgacctcatccatttgtcaggaatgttattcctcgttaggaggatgggtcatctagatgatgatgctgattattctttttagaggcagttactctgttgcccaggctagacaggcttgagtgcagtggcacgatgatagctcattgcagccttgaattcctgtgctcaagcaatcctctctcctcagcctcccaagtagctggggctacaggtgtgtgccacatgaacatgctaaattttctatttttgtagagatgtggtcttgctatgttgcccaggctggtctcaaattcctggcctcaagcaatcctgcctcagccgcctaaactgctgggattacaggtgtgagtcactgtacctagcctcacctaaatgattcttaaggccctttctaactccaaaattctatgactaagctttcaattttgtcttttaatactactcttcctaaatctttcactatagctgggactggacagcttatatcagccaattatgtgtgcatttgtgtctctttgatatcctctccttcacccttcttttagtcagtccacatttcagccattctttaagatctaaatcagttatcttctcagttttatacccatacgtgtccaacctacagtccacccacggctcctaacattactacacatactgtatccttaattaatgttggttatttgttgaatgaatgaaaacttttctcaccatcccactgtgatttcacttgtcactcaattcttacagttcttgttgctaccagtcatttcacaccaaatttactcttttaattaccttcatgaaaaattaccatacagtgtacaatttgcagtaataaatataaactcaagaataggtagaaaggagaaagtgtttaactgggattttttgtgggggtgaggtcaggggaagtgtcatggaagagaattccttagcagggtttttttaaaagtctagctggaggagaaaacagaatgataaagggaacagaagacacagtgacatgaagcagcatgttgtgttgagggcacagtgggtagagtggtgtataactgctgccacatagaggaagggagaggaagtggtcatttcaaggagcctagacttggttctgtgctgtagtctagggagccaaaagcagggagtgatatgcaaagttagtggtttggtttagggttggaattgaagagaattctcatctgacacatgaccttagctttctcagtagcaaccaagaaaggtagaataagggatgtgaggataatgatgaaagatcagaaaagcttccacaaggaatgggagaggaagctgaccaaagacaagtccaaaaggcccaactgaaatttaaaaacatgaattttaatgatggcagtatacgtgttcatgcagttttctccagcagtgcttgtatgtcagggataggaggcagtgggtagtagaattgattcagatttggaagtttatgggtatgtggaaaggcagttgggagtactggtgagaaaggaatctaaagaatcagtaatggggtccagatttcatatggagcaaaaccaggccaggaagataaataaggaaaatatggaacagttggaggatgaaggccttagtgatgttaaaggaagatatgtgtggaaggaaagatgctgtgcagaattagttggtggggaggggctgtactcagagtgggatattaacgcttgggattacttcagtagagcaggccacagttggcagggtatggatgttgctgagatggtgtgaagaatggcatagggcaaagaaccgtgagtctagggcgtgttgtttgcatgatattacgatagccagaatgattgcaggtgttggagtgaagagagaaaaattgcaaaacagctacttcactgtcacatcaacctggaggggaagagtgtgacataagccagacatcacgtgcctcaagcttttaaaccctaagcttgaaagtagtagagttacagcctgcaagtggcaatgagagtgccggcactgcctctggacctgtggaagatgggggtggagaataaacatcacctctgctgtaggggtacaatacagctagtgtcctcgtgagatagccaggtttcggttagacaataagaggagtgttctatgaagagactaagagtatgagggtttgtttaatcctagaacagaggtttcaggtggttatcgtggaatgagttgggagagagaggagcaacagaatgagttgaagtgaggaaaaacagaacagtaggacagagaagattgaggatttagggagaataggtgaccaagactttcatcttagatttttcctacagattacagggatgaaaggtataatttgaactgactggcctcaaaattttcagtgtggatatgaaataatttagtgtcaagtgatacaagacagtttctctggctgctacttcttggagtgtaaaaatgaggttgcgttaggtcctgccgcccacttcctaggaggtcatgccttcttttattgtccatccctccttttattgtccgtccttcctccttactgtctcacacccctctgctgacaaacttaatcttcatcctcaccagtcttttaactattatttcagaggatgaactattcttccttctgttccttgccatttctctgtatctttgatcctgtccttgtttaccttccttctccttctctatacaattctgatacaaacttcatgagaaaaataactacatttcctgtctcttaagcattcctcctctgccctcaatcctgcactctgactgctgccccagcactcaactaaaactgtttttgctaataccatcagtcatccctgattgccatgtctaatcagtattttctcatttgtacctttgtactgtgtttgaaacattctgaaaattacctatttcttgaaacttgactatcttgacttccatgaatcctattcttcacatctctaattccttctctgaattgcttgaaggcacttcttctgcctgccctttttttatagactttattttcagagcaaaattgaatggaaaatacgcagagtttccatatacccactgcttcccactcacatagcctcccccactagcaacatcctgccacacggtcgtacatttttgccagtagagaacctacattgacacatcattatcacccaaagttcacagcttacattagggtttactcttggtgttgtacattctagggggtcggcaagtatctaataacatgtgttcaccaatctagtatcatacagaatagtttcactgccctaaaaatcttgtgtgttccaccttttcattcgtctttctcctctaatccttgatttatttgatttattttattttattttatttcttgagacggagtctcgccctgtcgcccaggctggagtgcaatggtgcgatctcggctcactgcaacctccacctcccaggttcaagcaattctcctgcctcagctgcccaagtagctgggattacaggagcgcgccaccacacccggctaattttttttgtatctttagtacagatgggctttcaccatggttttgccttttccagaatgtcctatagttggaaacatgcagtatgtaactttttcatattggcttctttcacttagtaatatgcatttaaggttcctcttccttcatggcctcgtaattcatttctttttagcactgaataatagtaattatctggatatactatggtttacccattcatctacatatcttagttgcttccaagttttggcaattatgaataaagttgccatacatttgtgtgtgcatgtttctgtgtagacataagctttcacctcatttggttaaacactgaggagcatgactgctggatcatatcagaagagtattgcccacccatctttaaaggcttccacaggatttgtgaggcaatgagggcaattattaggattctactttgcaaataaataaagatcagaaaaggcaaatgatttacccaacattatactagtagtaagtgatagagcaagtctaaaattcaagattcctgccgattcatccaagactttttcattatcttatgtgacctctttattacgtaacagagaaatagagtttagatttctcacctggaggtccaagccaagaactgctacacaacccttgaaaaactacagtacctcatatagccttggctgggaaagggaataggctggaaaggtaactacagtctttgttagggcctttagtgatgaggatattagagtctccaataaatccaagaatttgtttgtatttacaatgtattaggccaagagtggaaaggcaactcatagaatgggagaaaatatttgcaagtcatatatttcataagagattgatatcaagaataagtaaagaactcctacaactcaacaacaaaaacaccaaacaacccagtaaaaactggacaaaggacttgaatagacatttctccaaagaagttatacaaatggccagaagcacaagaaaaggtatacagcatcacttatcattagggaaatgcaaatcaaaaccacagtgaggtatcacctcttactcattaggatggcaactatcaaaaacaaaaaacaaaaacaaaaaaataacaagtgttggcaatgatgtggagaaattagaacccttttgcattgttgggaatgtaaaatggggcagcccctatggaaaacagtatggtggtccctcaaaaaactttaaaccagcaattcttctggatgtatacccaaagaattaaaagcagggacttaaatatttggacacccatgttcatagcagcattattctaaataactgaaaggtagaagaaaactaagtgtccatcacaggatgaatggataaacaaagtgtggtatatacatacagtggaatattattcagccttaaaaaatgaaggaaatgccaatacatgctacaacatgggtgaacattgaggacattatgctaaataagccaatcacaaaaaaaaaagacaaatactttatgattctgcttaaatgaggtaccaaaagtagtcagagtcatagagatagaaagtagaatggtggttgccagggcctgtggtagggaaaaatgaagagtttaatggatatagagttttggttttgtgagataaaaagagttctggacattggacactactgaactgtatacttaaaaatggttaagatgggccaggcgtggtggctcacgcctgtaatcccagcactttgggaggccaaggcaggcagatcgcctgagatcaggagttcaagaccagcctggccaacatggtgaaaccccgtgtttactaaaaatacagacattagctgggcgtggtggcaggtgcctgtaatcccagctactcggaaggctgaggaggagaatcacttgaacccaggaggcggaggttgcagtgagctgagatcgtgccattgcactccagcctggatgccaagagctagacttcgtctcaaagaaaagggggggttagatggtcaattttatgagtattttaccacaattttttaaatgaataaatatttcatcccctccaaatgtttattaggccaaaccaattatttgtacattagtatattcaactaatatagactccattaaaaaaaagttttctcttatttaaacttcataatttaggaacatttcattatgaatttttctgcagtagcaatgatgagttcctgcaatcattctatcaactaatgcgatttagtagaatatacacatatgggcttaaacagtaattgatttttatttaacagttttagaaaaatccctctgtcatatgataactgtttaacatcagaggaattgtcagactgttttttaaagaggctacactgaaaaatgctttcctgatgaagattcagtgttgctatagcactctttattaaagtggtttttcacgataagcacaagtcaaaatgttattagagtcaaaatgtctgacattctatcatcccatttttgcccttcctggttaaatcctactaatcctttaaagcttatagatgccaactcttctaaggagtcttcccgaatttctcagctaaaattaataactcccttccttctgggaactttcagggattggtaggacttaaacagaaaagggaaacagttaccatatgactcagcaattccactcctaggtggaatgaaattctgtattcaagagaaaagaaaatataatgtcacacaaaaatgtgtacatgaattttcttagcaccattatttataacagccaaaaagttgaaacaaccccagtgtccatcagttgatgaaaggataaatgaaacctgatgtatccatagcatggaatattactcagcaataagatgaaatgaagtactgctaaatgcaacaacatggatgaagcttgaaaacatcatgctcagtaaagaagctagtcacaaaaaaacacattctatgattcaattgatataaaacatctggaataagcaaaatctacagagacagaaagtagattagtggttggctagggctgagggattggagagaaatgggcagtgactgctagtggatatgaggtgtcttttggaggtgatgaaaatgttctaaaattgactggcgatagtttcacaaacaatatactaaaagctatggatttgtacacttaaaatgagatatgatatgtgaatgatatgatatgtgaattatatctcagtaaagcaggcttttccattttaatgttatttgttttgtgtgtgtgtgagatacaggtgtcactgtttgcccaggctgttctcaaactcccgggttcaagcaatccgctcacctcagcctcccaagtagctgggaccacaggcacacaccactgtgcctggctcctaataaagctttcttaaaaaagcattttctgacaaaattcccctaaactaatataattcctggacaaattcattttttaatttagcaaatacctgcctacggtaatatcttgttttatctatttcactttattgtgctttgcagatactgcattttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcaatagtttactgagaatgatggtttccaatttcatccatgtccctacaaaggacatgaactcatcattttttatggctgcatagtattccatggtgtatatgtgccacattttcttaatccagtctatcattgttggacatttgcgttggttccaagtctttgctattgtgaataatgccgcaataaacatacgtgtgcatgtgtctttatagcagcatgatttatagtcatttgggtatatacccagtaatgggatggctgggtcaaatggtatttctagttatagatccctgaagaatcgccacactgacttccacaatggttgaactagtttacagtcccaccaacagtgtaagagtgttcctatttctccacatcctctccagcacctgttgtttcctgactttttaatgactgccattctaactggtgtgagatgatatctcatagtggttttgatttgcatttctctgatggccagtgatgatgagcattttttcatgtattttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggtttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtatgatgcctccagttttgttcttttggcttaggattgacttggcgatgcgggctcttttttggttccatatgaactttaaagtagttttttccaattctgtgaagaaagtcattggtagcttgatggggatggcattgaatcagtaaattaccttgggcagtatggcctttttcacgatattgattcttcctacccatgagcatggaatgttcttccgtttgtttgtatcctcttttatttccttgagcagtggtttgtagttctccttgaagaggtccttcacatcccttgtaagttggattcctaggtattttattccctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaactttcaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgacccagccttgcatcccagattcaccgaagttgaaatgaaggaaaaaatgttaagggcagccagagagaaaggtcgggttacccacaaagggaagcccatcagactaacagcggatctctcggcagaaaccctacaagccagaagagagtgggggccaatattcaacattcttaaagaaaagaattttcaacccagaatttcatatccagccaaactaagctacataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaattctccaattaaaagacacagactggcaagttggataaaaagtcaagacccatcagtgtgctgtattcaggaaacccatctcacgtgcagagacacacataggctcaaaataaaaggatggaggaagatctaccaagcaaatggaaaacaaaaaaaggcagtggttgcaatcctagtctctgataaaacagactttaaaccaacaaagatcaaaagagacaaagaaggccattacataatggtaaacggatcaattcaacaagaggagctaactatcctaaatatatatgcacccaatacaggagcacccagattcataaagcaagtcctgagtgacctacaaagagacttagactcccacacattaataatgggagactttaacaccccactgtcagcattagacagatcaacgagacagaaagtcaacaaggatacccaggaattgaactcagctctgcaccaagcggacctaatagacatctacagaactctctaccccaaatcaacagaatatacatttttttcagcaccacaccacactgcattttttttaattgaagatttgtggcacctctacaccaagcaagtctgtcagtgctgtttttccttgtttttttggtgtgtgtgtgtgtgtgtgtgtgtgtgtgtgtgtgagagagagagagagagagagagaaagaaacccactctcttatcacccaggctgcagtgcgatgatgcattcttggttcactgcagccttgaactcctaggctcaagcagttatcctgagtagctgagactacaggtggatgccaccacccccagataatttttaatttttctgtagagacaaggtcatgctatgttgcctgggctggtctcgagcacttggcctcaagccatcctctcacctaagcctcccaaagtgctgagattacaaatgtgagccactgtgcctggctcagtgctatttttccaacagtgtgagctcacttcatatctctaggtcactttttggtagtttttgcagcatttcaaactttttcattattgttacagctcttatgatgatctgtaattagtgatctttgatgttactgttgtaattgttttggggagccatgaactgcacccatagaaggtggcgaacttagtagtgttgagtgtgctctgactgctctactcactggccattccttcatctcccttccccttctgggacctccctattccctgagacaaaacaatattaaaattaggctaattaaccctacaatggcctctaaatgttcaagtgaaaggaagagttgcacttctctcactttaagtcaaaagctagcaatgattaagcttagtgaggaaggcatgttgaaagctgagataggccaaaagctaggcctcttgcactgaacatttagccaaactctgaatgcaaaggaaaggttgtagaaggaaattaaaagtgctgctccaatgaacacatgaatgataaggaagtataacagccttattgctgatatggagaaaatcttagtggttggacagaaggtcacaccagccacaatattcccttaaaccaaattcccttaagcctactccctaactctcctcaagtctatgaagtctaagaggtgagggaagtgcaaaagaaaagtttgaagctagcataggttgattcacagggcttaaggaaagaagccatttccataacataaaagtgcaaggtgaagcggcaagtgctaaagtaagagcgcagcaacttatccagaagatctagctaagatcattgatgaagggggctatgctaaacaacagattttcaatgtagacaaaacagccatctaagacttttgtagctagagagaagtcaatgcctggcttcagaacttcaaatgacaggctcactctcttgctaggagctaatgcaactagtgactttcagttgaagccagtggtcacttatcaatgtgaaaatcctagggtccttaagaatgatgctaagtctactctgcctgtgctctataaatagaagaacaaagcctggatgacagcacatctatttacagcatagtttactgaatattttaagcccactgttgagacctactgctcagaaaaaaaaagattcctttcaaaatattactgcttattggcaatacacctagtccccaagagctctaatgaacatgtacaagataaatattgttttcatgcctgctaaaacaacattcattctgcagcttgtggatcaaaaagtaattttgactttcaagtcttgttatttaagaaatacattttgtaaggctgttgctgccttagatagtgattcctctgatggacctgagtaaattaaattgaaaaccttctggaaaagatttaccattctagatgccattaagcacatttgtgatttatgggaggaggtcaaaataccaacattaacaggagtttggaagaagttgatttcggtcctcatggatgactttgagggagtcaagacttcactggctgcagatgcggtgaaaatagcaagggaacaagaattagaagtggaacctgaagatgtgactgaattgctgcaatctcatgattaaaactcgaatggacaatgaggtgcttctctacatatgagcaaaaaagtggtttattgagatggtatctattcctagtgaagatactgtgaaaattgttaaactcacagcaaaggatttagaatagttcataaaccataaacttaataaagcagcagggtttgagaggatttttaattttgaaagaacttctactgtgagtaaaatgctgtcaaacatcacatgctacagagaaatattttatgaaaggaagagtctattgatgcagcaaatttccttcttctcttattttaagaaattgccacagccaccccaacccttaacaaccaccaccctgtcagtcagcaaccatcaacatcaaggtttgctaccaacaaaaagattactactcactgaaagctgagatgattgttggcattttttagcaataaagtatttttaaattaaggtatatacattttttagacataatgctgttatacacttaatagactaaaatatagtgtagacatagcttctttatgcactgggaaaccaaaaaatgaatgtgactcactttattgtgatatttgcttcactgcggtggtctggaagtgaacccataatatccctgaggtatgcctgtattccaggccattgaactatttatattattcttcactgcaatttttttacattatgagattattttttagtgtttattctattatctacacaaagtataaagattgtaatagctatcttaatttgtattaatctgccataatatatatagtggctataatttttattaaattcagtttttcaggactagattttacatatctaaattctgttacgaattcttaatttttttgtggcaatttatagtcagcaaatgctatcatgtgtcattttagccagtgagttttatgtttgttattactaccaataataatcatcatggtttggatagaagacttaacagaattttttctttcttaagcaaatccaagagagaattttgagcattgccctccagctctgtagcagggtttaggcagcaaagatcttcagggtagaaatgtcctgctttggggtaggacagaaacagacttgataagcgcatgaacagatacattgcagagaatatggtagctgagtgggggagcagagtagagcatatttgggggatgcagtgaaggacaagactggaaaggtcctctgggaaccagaatttggcaggccttgggtgcagtcacatgaagatgattttattctttaggtaatatgatttgaaccccccacacacactttctcctgatcagcatacaaaatgtggaaaatatataaaattagaagaaaatgttacctatcagaggtaatcactgctaatatcttaaaatatagctttccagtgtcttccattttgtgttttacacagttgaaaccaaattacatacataattttttatgctgccttttgttttttgtttttttttgaaacagggtctcactctgtcatccaggctggagtgcagtagcacagtcatagctcactgcacccttgacctccctgggcttaggtgatcctcctgagtagctaggactacaggtgcacaccaccacacctgctaatattgtattttttttgtagagatggagtttcaccacattgtccaggctggtcttgaactcctgagctcaagcaatccacctaccttgatctcccaaagtgctgggataggaatgagccattgtgtccaaccctcctgctttttttttttttaactgaacattgtaatataagcatgtaccatgttactaaaaactttagtatatttatttcaataatactatgcatattctttaatggatggagtgtaaattaagtaacagttcttctgttttggttattactgttgtttcctacgtattccctttattgctaattctgtgctgttaaacatttgagtgtaagaagcaagtgaggtatatgacagtatgtggtaagtggctgaaagtttaagtctgaaaacagacataaactgttaggattgcagaatagttaggatcgcaaacctagattttaagataatccaccgggacaagataataaagccaacgatagtatgcaggacaaaacacaagggccagaggacagaaccttggtagaaaaagacctaattagggccaatgagaccaaacattggggaggtatgtggtatcacagaagctaactatggaaagtacgttagaggacagggtgttcagctctgccatagcgtagagagatggggtaatatgagagatgctctgtttatttggcaatcagcaagtcttcagggaattctgagagaaaagtttcaatggagttgtaggaacagaaaccaggtttcaagggattagagagcaagcaggtggtgaaggagcagaagtgtggagtgtaacttcttttggaagccctgttaatgaagaaaaggagaaaaatgcaattgggtaaaagagacaagaataaacagcaatattttatttatttttaggagaaggacttgaacatgattatacattgaggcaaaggattagtgtaaatgaaaatagggatacaaatattaaaaacaaactcatgattgagagtctgtatgctttcttaaaaaatatttttttttctgtcctaaaacctgattactagtttaagaagaaattcccagacttttcctaatcaaatgctatttccaagcattgtggcttaaaaactggcttacacccaagacttattttatcttactgaaatgaggaactacccatagtatcgattttggactttgcatgtttgctttgttttatttaagtgagtcatcgctagcatagcataagaataaacgcatttagtgacattttatttctagttaacattttctgtatttccttgttcgcagattacaaccacctttcaatggcagtttctgagaattctctagtgctggtgtctaaacatggttattaacattttatctgctatttttacctttttgaggccagttcaggttaccataaggttttgtattgttaaagtatcacgtctgtgtaccatcccaggcatctttatggttaacaaatgacttacaggaagtgtacctgaatatcttatgtggacagttctgtggacatcactatttcctttatgtatgaggcagaaatacatagaaatagctttagaaatagcctcaggaagtagttagaaaagattattcatagtccttccaaaaaaaggtaattggttgcaagattttgctttaaactaaattaataacctcttataagcaatcataaattacctttataatttctgttaatagaaaagtaaacaaaatcatcaaactaggaatacagataatatgcatttgtaattatacacaattgaaaactgtaacttccgtcattatgctaatcaagtgtaagccttcctgaagcaactaggaactcagtaataactgcaatattagctcttactgtttgctcattcaagaaactgaaaattattaccaactggtagtaagtcaaaatgaattcaagagctatttttgctaagataacttatataaaccctagctgccacatgactctctgctggtactgtattgccttcaaaggaacatcagtccggcattcaaaataattaagaagctattttaactgtttgttagagtttctctaacctaccctgctccctctggggtttccttctatgtgaggagtggtgtcagatgggtcaagtaacacaatataaggcataaacatgaaatctgtttacactgactgtaatcaatatcagcaggagataccacagcaggtctgtgccactcaaggaaggtcccagcatgtatgctcactacagtccttttatatacagccatctataatctcatccttttaccaatgcatatgatcccttccatctcctccccagaccttccttcaaagtagagctatattaatagtaggctgtgctgctgtgcctttgattataagttacttcatccgcataagtgctgaattattgtaatatcattagtgtaaggataagcaagacaaccagagcagagccttcatagtacagtttgtaataactctttgtgctgttttgtcataccctggccatgtcgttggctcatttctctcttgatctcaagaatgtaaacaccctaccatcttcttacctgtatttccaagtatgtcttggtgacccgaacatattcttttgaacttactgtttaatattcctgttccagaaaactgatacattttcctcctctgatattatagagttcctttttgataattatacttgtgaaaataccaacggaggaatactttcataatatgtagcagtatttttcacagtactggaggatggcaaaattaataataatacatagcaaaaatttcattaaactcctatttcccttactctcagtagctttcatttgcaaggcagctactccagacatgcatgcagaagactccaggagtttttaggaaccagagaatcattttacccaaggactcaggaaatgcatcataggaaaagcttttgagcaatgtcttgaattatataacacttggtggtttacgcagaggggtgtgtgtgtgtgtgtgtgtgtgtgtgtgtgtgtgtgtgtaatgccatttaatttagtaagtttttataagcattttagatccagacaacatatgtttaccaatttgtacctaactataaaacatttcataagaggaaatttatacagaggagaataattacaaattactttcaacatcccttcagtgttgaaattaaacttgagctcagatctgctgagtctaaaatttgttccctcctctttttaccatgtgggtgaggctggatactaggaaaggataagaagacatttgggagggcatcctaaaggatgggaaaaccacgaaggcagacatgcaggtgcatagtgccagggcagaaaatagtgaagaactgtaggggcgcaaatttgagaggttgaaggaagaagattgaatactagctgaagagtttggtttttcgtgtacatacataagaagccataaatttattgatctggaaactggctgattggagctgtaattgaagaaactgtttacaactattattttcccacacctttttagaatatttagaaagaataagtctttttgttcaaaagtaaagtctctttggaagaacaagtaacctactaatttggtttcttgccttttcttgatttgttatttaaatttcctacacaacaccaatgtacattttcctgtttcttaagatctaacttgtaattcatttttcatttcttcaagtgttttattcagaaagggtacctgggtgatagttttttgcctaagagttatctttctttctccttcctacacaatgcttagtttgggctggtgtagaatccatagttcatatcaacttctgggttttgtgaagttatttattccctgtgtccttgtttttaagagttgtggagaacatattttcatttctatgtgcataatctgattttgaatagactgttttttagagcagttttagcatcacagagaaattgagtggaaggtacagaaatgcctcctatacctcctgtccccacatacacacaatatcccccagctattaatattcctaaccagagtggcgcatttgttacagttgatgaaccttccttgacgcagcatcatctaaagtactttaaagtttacgttaggcttcacacttggtgttgtccattctgtgttttgacaaatgtataatgacatgtacccaccatcatagcatcatacagagaagtttcactgccctaaaaatcctctgtgctccacttgttcatccctcctactcccaacccctggcaatcactgattcttttctatctgcacagttttgccttttccagtatgtcatagttcataagctaattttaatttcctatatccttgcaggatttttaccttatccgtaggaaaattttgtgtagctttcatcagatttcccagtctatgatgtgtattctgaaattttcggtatgaagtctttccttcaattaatctaggaatgtttttttctcctgttacttcatttttattgtgtcctctgcatctatattgttctagaaagtggagaggtgatgctatgtagaatttgcatagttagagcaaaataaattttgtgagtttgagttttttaggttccacatataagtgagattatgtgatatttgtctttctgtgccggggttatttcacttagcataatatcctcctggttcatctatgttgtcacaaatggcaggatttccttcttttttaaggctgaataatattccatttatgtatatacatcccacattttctttatccattcatctgttgatggacatttacgttgtttccatattttgtctcttgtgattaatgatgaaatgaacatgggggtgcagatatctcttcaaaaaactaatttaatttcctttggatatatacccagatgtggaattgctgggttatatcatggtgctattttttattttttgaggaatatccatactgttttccaaactgtaccaattggcattctcaccagcggtgtgaaagggttcccttttctgcatatcctcaccaacactttgtcttttgtcttttcgataatatccattgtaattgataggagtgttaactcattgcggttttgatttgcatttctctgatgattaatgatgttgagcatcttttcacatacttcttggccatttgtatgtcttctttttttattgtaaattgacaatttgtaattgtataagtttatggtataaaaagagatgtcataatttatgaatacaatgtgggataaactagttaatgtattcatcacctcagatacttgatgttttttgtggtaacatttgaaatttactctcttagtgtttgtcttcttttgagaaatctctatttgagtccttagcctattttttaatcaggttatttgactttttttttttttttgctattgagttgtatgagtttcttatatatttgggatattaaccccttatcagctatatggtttgtaaggtttgtaaatattttctcccctctgtaggggacatacgtttttttaatgaaatttttcatcaagacatctgtcagtcactgaataaaaaccctgcatgaagctataagactttttgtaatatagaagattataaacaagtattcagcaaatattcatttgaggtcctactgtgtgccaatcagtgctatgtttttatatgaaatttctcattagaacagttctagacaatgaacagttgtctactgacaaagttccttgcattagagctcactcttttctttttatctcctcatgatggaagaggagcctcttctcctgttcagggccagtccccctaattatcacctggatcccatcgtctggcattctcagggatgaacctcctctggcaccattattcataccctctcaaatcttttctccttactgttagtgctgacaggttctttactatcagcactaaaccatgcttaagtctcttcttacatgttaaaatgaaatcctcactttatgcatatccccatttggctgccaccctaattttctccactttattactaaaatatttgaaatgtctgtgttccctgtctctgctcctcatagtaatccggcttccatccctccttttactgaaactacacttgctagtgttattagtgaattcttcattgctaaattttttttagcctttatcttacctgacctctctgccacatttgataattcaacaattctttctttaaaggttttccccttggctttggtgacaacgtaatctcctttgcttctcccactgttgacgtgttagcctcctttgcctgtgccccttcttctcgtataccctaagtgttcatgttccttggagttccaaactctgccctcttccctttctcctctacccactctccctgaatggccttatccattcccatagcttcagtgactatttacatgctgaggtcttttgtcctttttttttttttttttttttttttgagacaagatctcagtttgtcacccagtctggagtacagtggtgcagtcatggctcactgcagcctcaaactcccaggcttaagcagtcctcccacctcagcctcccaagtagctaggattataggtttgagccatcatgtgcagcctgtcatttacatttgtattttcagccctgaccacctttgagttctaggtctgtgtatctgtctgcctcctagacatttccaaatagggaacccacaggctcctcaacctcaaaatatccaaaactggattatcatttccctcactccctaatcccactagcaaaatgagtgagtgaataaataagaaataaataaaacaaaatcttcttgtgtccaattcttttcacccatttacccaagccaaaaatatctctgatgtatgagatgttcatttatccttagtgttgtgtcacaattttgtagatctgacttatccttggagtattaaaatacttatttttgcctctgttcccacaggtttcttttttctcaagagtctgtatcttttaagaagtagaaatcttcattaatattgaaaaaaatctttccttataaatttgaccattatttcactctggtgggcaaattgaggtggactatatacatccttgataataacttgtaacatttattattgagatacactgtaagccaggcactgttctgaactcttgtgtgtaataattcatttggtttccccaaattcccatgagttgtaggtattgttacatcctgtttcacagaggaggaaatgcagaatgcagagaggttaggaacgtgtccagcgtgacagttggcagggagcagaggcaggatttgaacacaagcagcctggctctggatcctttaagctcttaacctctatgcaatactatctggcaaacagtttgcattcttcatagcagtttcttatcactgttttttaaaaagttaaaaatatactgaattaccaagacatggcataattttaaatgtgtacctagggtatacctatgcaagttattcgagaataagtaatgcattttgctggtacagtagtcacaaaaaaatggatccataattttccttttattttacttttattttttaaagactttctagattttctttgactcgtttgaaacacaaggccatagcaacatttcttctgagtcctctgcttattttatgtcagcagctgtatcactttatcttagaaatacttgggttttcacagtatcaacacaaatcatattctgttgctttgtttctggaaagtggttaagcaactgtataaaagtcataggaaattaatgactcacataacggaaaccatttactaatgtgacttttgtctcagatgccaagtagtctgagtttgtttccatggtaacccatcagtataacaaatggtcgcaaactaactttgctacttttttggttgtttgtttcatttggacagctttctgatagctgtgtgtgtgcgtgtgtgtacacattaaagattatcacacacaaaaaaaatctgagtaattgccttagttgcacaaacaaaacctttttttagagagattgtttgagaatccaaggctattttgatgttacaaaacgataaagattacttaacatatctttctacttcagttcctattaagaaagggcacacagtcatcaatttttaagcccatacatttaaaaaattcatttataatatttgtttatttgaaatgtatcaatcataggagactctgccagaaacaaggcagagagaacgggaaatgaggacactgtcttgggagactgaagactgagtgaatgatggaagaagtggaggcagccagctctttcctgcccctccctgggggacagtgctctagggtagggaaaagaggacactgagaagggaaccaaggcaggcctggtcatatgggacaccgagttgcagagagatttctagaggaggtaatgacaaaactagatgcgttagaattaaactggtgagtgcgggaagttgaaaggagagtggatggaatagaagggaaagaaaaaatcatgaacaaaggcatgcaaatgagaaatagtgtgaagtaaatgggaatgacaaacaatataagacagaaagaaagggtcaagagataagactaaagacagacaggggcttaatcataaagaggccccattaaggaggttgaacctaatcctataagaggaagcagtgaaggattttaaacagaaatgacattatcaagtttgtattttaaaaagagttctctggtagcaatgaggaagatagatctgagcggggaccattaaggaggctgttgccatgcttcagggaagagatattgagagtctgaattgtggtggtgctagacacaggaaagggcttgatttacaaataggaagtaacacaggcaagaattggtagctggaaccagtcatttgtggcccatgcctgacttcagttattcatttggtcaacaaatctttattgtttcctgtgtttggcaaatgattagtgttatgctgtactctttcccaccttcatcatttctggatttcttctccattaaggattctttgtttgcacatcatgaggtaattaatagacaactgcacttcgcatggctctagttcatcccaacctgatctcttgtcttggcttatttgactttcttactcacataagaacctgtttcagagtcctagcacatttgtcagtctactacttgggaggcagtatctatgtgttcggataggggcttattgcccaggaagtgaatcagagcttatttgtgtcttcattgggtgggactctacgggtcatgaaaaatatgtacaataggttccagtgtatttcgtctgtatacttaaatgaggggaacaggactctgggatggaccacctacaacaatgtgaataacatttgaactttgcagatttggaaatggtaagacttagtctatgtcagttaggatttagttcagctgcatataacaaaatccaaaataagcattttaaataataagatttaagaagtttgggctgggtgtggtgacttggccaggcatggtggctctcgcctgtaatctcagcactttgagaggccagggtgggcgggtcacttgagtttaggagtttgagatgagcctggccaacttggtgaaaccccatctctacaaaaaatacaaaaattagctaggcatggtggcacacacctgtagtcctagctactcgggaggctgagacagaaaaattgcttgaacctgagaggtggagtttgcagtgagctgagatcacaccactgcactcagcctgcatgacagagtgagactctgtctccaaaaaaataaaaaataaatacataaataaaaggagtttggagggagaaagtccagggctacatgtttcttagagacccaccttccttctggctctgcaccatcatcacatggcttttcctgagggtaacctcgaggtccaaaatgactgatgagaatctaatcatcatcatgacagttttccaggcagaggaaagaataaaaggtaaaagggtatgtttcaactgtccctctcttactctgcctttccaaaagttatacccaataacctccatttatatctcattagcttatactccatcccatgcctaccctgtaagctgcaagggaggtcaggaaaatgcagtcttttaactggacatattgccagtttgagtaaaatcagggttctccttttaaggaagaagagagactgcatattggataagtaactgacagtttttgccacatacgctcctgggcaaaccatttgactagtcaagctggtaggttacttactagcctgctaggaagtaccatgataaacagatgtcagagacctaaagccttatctagaggctaggactactaggtgggttcaccagttaacatgttgatatatgaatctgaggactaaagaagaagacttagttttgtttgtttgttttgttttgttttgtttgttttttgagataaagcctcgctctgttgcccaggctagtgtgcagtggcgcaatctcagctcactacagcctcaacctcctgggctcaagcaatcctcccacctcagctgcccgagaagctgggaccacaggcgtacaccaccatgctcaactaatttttatattttttttgtagagatgaggtttcaccatgttgcccaggctggtcccgaactcctgagctcaagcaatccgcttgccttggtctccgaaagtgctgggattacaagcattgagccaccgtgcccagcctgaggacttagatttttaagttctcagtacatgcataatagttaagtccatcagagtaaaaaaaatgagaaagccgccaaggacagaagcttggtggacatcaacattttaaggagacaggagcaagaaactgcaaagaaatagtcacataaataccaaggacaagaatattgtaagaatgtataagaagggtcaagtatgatactaaaaaattacccttggatttgacaattagttacttactcatgagcagtttcagtggaattgtgcggggtagaagcctgattaagagggactgaaaagtaactgggaggtgaggagatggaaaatgtctatactgtagagacagttcttcaaatttcagttccaacctttcctgctgagtgacctttgacaagtcacataatttctgtgtatcttagttcctttatctataaaatggagttagtagtaccctccccatatagttgctttgaggatttagtagttaatatgtgtaatttttaatatgtgtatttataacaatgcctgtaataataatcactcaataagtgctgtcatcattatccttagtatcatcatcttcagggagcttggacctgaaggcagagtgatagtaagtaggtgaggacatggaattgtgggaagtgtattttttcccgtaagattaaaagacatgtcctgtatgaaaaccagttctctatctctattttacactgtaattccaattacctgtccatatttataatgctgtgctgaagtttcttaatctcttgtttttttccccaagcccatcaaacttaatgttggcttcctccactctctaactaaactagattaatatttctgctaatatttctttcctgcttgtctggtttgtttcttaaaaaaaaattcacatacagagttcacttgatttctttggtttttattactcaggcgaaagctgccctccatttgtgcaaataataacatatacgattaggcatgtaaaagctactacattataagggcatttaaagtatttatatattagtattgccaaggaattccacttatttcacaaacaaatgaaatgtgacagtcatgctgctgtacttcagcctgggcagcaaagcaagaccccatctcaaaagaaaggaattaagggaaggagggatggagagagggagggaaagaataaagagaaggaagaagggagggagggagggaaagaatgaaggaaggaaggaaggaaaatgtagtggcttttacagagggagagagggaaggagggagggaaggaaggaaggagcgagcttttacagagggagagaggaggaaaggagggagggagggaaggaggaaggatggaaggaagggaggggggaaatgtagcaagttttacatgcctaattgtatggagaaagggagggagggaggaaaaaaatgtagcttttacggagggagagagggagagagggaggaaagggagggtgggagggagatgtagtagcttttacatgccaagggaaggaagggagggagggaggaagatgtaatagcttttacatgctggaaggagggagggagggaaatgtagtagcttttacatgccaagggaaggaagggagggagagagggagatgtaatagcttttacatgctggagggagagaggaagggagggaaatgtagtagcttttacatgcctaatcgtatatgttatcatttgcacaaatggagggcagctttggcctgagtaataaaaaccaaagaaatcaagtgaactctgtatgtgaatgtttcttttaagaaacaaaccagacaagcaggaaagacgtatttgcagaaatattaatctagtttagttagagagtggaggaagccaacattaagtttgatgggcttggggaaaaaacaagagattaagaaacttcagcacagcattataaatacagacaggtaattggaattacagtgtaaaatagagatagtgaacaggaagtaagggaggcagggattaggactttgctttttaagataccatccaattttcatgttagacaataaagaaaattcttagtgggttttttttttttagcaattaggaaaaaaaggcatctaaagttatatacttctgttcccatttttagattattcagtacttgacaatgtttttgaatttgtttttattttaacaaagtcataaatactaataatttagagtctaagttccacaaggcatattatggaaaagcacagtccccaacaaccgacctgtttctcacatggcccaacagggaaggagccaggagaataaatgcatcagcttccctcccttcctgccctctatccttgcaatgtttgtcactttagcacaatcggaggtagagggcaagggagcttggttgatgtaattcataagactggcgtcctggaccacagagaagggtagagtgaatctggaatgataaaatatcaagcccactagtttggatttccatgagcactttaattccctgtatgctttttttaaaaatatagcatcctattcctgtatggtagatgcagtttcttttttatatcactcagaaatttttttattcttcaagcacaggctctgttttgttcaagttgctatttttctgtttttttgtttttttttttaagactgtatcttgctctgtcacccagactggagtgcagtggcacactcatggctcactacagccttgaactgttggactcaagtgattctcctgcctcaaccttttgagtagctgggactacaggtgcacgccaccataagttgtaaattttttgttgaaacagggtctcctttgttgcccaggctggtctcaaactcctggctcaagggacccttccaccagcctctcaaagtgctgggaatacaggcatgagcccctgcaaccagccaagttagtttttttctattcatcttggtttctttcatattaagagactttcctcacttatctgcccatatttaactatgaagcactaaaagttgattaggagctctgtgtatgtggcaggtgcttgtcatctcagatttttattgtaggctgatttggctggctgtgtcattgggaaccctcaacatctgtctcatgaaatcttttctttgaggctggttggattccccagagaatattcttcccacattttgaagaacaggtgcctggttctggcattgtgagaagccaggttaggggaagaaggttggaagtctcagcattaagtcatctttcattaccccagccagcatgcttttgtgctctttgtgctctttctgatacctgccctcacttcaggctgtccagagatccttctgtttcatcttatcaggagaatacatctcagtcatctgcaggagtcagggaaggagaggtctgcagtctgactatttccaaaacagtttttgatcaatcctctgctgtgtccctccttcattcgacttcaaaacctgtttaagtttccttctcttggcttttactattgccagcatgaggttcaaatttcctcagtatgctaaactagttatcacttgtctgtctgtctctggccacttatttttgtctctagttctctttgtccctgtgagataatgcctttgcttgtttttatttagtaggtttggggagggagcagaggctaatacatgcactcaacctgccatgtttaactataaatttgtatataattttgtaagaaaagtaaaagagttttattgtaaatgttatttcttgatatctgatcatatatcagtggtctcagtgacagcaacaaccaagcgccttgatgctcagtggaccctgaagggtccaggacatcagtgtttatatctccttgttgggagctccggacaccatagctgatgcctccagcaagccttgaggccaagagatgttgggagagaagcaataataaaaaattctaggccggacaccgtggctcacatgtgtaatagcaacagtttgggagatcgaggtggccagattgcttgaggccaggagtttgagaccagcctggccaacatggtgaaaccccgtctctacaaaaatacaaaaattagccaggcatggtggtgcacacctgtaatcccagctactgttcagtaggctgaggcatgggaattgcttgagcccaggaggcggaggttgcagtgagccaagattgcaccagtgcactccagcctgggcgacagagcaagaccctgtatccaaaaaaaaaaaaaaaaaaaaaaaatctggattttttttttcttgcttatttttattactattcacagttttttaaatgtatttatttttgagtgtacaggttagcaactgccctccttaccagggagtcctccagctgcctgacaagtacctccaggtccatcctttgtcaaataacacttatctcgcctgcattgtgaccataccaataaattacaccctgcctggatttcaagggagactccactgtgaacccacacatacattcttcatatcatgattcattaaatcacttaagggttcctaaggaaaaaaaatggccaaagttatcatagtagaactggtggtagaatgcatgccctcctctcccatttgtgtgtctgtttagaacataaaagtaaacaaaagtgcacatatgacacacaaatacatacttgatttttaaattatgtttgctttttttttataattcctgttcttggatttctgtgtactgatggagaaatcagaaaaaccaggccaggtggcttacacctgtaatcctagcactttgggaggctgagacaagagtatcgtaatcctgacactttgggagactgagacaggagtatcacttgagcccaggagtttcagaccagcctggataacatagagagacccatctttaccaaaaatacaaaacttggttgagtgtggtagtgtatgcctatggtcctagctacttgggaggctgaggtgggaagatctctttggcctgagaggtcaaggctgcagtgagttgtgactgcaccactgcactccagcctgggtgacagagtgagagcctgtctcaaaaacaacaacaacaaaaaaaaaacaactgatagatcgtaataaaaatctattttattccctgaggcagctataagtttgactgcctgtcacattcaccacagcagttttcctgtctctaagcctttatctaaattttcaactcacctaccagtcctatcactccgtagatatgacttattactcccctaagaaaatcaaaactgttcaacctgggctctcttgccgttctcttttgctttctctagttttctctttatttcatctgttatctttgtctctttcctatgttagaggaatggttatctttttctaaggctgagcacccccccaccccaatacctacatacgacagcagagagaacagtatgtacaaaggcctgggagcttgaaagagcaaagttgtggaaaaatacagattctcctttgtggacaagtgggctttagatttaaacaggcctagtttgaatgccagttcttctctaccacctcctacttaaatgaccttgagttcacttctctcatcacacttcattttccttatctttaaagtgacgaggctcacgcctatgatctcagcactttgggaggccgaggcaggtggattacctgaggtcaggagttcaagaccagcctggacaacatagccaaaccctgtctcttaaaaacacaaaaaaattagcctggcgtggtggcaggtgcctgtaatcccagctactcaagaggctgagtgaggcaggagaattgcttgaatccaggaggcggaggttgcagtgagcggagatcacaccactgcactccagcctgggtgacagaggaagactccgtctcaaaataagtaaagtgaagaaaatgccagctacttcacaaggttgttgggagatttcatagcatatggtaagctctcaataaatggtagctgttcttgctgttatggctggagtaaaactatgacagtagttcatcttaaaataagaatttgcttattcctagaataagcatttgttcatatttatgcctcttgcattaactatgaatataatccctacaaggtcaggaactctgtcctcgtctttatgttttaaacatgtaccacatgcgcagcatataaagtaaatgtacattatgtgttgaatgaatgaatggtgtagcctaatgtatattttgattgaattgataagtaaattcactttttttccagtttccagtggataattaaaaccttccaaagattttcagatcacattgttaggaatttgcttccttcctgctacactgtttacaaatactggcttttaacacattacttttgcatgttagacttgagtgaaagtatgggtgtgctttttaacatgtcatcaataatagttaattaattggctctttttttctttccttcagggaggtggtacaagcaaactgtgttcgctggagaaagaagttctcatttatgtgcaaaatgagtgcaagtgctgccacaggcatcctagatccttgtatctacagagtatccgtgaggaaggtataaaaatagcctattacttcttccctttcagaaaccataattagttccgtagtcactggctggctttgtttatctctgctttatctgtttcattagaactgtatatgcagtttcacttcatgctcgctgcagtaattaaaataccatggcaaatatgatgaagaatctgaggttataaattaaaattattattcaagaaccttcatctcactgtcactatacgtataagtattaatcttacttgtgttagtttggggactgtatatatctatatccactatttgttaaattcctagtttttattaggcattgttctgggaactttatgtgtaatatatctaataaccctgaaattaggtgttattttctccattttcaggaaaaccagggctcagagaagttacttgcccaaatttacatagttaataaatggcaaagtcgggactcaaacagagttttctgactccaagtctgttttctttcctgtatattttctttcccagtattaggttgaagcaaattaccaataatctaaaaaaaaaatggtaatttcatatggttcaactttctgtttgtgtgtgtgtgtatgtgtttgtgcgtgtgtgtgtgtatgcatgtgttttacttaccaaaataatacatataatggtcaaaaattaaatagagaagaaggatttagaatgaaagcaagagtctctggccttgctcttttccacgccagttctgcgtccttgtcagtcagaataccattgccatggtattttaagtattacataaaatacttaatataatatactaaataatattttaagtattatataaaagaagccataaaagaaaaattagtaaactcaactatataaacattttatgcattacaaaatataacataaagtcttaaattaggggaaaatagtcacaaattgtgacaaaggactactttccttagtatagaaagagcactttcaaataaattaattttaaaaataaacaaccatttagaaaaataggcaaggggcagaataaacacttggcaaaaaaactataaatagcttttaaacataaaaatgtgctcaatctgacacaaaactacaaataagataccattttttacctataaagttgacaaaaatgaaaaagtttgatagtgtgctctgttgcctaggacacagggaagcaatcagtgaccagccagcagtactattccaggcactgggaggacagtggtgaactggaatgagttcctgcccccagggactttactttctggatggagttgggggaggtgtgatagggaagacagagaccatagtaaacatgtagccaaataagattatttgaggtcatgataagttttatgtgtaggaaacaattcagtaatggagaatagcttgggcaaaggagattattttagagaactgaggcaggagtcagtgaagacttctctgaaaggtaacatttgaagaaggggcaaccatgtaaaggtctagggaaaggccattctaaaagagtaggacctgaaagcaaaaaagcccctgtactagtttcctaggactgctataaataaatagcacactctgggtggctttaaacaacagaaacttactgtctgagttatggatgacagaagttcaaagtcaaggtgtcagcagggccatgctccctctggaagtgctgggggagaaactctcacacctctcgcctaatgtccagcagcctcaggcattccttgacttgtggatacattattccattcacgtgattgttttctccctttgtgtcttcacataattttccctctttgcatgtctgtttctctgtcaaaatttcctgtttttataagaataccagtcatatcagattaggacctcattttaacttgtgtacctatatgaagaccctatttctggccaggtgtggtggctcacacctgtaatcctagaagtttgggaggctgaggcaggcagattgcttgagcccaggattttaagaccagcctgggtcacatggagaaaccccatctccataaaaaatacaaaaattagccaggtatggtggcactcacttgtagtccctgctacttgtgaggcagatgttagaggaccacctgagcccagaaggctgcagtgagccatgatcatgccactgtactccagcctggatgacagagccataccctgtctcaaaaaaaaaaagaagaccttacttccaaataaggtaacattctgaggtaaggacttcatgtctttttttggatgagggagacgggggacataattcaacccataacaggccctaaagtataataaacatggagattattttaatacttctgatattaatggactagcttgttgcagaccactgctccctctgagaactattagaaaagctagacataatatccaaaacagccgcttgaaggcattggaagctagtgaggtagtaaggacttgagaggcttagaatccatagaggagggaagcatagagataagcctgacatttggcattgcttttaccctcaaagcatttgctgatttgcaagtagtggcaaagaaactgagcacaaaagaatggctgagcagcgaagacactgagttgagattgcagcaatcttaacaggtctaaaggaacaaaaactgaaatctggggacaaccaaagaggaggggccttgataaacacctcaggctttcagttgggactcactctctgagagtttcaacctagtaggaagagtgtaatacacacagatcagccttacaaagacaaacccagcctccagtccgctcaatcccttcttggatgaaggtgatctgcctcttccttactacttgccaaaagcaaatgtatgccttctcctatatcacatcactctgaacctcaaattatttcttcaagttttcatacccagttatcaagcatacgaagagacatgactacatgaccaaaaatcaaaaggaaaaatatgataagaagagacccatggaagatacagattttggaaagatcaaagacaaacttttacaataactataattagtgaacaagatggagaatttcatcagagaactaaaattgttttttaaaaaagcagcaaattaaattctaaaactgaaaagtacattaactaaaatttaaagctaagtaaatgaataaaacttcaacagatggatttaacagcaggtttaccataactgaagagagcattggtaaattggaaaatagaagaaaatattcaggctaaatcacagagagaacaagggtggaatacacaagaaagaaggtaagacatgtaggagacagtagaaaggtctaattgtataagccctaggaggagagacaagtgagtgtggctgagaatcttctaaaaccaatcaaagatatcgaaccacagattcagaagtactgtgaaccctatgcagtgtaaacagcaagtctggcatgtttaaatgacaagaccagcctggctgtggcgtgggaaacagagaggcaaagttcttggtagtgggattggacgcagtagatcaggccgggccttatgaagagtttagatctaattataattgtaagtattggaggattttaataaggagagacatcatcttctgtaagatcacttttgctgctgtgttagatgaatcacagagaccacttaggtggtttgtgttagttgaagggagaagtgcttatgttttgaatagagttaaaacatataagtggtcattattgtgcagccagttatccaactaaaaatagaggattctgttactatggagtgggggatatggatgattgggatatgactagcattctttctacagagattgaatgaaggaatagatccagcaaacgagagtgaggagttgccagtgaagtaggaataaaaccaggcaattgtggtgccatggaagtttagcgaagaaaatgatgcaacaaaggaggtggagtggccaagtgtgtcacctactactgagatgttgaataagatgaagatcgggagcctttggctttaacaaaatgaagatcattggtaatctgaagagctattataaagggccgagtacagtggttcacacctgtaatcccagcaatttgggaggccgaggaatgaggactgcttaaggccggaagtttgagacaaaactaggcaacatggcaagaccccacctctccaaaaaaaaaaaaaaaagagaaaaaaaaaattagctgggtgtggtggcacgcacctgtagtcttagctactcagaaggctgagtgggaggatctcctgagcccaggagtttgaggtttcagtgagctgtggtcatcccactgcactccggcctggttgatagagagagaccctgtctctaagaaataaaataaataaaaaatgaaaaagaactattgcagagggaaaataaggatgaaaccccaattggagtgggttgaagagagagtaggatatagcaaatatagataaatattttgatgagtttggctatagaggggagcaaagaaaagaattagctagcagaaacaaggatcatctggagaaaattttgttttcttatggaagggcactattaaggaatataacagtgacctaatgaaaatgtgatcactcataatggggtagatgtagtgggatggccacacctgaaatcactgaagcagggaaggggaggaacagcaaatattcatgaatgataatagagtttatcatagattgttccttaacatatttgtattcactgcttgaaagatggaaatgatagataatgcattatgtatctgatttatgcaagaaagataagagacaacaccatccagcagatgcatttttaaaagtaggtagggagtggggagtttggccctaataataatgacaaagacatatatacaaacacataccatgtgctaggtattgttctgagtgttttacacttaattctcacagctgtgtgaaaacaaatctaaagatttggcaaatttatgtacagtgacatattttaagttaaaaaaagacatcatctattattttttattattttccactttggccagccttttcacattaggtaagagggtttgtactatactaaatgtatacttttacatgcacagagtatctcttcaatgattcataaaaactggttgtccctggggtgtggtttcaagtcctgttgaaatctttctatattatattagtatgcttaactgagtaaataatttaacctttctttggtgattcaggtttttgcagtgagtccacaacactttttgaccatttcttcttcagcaaatagataaaatattagcttatattctcaccatttgtctcatttagattaaagttaaatgctaaataaaaattctggtcatttggggggcttgtgggagtctaaatagttggatttaagatcgtcagaattttactgtctatgatatttgccagcatatatatgtctgcttcagaattatttgacatatatttaattttaaatctttcattatgtgatatccttatagtattttctgtctttggcaggaattaaaaggtggaaaagcttatgcaaaggtaagcagatgttcttttaactgttttggaacatgtaatgttgcttattgctatttataggcttaaaaattaaattgtttactcttctaatatctgttcaagcttggctctttttgtatgcaacttggagattgaacagttggatctaacagtaaattataggcatattctttctaaatgctgattatggaatattattctttagattcagcctccctgctagaggatgatctctagtttgcattaagccatagcatgtgataattcaaaggatctcacctgggaagtgttgccaggcccacctcccccaactgtaagaggacctgtcctttatgctgtcttagcactctgtgtatacatgatcagtactgctggtttttacttttactagctatgtggaattactagagaatgtgctcacctttttgctgactagaaggaattagtaacaacattaccagaaattcacatagtccttttgtatttccagtctctgtgaatggtacctccatcaatccagtcacctgaactgagagattgtacactagtcttttttttcccctaattttttaaattttgttttttatttttgtagagatggggtcttgctatgttacccaggctagtcttgaactcctggcctcaagtgatcctcctgccttggcctcccaaagtgctgagattacaggcgttaaccaccatgcctagcccctgtacactagttttaacttccatatctaccaaacaccctaaatctagttggttgcaatgccaggatgttctttgttaaagtaatagaaaaccttcctcaactagagatttttcctatgttacaaaacaaggagatgtgagatagacttgcttcaaaactggtcaatccactgactgaagaacgtcatcaagaactcattatttttctctttccattctgccattctctatgtgatgactttgttcttggccagctcccctcctggacaccaggtggctggctgcttaattttaagtcaacacattcacgtatgacaaaaatccagctgcttctccctgtattacttttttttgagtgaggaaatgtttcctagatggccctcggagggttttcccatacctttcattggctggaactagattatatgcccaccgtaaactagttgtgggcaataggaatggattgccatggttagcttaaactaatcacaatctaacaatgagctagggtttgggtttccttccttgtacacatgggtgaactgaggctggacgcctgaataaaaccagggttttgtggctgggcgtggtggctcatgcctgtaatcccagcactttgggaggctgtggtgggaggatcacttgagcccaggcattcatgaccatcctggacaagatggtgagaccctgtctcagtaaataaataaataaaataaatcaaggctttgctatcaaggaatagcagggcattgattctgggctaggcaaacaacaaggtctgctgtagttgaccagtcctcttgatttttcccctctaaaaaggtcttgaaaccatactttctctccattcccagggccactgcctcaggttatgccttcattattttttatttacagcctgcactggccttctagagtctgtctctgttatctccctccatcctccatattattgccaaaataatctttctaaaattaaaacatgatcatatcgttcccccatttttagtcctttagcagctattcattgcttataaaggaaaatgaaaatttcttaatttacgtgtgtctggcatgtaagacacatcttgtcatctctactgtcatctgcacatgaacacacaagtaaacactcatacattcatccttatgcctcacacataccaccctcacaaacctggagtatcccatgctatcttagccttttgatttgtaacttgatgtttttcctgccatgcttatatttctccctcctcttgtcctgtcaactcatgtatcgttaaagactcagcttagtcatccctccccactgagaacttttcttttcctctctttcttgtaactgtgtcttcctctatcacagcactttcacactgcattaaagaatctgttcacttttctatcctcccctattaaactataagagtaggaatgacttccatattacctgaaatgtggatgctgaagattatttcatgaatgaattaatatctgggacaaatacagctagtgtttatgtatatatgccatttcatgagacagttactcagtgaagccaaagaaaaaatcataaggaaacatagactttctggttcttcactagaatgtaagctctttcaaggcggagtaggtgtcctgttcatcactgtttcccagtgtctgcaactgagcctgtcatataaaagatgcttgataatattgacttcactcattagtaacttttagcctgaaatatcacattgacatgccccaccttttaatatactttttaataggggctgtcttagttagtttgggatgctatagcagattaccatagattaggtgatttaaacaacgtttatttcctgcagttctggaggctgggaagtccaagatcaaggtgctggtggatccagtctggtgagggcctgctttctgctttgcagatgtctgtcatctcatggtgtcctcaaatggcagagagcagagaaaaaggaagcaagctctcttttgtctttttaaaagggcattaatccattcttgaggactccactctcatgacctaattacctcttataggctctgccacctaataccacccttttgggggttagggtttcaacatatgaattttggggggacataaacatgcaggcataagaggcactgatcagattctccccctttttaacttattgacattgtaatataccaacattacaatagtagatggtaagccaatgggctattgttttattcaacaaatatgtattaagtgccaggcactgttcttggtactattctaagtactggagatacagcagtgaacaaaacagacaaatcccctgcatttgtggagcttacatgctaatggaagcaggggtcgttggaggaacagacaatatgcaaatatgaaatatgtgtgtacatgatgtgatagtaactactaaggagaaaaatagagggggtaaggggtggaaggcggtaactacaaggtaaggcagggaagagggatgtgatataggatggtcagggaaggcccctttagagagatgacttttaaacattgacctgaatggagtaaaagagaaagttataagaaaatccgagagacagcatttcccgcaaaagaacagtaagtgctaaaggccttgaagtgatcttggcattttcaagaaagaggacattgtggctgccagagtaaatgcggaggaggaggaaatgaagttggccaggtagccaggcacagaggaataggagaccgcagagaaaactcttccaagaggaacgagatcatgaccttttcagggacatggatggatctggaatccattatcctcagcaaacttatgcaggaacagaaaaccaaacgctgcatgttctcacttataagtgcaagctgagcaaatgttgatcacgtggacacagggaggggatcagcacacactggggcctgtcgggagggggcgggaggagcaagagcatcaggaaaaatagctgttgcatgctgggcttaatacctaggcgatgggttgataggtgcagtaaatcaccatagcaaactatgtgacaaacctgcacgtcctgcacatgtaccccagaacttaaaataaaatcaaaatttaaaaaactcttacaggaaatcttgctgtaaagagggccagagaaatggttcaatagcctggagagagacaaagggtgaggttttgttttgttttcttttgttcattaaagtaggagaaaatccagcatgtttgtgtgcttttggaaacgatccagcagagaagggaaattttagaatgcacaagagcagaaagcataactgaagtgattaacttgagtgggtgagaggagagtggttggcctcagacagtgctgtaagtgggaaagcaagcatgtgggcacagatgcaggtaggtgagtggatgtcactggcagtaaaagcttatggaagttaagtgctcttttgattgctttaattttccgattgaaataggaagtaaggtcatcagcagagagtgaggatgagaaagcgatgttggagggtcaacgaaaaggataatgtatgaatcataatagggtgcactgataatgtgtgatcattcatgtaagtattcacatgcccagttggatatggctttgtcctggacatatccaagctttttctgctgatcttttgcccctctaagagaggcaataagacagctgggcgcggtggctcacacctgtaatcccagcaatttgggagactaaggcaggcggatcacgaggtcaggagatcgagaccatcctggccaacacggtgaaatcccatctctactaaaaatacaaaacaaaaattagccaggcgtggtggtgggcgcctgtagtcccagctacttgggaggctgaggcaggagaatggcgtgaagctgggaggcagagcttgcagtgagccagagcttgcagtgagccaagatcgtgccactgcactccagcctgggtgacagagcgagactccatctcaaaaaaaaagagaggcaataagactagagtaaccatgtgcaaattaggtgggtattactgctgcctgatgtgtgtctgacttattgcatttggggcttgtggcccttcagctgctctctgggttcttattcttacattctttttgtaccaattaaaagctattaaaataatgctccagcctgcaattaaaatattcatcttgaatgccatttatatgtgcccactgtgtgttttaaaaccctaaggcaaacaacttagaatcacagcagtttttgaaatgtataatactttttattgtatatttatggaaatatgcttaataagttgcaactcaattcattttttgttaataaaaagactgtatatagacttagcttgctcaaaaaatgatacaatgaggttgatttgttgtaccacatggaaatgagaaacagggttgagcaacaacagaggaaagactatagggcaacctttggcagctgcagaaaatggggactgaacctgagcagtaataacaagaaggaacaggtttgagctgaacatctgacagcagcagagagggttgatgtggggcagagttctgagaaagggaggaattaggtttcataaagagagatttagttcaaggatgatcagcaaggcaaatgtggaaggtagtgaaagagaaggcactggtaccaaagaaaataggtgattcacttaagtcactccagttcttgcatgggaagtgaaaacttaataacctgcaactatctgccttcaccagtggttaacttggcatagaactggacccagaatagggagagaagggtctaatcattcttctctatgtgtatgcaaattatcactcttggtttgctagtatttcccacagggtggtgtaaataccactatttgcaatgattttagctgtttgatacacattatttttactttaacagtaatatatattctttaatgtatatagaaaaaatatatttaccacatcaaatctgagttcaaagatcctgttgctgaacgcaagaatagaataaataaattcatataaaaggtgaaccaatttaaaaacacaaagcaaataatagaacaggtattaagagtcaaaaattgcaaataaatgaagttggagaaaacctgtctagggtatgggttgaatatttattttaaggagcatatgatagaagcctactagatagtctattaatataattctctttcttttcatagctgggctttgcagatctaaacctggcagagtttgctggatcaggaaataccactcgccgctgtttactggaaggctatgataccaaaaatacaagacaggataattccattcttaaagtaagcacgtttcaggatttacttgtcaagaataaaattatctgcctttaaataagcgtatgtatatattgtcaaggacaagatgtgaatcagtgctgatatgataaactgaccataccactgaagtattcatcacttagggaaaaaccccatctaagtcacaaatgcagtgaaaagtaacaaatgttcaccttcatggtccaaaggtgtttttctttgacgtttgagcattcagagaatacatacaccactataacataagagctcattgggaggaaggagcatgatgaattaatgaataccttaaaatgtttgtagctcccataaggtgatttacagagcagctgcgataggtacatagaagccactgtgttctcttgtaaactagtgaagtgacagatggaacccacttctgggcatctgcccggctttttccaagtaccatcaggagctatgtgctctagtaatgagtgcgaatgtatacttcatagagttaattgtagtattaaatgagattaattgagaaaatatttgtaaagtactttgcgcctaggaaaccccattagatagaccttttgcagtgtttcagttaggttaccccatgatggtaagttatctaataagaaaggaaaatagttctgagtaaaaactggtgttcaaaagttagtgaagcaaagaattacctgatactctacagttttcaaacttttttgcagcaaatcttaagctctgaacatacgaaaatgtgtaaaatggttattatggccagtccaatgcataaagtggtttttgtaaccctcacacaaatttagcagctggaaagaaaggtgggacagcgagttgatatgggaaggaaaatgttcagaagacaaggaagaaattagaaaagtatcacaatataaacttctgtacacatcatgttgattgcatagttttgtggttttataactctaaaaagttttcaaagcacttgcccatatctccatgagatgaacagggttagacggatgaggatagattgttattcacattttatagatgaagagctgaaactaaagtatctcacaaaagtagtcagtggcagagctgggaccacagtgcatgtcttctcctgcctggtcagggttcttatttcctcgtatttcttatatgaaaagatggataattcttctcagaatgacaatgttttcattggaaattgaaataactttttaatttcagacccccactttcctaagagccaactcatggagtaatttccttctggcttcccattcatccttccacaccgtctctcccactttgtcctacaaaaaaaaatactctttgaagatcatgccattcagtcataacactctctcctttcccaatctctgccatctcctgaccccttaggtaccgtctcgctcctatccattgatgacttagctcctggctcacagtttttctctatatctcttctcaggtcatcatttttccatagcttcaccatctgtgcagacgagctagccttgtggactatcttatctatattttctctcctgatagctgatcttctatgagtctaaggcttctcggttccttaaactccctatctccagcaatattttcctcctcctcatctcagttcctactcccatggtcacactctagagtctagacctttttactcctagaaacttcacccccaaaaaatttcaatttaaagttttcttcctcctaccactgtctcttatgtttccagtcctcttagtctcctactcacttagctatctttaaccttaccactctcccactatccatcagccctgacttgcttctacttccctgtctatccagcttaaatttcatgggtccataagggcaggagttcaagaccagtctgggcaacatagtgagaaccccatctctaaaaaaaaaaaaaaaaaaaaaaatactcctggctcctctgtccctgtctccctgcattgtctgaataatccccaacttttgttaactcacttattaaatatctacccttgcatgctgagcattgctgaagagaatcacacaaccagactagctgccattactaaagccatgctcactgccatctggcagtcatactctacttccttcatatgcttcctttctcaattttagatattctgtctcataccttttttctcctcgtatcccaacacattattcttgctctcagatactgaccttgccttatcctattgagaaaacagaagccattaaactcaaattccctcatcttcccatcatagactttacctgcctctcccgccttatcctttttgtctcctgttacaatggatggcatgtcccctctcctgtcagaagtcagtccttcctcttggcttctggaatccaaagtttgcctaatcaagagctttaccccttagactatcccctcttctcatcatctctacctcgaatgaatcatcctcatcaacatataaagaaacagctccactgtttcccatatttataaagaaagacaaaaattaacctctcatcttcttcaactactgtcccacatctctgttctacttaactattcagttccttaaagctgtatgtgccatctccatctcctttctgagacatccgtgatattcaagagtgcagttttgatggagttggaaagcagacctcagggttctatgaaagaagagatgatgaggaaatcagtgcagcaggatagatttggcatttaaagagaaaaaagagtcatggaggtgctgggatgaggagataggaatgaaataaggctatataagatacatgtcatccattagctgcagaacatacaacaatgtacatattcttgtattcattaagactatgaattttgctatgtgcagccctgggatcacatctcagctctgccctttactagttatctggtttttaaaatatcacttaatctccctgaggttaaaatgaaaataattgctctctcctaggaatactgaaaattaaaggaaataatgcatattaaacacatagcttatgcctggcacataatgaattctcaaatcatgattgttgttaatgttgttgttactattaccattatcattattattcccataagaacataaagaggtcctatgactgactgttaaaggtagtcagcaactagagaatagcagcatcttagaaagtattagaaaagctttaaatcctggttgggcacagtgactcacacctataatcctagcactttgggaggccaaggggtaggatcacttgaggccaggagttcaagatcagcttggacaacataagcaagacctcatttctgcaaaaaaaaaagaaaaaggaaagaattagccaggcgtagtgtgcacctatagtcccagctactcagaaggctgagacaggaagatcatgagcccaggagtttaagactgcagtgatctgtgatagcaccactgcacttcagcctgggtgacaaagcaagaccttatctcaagaattaaaaaaaaaaaaaaaaaagttttaaattctgatctaaagctggaacaaaggtcagaagctttttactcttagaagccaccagctggcatcccttgaaacatcaacgtggcaacttgaaggaaaacattaccagacacttaggtaccacaggaatttgggagtaaagacagatagattagcacagccacacacccacaggattattactggtaaattattattgctatttgtttccattatttccattcagatttttgcaattttgaggttttgaatgttaaaaatgattttaatctatatggagcagtaattgaatattgaatataacccacttcttctttttttttttttttttttaatagagacagggtcttgctctgttgcctaggcgggagtgcagtggcatgaccatagcttactataacctcaaactcctgggctcaaacaatcctcctgccttagcctcccgtggatataacccaattcaacaatcattttatttaatgctttcccaatagaaaatatcggactaagtgctgtgaaggaagcattttataattttttataatcgtgatatttcttgttttatatttaggttttgatcagtatgcaactgatgtctggtgacccatgttttaaaacgtaagttgatacccaataaatggattatgtatctaaaagtataagaaagatttatttgtttaaatttttacattaatattttgtagtgcttataagaaaataccagttaagggatagtttcttccctgggagactgacctgaccctcttagaagttatgtttacctattaccaaatgagttctccatactccaaattattaatgctataggtctttcatcatcttcgggttttgcgtaaaattatataagcaaaaatttttaatacggcttctgtgaacatattcatttcttcaataaacacctattaagtgccttaccatgtgttaggccatattctagatactagagaaacagctgtgaaaaaaatagattaagtccctgccatcctggagcttatattctaagaggaaaatggacaataagctaacaagtaaatatataatatacaaacggttcataagcgctttggagaaaaaggatgggagggccatcgtgaagagaagtgttgctattctatatatagtagtcaggggaggccccccccggtaaagatgatatttgagtagagacctgaaggaggtgggaagcaagtcacactggcattagggggaagagtatttgaggtagaggaaacaaggacaaagaccttgagggagaagtgttcttggcacgttcaagtagctgcctggagagcagcgggtctaaagcagagtgaatgaagaggcgggtgataggagatgaggtcagatgataaggagtcttgtggccattataaaaaggactgccactcacactctgagtgagatagaaaagctattggaggttttgagcagaggagtaaaattatctgacttgtggctgctagatagggaatagacaatctgtaggagtaacagagaggacagggacacaaataagtagataaaaggctgttttcagtaatccaaggttttaagcctgagtaactggaagaatggtgctctcatttgttgagatgagaaagacaagaggaacaaattgggagcttgggtgttagacgttttaaattggagatccctatttaacatccagcggggcatgtcaagtaggcaattggtggatagatcaactagagtccagtggggagatctgggcaggagatagaagtttggaaattattacatcatcagcatacaggtagtaattaaagccatgagacttgaataagtaactagagggaacgagtagagatggaaaagaaccagagactgaggtggggacaccccagcgtgttagaggtcggggagattgggaagaagaatgagcaaagaaaccaccagtgtgatcagaggaggaaagcaaagcagagtcctgtcctgaaaaccaaatgaagaaacggcctcagaaaggcaggaataagcacctgtgtcacacgctgctggagtgggtctcagaaaatgaggactgaggattgacctttggaatttgcagtatagagactattgatgactttggcaggcactttggtagaatgcccttagactaaagccttttgagcatgggttaaagagagtttgggaggagaaaaattggagacagtgagtataaacaattcttatgaggggttttgctataaaaaagaaacagaaagatggggtcataagtaaagagaggatttggagtagggcaggttttattcatttttaagatggaagatgatataacatatttgagtaccaatagtattggctcaacaagagggaaaaactgatgatccagaaaagggactgttgctagaacagcgcccttggattgttggagggaggaaggcagagaacatggctactgacgcaggtagaggagaaatggaagcatatagaagttcttttccagttgcttctgatttcttagtgaaataggaaacaagatgctcattgaagagcaaggacagggaagatagaggaaggggtttgaagaaaggaaaaggtgtgcagaagtcctcacagagagtgagcatgaatggaacagggaaatgcaggattgcctgtcagcagccttgaggacacttaatgattaaaagtgaaagttcattgataccattgaaatatctgagaaaaatacacatagaaaactaaagaaaacattacctccctatgtatcaacttcatgtttttaatagctgtaacttagaaagcaacatttggccgggctcggtggctcacgcctgtaatcccagtactttgggaggccgaggcaggaggatcactctacaaaaaatacaaaaatcaggcgtggtgatgcacacctgtggttccagctacttgggaggctaaggggaggattgcttgagcctgggaagtggaggttgcagtgagccaagattgcaccactatactccagcctgggtgacagagcaagcccctgtctcaaaaaaaaaaaaaaatcaattcttgattaaaaccacacatcttcctataacttagccttcctgtgctgtcttctgataaaccatggtttcctgactcctttattttctgctttcttgggattaaaccaattttgctatactatttttggtgtctcaggtaactgtttttctattggagtaagatttagggtaaaataagaaaatgagcagcaaaacttagtagaagaaaataaattgatcgttccttctcatgaactttttatggatattccctttcttgccctttctcttcccttttctctctctacttaaactcacatattgaagagcttgaaagtagatcatctaatgttttatattatctccataaatttaattctgacaatctggagtttatatttacagagaaagacttttgtaattcataaaaataagcagacattacctaattccaaatacataaaatatttttcaagagaatcaaaccctcagtagtttttcttttctctttgaaattgttcaaatgtcattgaaaaaggggaaattctaacacattcatacacttgcacatactgaatatgtactgaatagaaaaacattttaactactgatgtaaaaagtaaattagttttatcaagttatatttaaatatatgtcaaatatgtaaagtcacattactttagagccgaaaagaatgttggaagttgtctaatccagtgatttttttagactatttagctacaaaatcctttgctcaaatatattatgaggccaagcatggtggcttatgcctgtaatcccacactttgggaggccaaggcaggtgggtcacttgagtccaggagttcacgaccagcctgggcaacatggtgaaaccctgtctctaccaaaaaataaattaaaaaattagccaggcgtggtggtgcgcctgtcgtcccagctactcaggagtctgaggtgggaggatcccttaagcccaagaagctgaggttgcagtgagccaagatcatgccactgcactccaggctgggtgacagagcaagacctgtttcaaaaataaagcaaatatattatgaatcctagtatataaaattttactttatatcccctccaacttaggtaagataagaatagattttccattgagcacactcccatacctacttccagaagtccctaaaggagatcatgaaaccagttttaaaagtgttggtgtaatccaagttctcattgtacagatgaggaaacggagtaacagagcaattgtgtgactttactcagtatctttgtccagaatgaagatgtaaataactgctggagggcttcattctaccattgtctgcttttgtctatctttaaatttttcatgatataaattgttttaaatttacttgagaaacaggagtatagcagatccttagtctcaagtttaaatcctagttttaatattttctgagcagaagatctgtgacatagattgtataattcttctgaagcaccaattatataccataaggccagaatttatgaagaagacagctggtaagtcagcctaaccacctaccctaaactttattgcatagttctctacaactcatcaaacacccaccaactcttgtaaaagaatgaaattcactctgaaaagtgctaataaagaaaaaagatattttgagagagaaagtgtatactctgctggcatttgggaatgtggtggcaaagcagatctaggggtgatataagtctcttgaatagcaaggttctgacgcgttcatattccaaaaggaaggaaattatcatttgtgaaaatgatttcatgaatgttactgtctctcaattcttaaaactctgtaatataaatattatccatatttttgagtgaggacatcgagactaagaggttaaggaattaattcttccagggtcccaggatgcaatcattcattcggtacatgtgtattgattgcctgccacatgccaagacttaacaagctagaaaagaccagcccctgctctgaagggattcactgattacgtgggagacaggcacacagcatacagtgtcactggggcacacaggataggatccctagccacagttctttgaaagccagggaaatctttactgagaaggggacactgagctaagtttaggggatgactaggaatttactaagcacaggaggtaggtagggacaccccaggagagaaaactgtgcacaagtttatgccatcgttacagggcattgagtatttaagaaatgtcaaataggtaatgttgtcgttttatgaggtcatttttcacatattcttaacattactataaagcaatcaaattaaagtaatcccatttctttttctatacttgacccacattaagtgatttcagatgagatataaaagcattttcagaacaaaaggggtaatggaacaaaaactggcacatggcaagcactcagtgattatttattcaacaagactgagttgtccagggaggtaagagagctgccaagccccagctaagattttggattctaaatttgctttactatcagtccccatagtcagtgaattttctccataatgcttagttgccccagtaatagagcagttagtatagatggctgatattatcaagggttgcagttcttcagcttttttgagaccgcagaacaaggggtgccaaattgaaggtgttgcttaaagagttgtggctgtggagtcaggctggaagggagaatggagccagagggaaatagagagggaaggggccaatgtttgggagttctgagggttggaaaacaggtctaagacatagaggggatagggacactgtaatcaggtcacctgtgaaagaaactggcattaaaaaggtaagaatttttagacatgcaggcatgagtcagccatcagtgattaatgactatgactgtaggctccattctttgtgtttcttctgtgtattagtttttcccatgaaatatttaatgcagggtgtttttttttttccacaaagctattttacattatttgaaaatacagcccgagcgtggtggctcacgcctgtaatcccaacactttgggaggccgaggtggatggatcacctgaggccaggaattcaagaccagcctggccaacatggcgaaaccgtgtctctactaaaaatacaaaaattagccaggcatggtgacgggcacctgtaatccaagctactcaggaggctgaggcaggagaatcacttgaacccgggaggcggaggctgcagtgagccgagagtgcgccattgcactccagcctgggaaatgagcgaaactccgtctcaaaaaagaaaaaagaaaggagaaagaaaatacagctgttggtaattgaagaggcaggtctaggccagactgcaagttctgagggatttgagttttatgccgaaggagctatggaggggttttaaataagagagtaacatgttcagaggcaagtttcagaaagaccacagtgacagtagcatggagtagagattggcagaccagcaaggagacccttgcagtcagccaggagaaaggtacaaaggccaaaactcaagtaattagtggagatggagaagagatgatgaataggaaaaatactaaatgaggatctgagatttggaaattgattggacatgggaaaatgttattaggaaggaggcagaggtgatatccgtaattctagttttggtgactttgtggattgcaatgacatttacagagagaatacaagaagaaaacagttttgggaaagatgagtttagttggggagatattgagtttcacgtacctgtaggacaaatacttgaaagcgtctcaataggatatgtaagtctagaatttaggagatcctaggctggaaatagtcaataaatgcaatagatttaatagcaatcttaaatgtctctatccccaagaatccgagtagcctgagaactccattaagaataacagggtaagaatttaagaattgccataaagcaggtcagctgcatgattccttcagccacctccctgttttatctctggtcaccaaggcatagtttctgggaagatgtggttttcctctgcaatatcagcctcaaaaggttagggattggctgggcatggtggctcgtacctgtaatcccagcacttcaggaggtcaaggtggaaggatcacttgagaccaggagttagagaccagcctgggcaacataatgagaccctgtctctaaaaaaaaatgtttttagaaggttagggatgttttctaataaaaatccctatgttaaaaaggaaacccaatgggatcactagtcaacaataatttgttgcacgttttaaaataactgaaagagtctgggcaccatggctcacatctgtcatcccagcactttgagaggctgaggcagatggattgcttgaacccaggagttcgagaccagcctggacaacatagggagacccccatctctgcaaaaaaaatttaaagtctctactaaatgtaaaaaaaagccaggcatggttctgtgtgcctatagtccctgctaactgggggactaaggaagaaggattgcttgagctggagaagtggaggctgcagtgagccatgattgcgccaccgcactccaacctgggtgacaaagcgagaccctgtctcaaaataaatgagtaaaaaataaaagagtataattggactgttttgtaagaaaggataaatgcttgaggtgatggataccccatttaccctaatgtgattattatgcattgcatgcctgtatcaaaatatctcatgtaacccataaatgtatatacctattatgtatctacaaaaataaaaaaatattttttttttgagacggagtctcgctctgtcgcccaggctggagtgcaatggtgcaatctcggctcactgcaacctctgcctcccgggttcaagtgattctccttcctcagcctcctgtgtagctgggactacagatgcatgccaccacacccgtctaatttttgtatttttagtagagactgggtttcaccatgttggccaggctggtctcgaactcctgacctcaggtgatccacccgccttggcctcccaaagtgctgagattacaggcgtgagccactgcacccagccaaaaatttttaaagaaaaaaaaaactgttagaaattaaatttacccctccttgcttcacagcttttacgtggaataggagtttgaattaaccaatgaaaatagatccattactactcccagagaatccaatccaaaaaacaaatctaaacaactgggcctctctgtagactctccctgggcaggtgaactgtttacagagatgaaggtagaagataaaaccatggatactatttaaaaagtgagtggagccagccagggagcacagtctctgaagcaggaggcacgaggcattctcctcccagcctgattcaaaagggcttggcactgccttcctcagctgaaaggtgctgtcctgagttgacagttagagcaaccctcccttgaccagtgctgggttcacactgacagaggcctctctttttaggactctatggagacaatgcccttttcttgttatgttaaaaaaaaaaaaaaaaacccttttcttttatgaattttattcaagttttgaaaagatgcttatacgttatttgctgatctttgttactttcactctcaaaggggtaacattaccaagcagtctatgctaaggcttactaagctcaccaatcaataactattgtaaactttgaggctcccccacaactccagttcgtaaatgtttatttacaggcctccctccacttcaatgtctataccaattgctggtgaatctgaatctttgcaagaagatagaaaaggtggagagactctcaaagtgcatcttggaatagcaggtatggatgtgtggcttactggttttttaatttgtgagagacgacttgatgccctaaaaattctttgggaattgtgtgggtatttgacttgaaacaggccaataagaatcaacagttttaattatgtaattcttggttgatccagtgctttattttgtctaaagtattgtgctctgacagattaaaaactagatgttacaatgacactctcctcactgtatgcatctactccccacaggtacaagagaatactacaggattttttccatttttcccgttccattaccctgcaacttctgcaaagcagcttctgcctctcgggtgtcgctcctcttccatgaatcgctttccctctgtcagtggttctcaagccctagtgtgcatcagagtctcctggagggcttgtgaaaacacaggttgctggcggcagcagccagagtgttcgattcagtagatctgggttagagcctgaagttttgtatcactaaggcattcccacaagacgctgatgctgctagtccctgaccacaccttgagatccacatttccagacacacttctggcagcagtcagaatctgctccagaagtaaaagcatggtggggataatgtcaaggttgcaggaggaaaaggacttaggagcttccttctttcttcagtattatgtgaacaggatgtattgtttgaaagaagggaaaggtgaagttatataattaaccctttcactgccttttaaaatatgcaaatatttggtttcttataaataatggtgactctgaaatttcctgttttgggatcagtggatcttttgggaacttgtaaccattccattagctccttctcttcagcatgtaaatatgctgatttctttctcctactgaaaaaatgaaaacaaaaactccttagccctacatccttctctatctactgcactcccttagactccagcaggctggcgcatgtgctcacatgctctctctcttcccccactctgccccaaatatagatacatctctctctctctctctgtgtgtgtgtgtgtgtgtgtgtgtgtgtgtgtgtgtgtgtgtgtgtgtgtgtggagagagagagagaaagatcagcaagagatgatatatgtaccacacacttcttatagccaaacttctagaaagaatatactgtccatttattcctaaacacattagcagtctggcttccatcatctgccctctcttgctgctatcccctgatacatgattgtcaagtcctgtggacatttgttctggtcttatctgatggccagttattcattcttgatgctttctcttcccttggctcctacctctctgatctttccttttctagcttcttagaggcttcttcatcttcctccaacttccctttacatattgatgttccaaagggtttggtcccctcacttccttgagcaataccatctatacccttggctttatctatcacataaatgtaaatgtgattctgtgatgtacatgtgatcaaatgctttggggaaaggtccacttcataccaaatgtaacactgaaatccatctgtttctctttctacccagccagagtctaactaagttcttcatgatcaggtcttatttatttctgtatccccagcagaaggcccgggacacagtagatgagtgactgttgaataggcatcctcaggtgtctctaattccgcatatctagcacaagtcttcctaccttttcctcctgtcttttctacttcagttttcctgacacaaacttctcctttcttattgagtcctgctatttgtgcctatgaaacatctctccctctcagctggattattatgaaaacctacactcttatgccccctgtttatcctgttgccagagtgttcttcccaaaatgtagatttgatcatgtcacaccctttcttaaagccactgaactgttttcttctttaaactcatagaaggttcttcatcaacaggcatctactcatctttctagccccttttccctcggttattatactccactaccctatatgccaactttaccaaacgatctgcttccctacaaagaaggcatgctcttcccggtgcctttccttgctcatctagctcaggagttcctatacgtcgctcaagtcctggggttaacctcctctgttaccaggttgtgtcagatgcactgtcctttggagctcttaatagctgcttttttgtgcttgtatttttgtacttaccacattgtataagttttgcttctacctctaaactctaagcatgtattttgtcttattttgtacttcctataccttgtacagtattaggcacctgactgggtaaaatattaataaatattgattgaatgaataaattttgaaaaccagaagatatgtggatgacttaagatctgggccaaacccagaagtaaagagcgctgcataactcgatatgaaccaactttttgagttcagattttgctgaatgtttgcttttggaccacttatactctgtccagaaatgagaaacctttgcagaaggaccaggttactccagtattttccttgttttgcagcatttgttggtccaactgcatgcagtatcatttatagaatagctgctataatagctatgttactcaattgctttccttctgcttctaagttaaaaacagttcttgtttccaaatatgattgtgccctagggaaaatggtcacagttctgcattctctggaagaagcctggttctgaaaatatgtaattggcacctggaacatacacatgatcagaaactattagaaatggctttgacactgccttttgtacatttactttgaatatgaatactataatcactttcttaagaacttttactctcagtgctacgtcccatgctgtgttgatttaagccacagacattgcccaaattatagcctagcactaacaacactaacattaaagtaatagagtactctttagcttgctgttgtgatggatttttaaggaagcagtatttccttagaaaccacattaaaacctaccaattttgtgaacatttataagaatacatctgagtcatttttgttagagaaatactgaacactaaaactgtagcagttttaagatagagtgctgttaaatgttttgaacaacaggagtttattgcatagactgaactaataaaggactgaaataattttttaatgttatgaaaaatataattcttcagcgaactaaggtatttaaatactttgtatatcttgcaatacagttacttccattgcactgacttaaaaggatgtccctcattttgtaacttattgttttgataatgaacttggcagagtttataaagtctgcagagtagaatacaaattgaccattaactttttggcaataagaatgacatcatgttatgacatattacagatctttcagcaaagagtgcctctgttccagacgaacttggtgcctgtggacattctagaacatcaagctatgcaagtcagcagtcaaaagtatcaggtagaggctaacagtgaagttgaattccttattgttccaaagggacttgaaactgctgtggtgtgggggaacgatgtcagattgcagagtgtttgatatgagtattatatccaaggtgattttctctgacagggtatagcacgtgtcactcccggtcatctagtttctctgagctctgccacaggagaaatacctcagtgggaagcacatcaacaggagttgaaagtattctagagccatgtgatgaaattgagcagaaaatcgctgagccaaatcttgatacagctgataaagaagatacagcttcagaaaaactcagcaggtatccttttagtttaaagaataaattttaatttttaaaaaactttgttttcataacataataaaaaggaaaaaatgtaattcttttcaaagatgcccagtgaaacaagattctgtagaatctcagctgaagcgagttgatgacaccagggtggatgcagatgacattgtagagaaaatattacaaagtcaagacttcagcctagattccagtgcggaaggtgtgtaggtaactgttaagcatagattcctgcaatccaggtttttgtaatctgtgtagtcagcagtaaagaggctcagaacatcataatactgactgttgcatatttgtatagtaaatttcatgcccataaaaatatcaagataactttatagctcatttattaatgagaatgagtattgagtttagaaaaagaacaaatgttagttaaaagtgatcaattttaaataaaacatttattgtgtttttaattatgcctagatgtctacagcgttcgtatacctaatgataggtatctacatctgcttttgttataagtgctttaagccactgttgtaatttggaggtggtcttagaacaatagtgaataatggaatccttcattccctccttagaattttcactgaagctgaaaatttgtatgccaccaatttgaaaggtataattactcatgttgatgtgaatagaaagcacttaacagtggacttattttcattatgtagttgggtgtaaagagaaataattaaaccttactttggaaatttctaggaagagctatctccattactcagttaaaagaaaaagagttttagaaacattgaagagaaataacctttagagtatcttttaaattgcctattttaaaacatgtatataactttggtttttaagttgtttatttctctaataaacaattgtaaaatatgaattattacaatatccatatatttgacaatagtctaataattgtacatgtaacaaacattttaaatgtgtattgcagaagaaggactaaggctatttgtgggtcctgggggaagtacaacctttggcagtcatcatcttccaaataggtaagtagtacaaatagtgtcttattaaaatatagactaatttttttaaaaaaatcatgagtagaggatgatggttgcaaagtttgtactaggctgaagcaaggaaacacagatagtagtagttacatgcgaagagttacagctcttagtgtagctctcagttttcttaattctgggtatgtttgacattatattttataaattagtttttaatttccttagaaatatttttaaagggtattagtcaaggaccagtagaccattgggaaagttgcaatataaaaggacacttagaaaagagttcttagtctttcaaaacattaattttttattaatttattttctagagacagggctgttgcccaagctggagtgcagtggtgcagtcatagatcactgtagcctcaaactcctgagctcaagtgatcctcctgccttagcctcttgagcagctgggaccataggcatgcgccactgtgcatcgctagtctgataatttaggaagagcaaagcaaaattacattttcagtcaatgatcttatcttttccgagcagttacacagccactgagcaacttaagctgctgttaacctttcttgtactctccttttctccaccccactgccatacatattaaaaccatcattctcagcaaactatcgcaaggacaaaaaaccaaacaccgcttgttctcactcataggtgggaattgaacaatgagaacacatggagacaggaaggggaacatcacacaccacggcctgttgtggagtgcggaagcggggagggaatagcattaggagataaacctaatgttaaatgacgagttaatgggtgcagcacaccaacatggcacatgtaaacatatgtaactaacctgcacgttgtgcacatgtaccctaaaacttaaagtataataataaaaaaagaaaagttctgaaaaaccaaataccattttgctagttattcagatgcagatgaagaaaagtcacctgccaaacttacattgattatcagcactgcagcagataatagtgagcacagacaccaaggacagtgtaggaattctaatcactcacttgctccttaacaacctgctccccacacttctgtgcacccctaattccattccatgtcgtatttatgtagagtccctgcacaactacagagtgagtcacagttgcaggtgggtagctccttggaccaagacagttattgtattctctcgtggtcaaaacctaaaagaattttgcattcatttcttttactaatactcattttaatgagtacctcctatttgtccagcacattacaaggctcaaaaatagactaacagcaaaaacctacatcaacgattaactacaatcagatatcataagtaggtaagagagagacatataaagctactttcagggagtaatgtgaaaaaggatttacagaagatgtaacactatttagatctttgattgactcatctgcttattaaattcagtaactgtttcttgggccaatttgtaggtaaggatgcaagtagaaaagacccagctcttaccctctgctggcttatggtctagcacatggggctggcaggctatagcccataggccaaattggcccactacctgtatttataaagtttcattggaacacaaccatgcctgtttatttgtatagtgtttactgctgctttgatgctacagtagcagagctgagtggtgcagcagagactctgtggcccacaaagcctaaaatatttactgactcttttttacagatgagatggacaaactaaaagtcataacattataataaatactgtaatagagggaagtttgagagaacagaaacaggatctcagagttcacacttgaagagagactttgggagaataaaaaataagtggggggcttataaggtgaatatgatgaatacaaatactcctggtaacaaatagaatgagtttataagtacagtaattatgatatataattatatcataataaacatatagcaattataggtagcattgagcatttattagttatgtgccaggcacaggtacatatatattttttattcaattcttatgtagtagtatctttcagtgctcacaacatactacaattagtttggtgtttttttaatggaaacaaagatacaaagaagtaatttgaggctggacatggtggctcacacctgtaatcccagcactttgggaggccgaggcaggtggatcacttgagatcaggagttcaagaccagcctggccaacatggcaaactcccatctgtactaaaaataaaaaaattagccgggtgtggtggcgggcgcctgtaatcccagctacttgggaggctgaggcaggagaatcacttgaacccaggaggtggaggctgcggtgagccaagattgcaccactgcactccagcctgggcgacagaatgagactgtctcaaaaaaaaaaaaaaaaaaaaaaaaagaagaagaagaagaagtaatttgcccaaggccttaaaactagtaagtggtaaaaccaagattaaaactcatgtctctttgagtccaaatcccattgtacttaaccagtatattttactggctcattaataatataacatagttcaggttcttctgaggagagggggttgtgaaagggtatttaggggcatgaggttggcaagcatctctgagctaggttgtaaagggcctcacttgccataacaaagtttcttcttctcatgtgcacagtggggagccattggccatctttgcagggaagtgacctatcagattggcattttagaaaaataaccggccataatttgaagggtagattagagcaaggaaagaccagtagcagggggaactaggtagaaaagtaacatttatgaggacagtggtatgaatgatggagtgaacatgtgtttttgagttagagacttgggttcacatcctagccagaccacttttggggcctgagtaaatcacttaacttcaatagaactttagttacctctgctgaaaagtaggaataaccatgcctatctcatggagtaattttaaagggtaaatgacataatatactcagtaagccctggctttattaatttaggtacagaacagcagaaaaggtagttccaaccaaatggaatttttttttctaagagatagggtctcaccctgtcacccaggctggagtgcggcacaatctcagctcactgcagccttcaaccccgggctcagcctgctgagtaactaggactacaggcatgcaccaccatgcccagcatttttttttttttttttttatagagacagagtctcactgtgttgcccaggctggtctcaaactcctggcctcaagtgatcctcccactccagcctctcaaagtgctgagattacaggcatgagccgttgtgccaagccttcaaccaaaaggcatttaaatagtaaatggtcaaaagcacgggctgtcttagactgcctgggatcaagtcctagctcttccactattgattgatactgttgacctctgtaagtctcagtttctttgcctataaaatgagagtgataaataagatcctgaactcataggatgtaagactaaattagatgacttatgtaacattttttggttttcatttttgaaagacaaggtctcactctgttgcccaggctggggcgcagtgatgtgatcacagctcactgcagcctccaattcctgcactcaagcgaacctcctgcctcagcccctgagtagctaggactacaggtgtgagccaccatgcccagcttttcttttttaactttttgtggacacaaggtcttgctgtgttgcccaggatacagcctggcccacttgggttttcttactgggaccggcatgcacctgcctgctttcctttagggacgttaaattttttctgacaagaagtctgcctgtatttttattttattcttctgtatgtgatttgtcttttatatctggctgcttttaagattttctgtttattactggtttttagcactttggctatgatgtgccttgaatatgtttttccttgtgtttattctgcctggggttcatcaagctttttggatctatgggtttacagttttcatcaaatctggaattctccagccattattttccccaacccctccttctgttattctgatctacaaattctagtccctagcccctctgagctttgatctctgactccttcactcagagagaccagcaggctgtgtttggggtcttcctctctgcactgcaggctcggaagatcctgaaggaaactgcttcaggcagctagctggggcggttgtcgggctctcttcatttatttcttgtttcttgggaccacagtcctgcactgcctgttgtctagtatgtgcaaactgtcatttcacttattctatccggttttctaattatataaggcaggagggaaaatctggttcctgttacttcatcatggccagaggcagaacatatttaaaagggcatctaaaagccagtgtgccatgctgcccaccatggtttcttcaaattctgattttctgtaggatgaatgggtgctcactggcattctgttgaggaagttcctatttcttctgtagaatgaatctgtgagaacaggagtttctgggcaatcaactgagaagtccagccaagtccatggtgggctagtaatcactaccttacttctgttgtttagaatttcctcttaaaatgccattaaggagagacactagtcatggtggttgcttctgggcttactaaactcaggcacactcatggtaaaatgacaagtagtagggtataccctaacatcttgacaaattgggaaatgggtacctggtgataacttcaggcagtaatgggccaggcgtggtggctcatgcctgtaatccagcactttggaaggctgagttaggaggattgcttgagcccaggagttctggttgcagtgagcttcagtcatgccactgcacttccatctgggcaacagaatgagaccctgccatgaaaacgccacaatattatgacagctgaagaccatcatcattaactcagtgcaagtcctgatgcactgccagagtcaacatatgctcttggatgagacctattttagaatgaatagataaacatgtttgaagagcatttcttgccaccatttgtcgataggtcaagaattggggaattctaatagattattgtgggaataagtgtgagagaatcaggatctaggctaatccaatgtattaatgataaacatttaatatttcacatagtttctatccgtgatgcctttaaacgttatggaaatcaaatctagtagaaaaatacccagtgccccatctctccaggggtaaggttacttggaacagtttcaaacactgcagctcaaaattttgaagtttttttccactgctgttttagggtggggtctggagcttatgaacaagttgtgatcaaacgctagaagtcaagtcggtgaaaacatttccttgtggatttaagatgtgagtagttgatgtatcaaggcattttattcaagcacttaatagaaaatgaacctcaactatcaagaggaaagccaatgctggtttcttctctggaaggacccaccgccatcctgtaccagccaccaaaggggaacatctacatggcagtctccaggcactgtgccactgtgtgccttggaagcacctggcttctgtggtcactgcacatcataatgaaaagcctgctttttctttcagaacaccccagcggagaaaacagcattatatacatcggagtatcattttaggattcaagtgtaaaaatctgtgatcaagaggctcaatagatttgggctctatggtttggtttttttagtttgagagacagtacatgaatataacttaaaccctatagattttgtcaagatagttgtaattcctgttctggaaatcttccctattacactacctacagcattgtataaagtgtgggtgttcatgctttgggaaaatgttagactacaatttaaacatgtgatgtgcttattcataattctcagtgtatcagtcataaatgaaataacaagtgcatttaagtcagagatacgtgaatggatgtaatgccgttatgcagtatatattgttaattgtcattaatattagatgagctgcagaaccacccccaagcactacataaaagactcaaaataagtttaacacttactgtgttgggcaccctaacagaagagctatcttaactcattgaatattaagatctgctggtttcaggagtcaaaatgtagaaaaagaggagaattgtaatatggtcagaaacagagaagccttttctatgtaaattcagacttatctgaggctaacagttttccgaagtggtggtgggtagcagcatgacagctgcttgccatgactgatgcagactactaggtttccattttagctctctgtaggtactgttttcttccccactgtgtcgaaagtgatttgttttgaagcaagagtagaatataacatctatcaaatatagcttttaaaataagaatacctggtctggatccagttgagcagcacagcagataaaccttagagtttttctgttcttacatgacggtttccatgtggaaagatctaaactttcttggaatcactattagtgaagaaaaatgtagaatctgtataaccagtaattccccaattcttactttcaaagtcatatccaagaaagacaatatgtcagaatagaatgactttggtctaggtgttttcacgttggcaaaaataaggaggaaattatattattttaatatccaaatttaaaggtttggaaaattttgaatagttaatattagaacttatgttgctgttttttatatttcaaggattgagtattctgcattaatccaatactattccaacaaagagattctggaagtttttaaaaaatgataccctgttttatattttgaatgtagagagactctgagagagagaatgttctgagttatactttttattttttaagatttatttttaagaataaaacattgacctgaacattttagcctaaccaagggacttaagtggtaaagacttgcattatgtcttcatgtgaactgatccgttcattatatattatgggaaaaatcaaagaaagttttttatagagatatgaagatattatttagagagatatttattatgacattttttaaaaacatatttttctattttcaaaatattatttctaggctatatttttattggtgctgtgcaaatgattttgcagttttgaaaatgataaaactagattgtaagtggggttcagtgaggacattcatcagacacgtaagaggtgctgcaatcagggtgatgcccatcttactcatccttggctgcccttggtccgacacctctctatacaagactggttctcagtattttaaatggtacagaattctttttaaaaagtagagagattttgaaaagcataaaaatcatgcctttataatcttagcagccatcagatacaccttgatttatgtagtagtaaatataacaaatattttaataaatagaaacactgataaggaagaaaaaagaactaatgtctatgtcttctgtagtcagcaaaagtctggatccattttctattttgtgttccattggcacactttgtgttcaaatttcagtgcagtcctttcaaaatactcgctaagggttgcctaagtgtctgccttactttctgattgtccttttctgagagcatggttaagaacatcttaaccatatagctgttgaaaaaatctgtttattaaataacaagttcacttctgtttatgttttgagtttagaaaatttgacttgaaaatttagattattaataaatttatttttaaatattaaagtcaaatttcaaatcacccagtgttgaagaatttgcagatgtatacaatactttttctaattatgtcttttctatctccatgcctggctttttctaattatatcctagagaaaaagactaatggtatttcaaagctgtgtatttgtgacgagataaagaagagtcttaaacatcttgtttgggagaatgcacaggccagtcaggagacccacctcctcctgtgccctgagctgctgagacccgacagatcatgaaggctagtaaagggcagagaaggccctgagccatcagtttacactcgaattgttgactcccctttgtggtgtttttgaaggctgcttataccaacagctaatgtggattagtgcttatgatcttgaaaaagtcttgaccaagaatcctaaactccaccactcctcccattccagcttaacactatcagaataatatccaaattccagatttttttcttttttacttttttttcttccttttttaagagagacagtgtcttgctcggtcacctaggctggagtgtagtggcgcaatcgttgctcactacagcctcccaactcccaggctcaaatgagcctcccaccttggcctcccaaagtgctaggaccacaggcatgagccactgtgcccagcctagtttcttttctgtatgctttttttacaaaactgtgagccacagaggttgaccacttagccaatttgttgctagaagggagaaaaaaatctccaactagcctccagacaaaacatactcaaattcaaacagcagttagttttaattaacatacagaagtaattttagactttcagatttctatgctgactagaacactttgcaggctgaagctgacattattaccaaatacttcatttaagtacatactctgaagtgtcaggcttccagtatatatagcaacgctctgagagacaaactgggctcatatgacggggttgcattttattttcttaacaggtctttaaattgggcagttctgaaattctgtttggtcagttctagatggtacgtcatgtgaatgcaaccaagcactgtagttgaaattgtgttatgccactactcatgttgtcttaggtactacgcataatgttaatagctgagatgttaaagaatttgaagtctaaaatataaaagatgaatatacccatattaatcctatgttaagatgctctggaaataaaggccttattcccttacacatgcgatttttgtaagataatatatacacagtatattttaaatgtttgtgtgggtggtctgtgtagttactccccatacaacaaagctgacaaaatttttaatttacacaatgtattctgcattttcaaatgtttatgttgtgtatatagcaaagaaattatcttactgatatgcgttgaccaaatcccatggagaaaagacatctcatttgaggttccccttcctctcatgtgtttgattttttggaaggtgatacagtatgtgggtaaccatgcaaatgtttatgaataactttactgaagtgattccatccgtattctgttctaatacttggagaatgaccttcatatttatatattttatttctttgtttcaactatccagtgataattcaggaaatgtttccttttttttttttttttacaaaaactttttatttgtaaaatgtttgtaataatgtaaaggtgaacatgttcaataaaaatcatatattaaaagtttagatgttctttatcttttaaaatatcagttaagattccatcagaaaattgtgccaaggtgaaatgaaagaaccaaaataacttatccctgagggtttatttatttattaccagggagcatgggacagatttgaacgcccccagtggcggatttctctttgaacccttgggcagcccatgcagtggcatggacctgggctttgggtgagacaaacctgagtctgaatacaaactcccctctgaacctggcctcaaactcctgagctcaagtgatcctcccactttggcctcccaaagtgctaggattgcaggtgtgagcccatgcgcctggcctgaacctattttctaatctaggatgggcataacaccaacactcttactgggttgtgatgaaagacacgggcattattgttaagagtatgctactttctaggcactcggtggtccatcaagccaaaatttgccttcgtatagcatctacacacatatactaatttctagtgttggacatacagatgcttattaaatgtgccactattagcatatacccaaaagaaaggaaataagtgtgtccggaattggtgggtttttggttttactgactttaagaatgaagccgtggaccctcgcggtgagtgttacagcacttaaggtggcgtgtctggagtttgtcccttttgatgtttcgatgtgtttggagttttttccttttggtgggtttgtggttttgttggcttaggagtgaagttgtagacctttgtggtgagtgctacagtttttaaggcagtacgtctggagttgtttgtttcttttggtgggcttgtggtcttgctgggcttaggagtgaagctgtagatctttgcagtcagtgttacagctcataaaagtagtgtggacccaaagagtgagcagtagcaagatttattgtaaagagcaaaagaacaaagcttccacagtgtggaaggggacccgagggggttgccactgctgactcaggcagcctgcttttattctcttatctggccccacccacatcctgctgattggtaaagctgagtggcctgttagggcactgattggtgtgtttgcaatccctgagctagatacaaaggttcaccacgtccccatcagattagttagatagggagtttccacacacaggttttccagagccccaccagagcagctagatacagagtgttgattggtgcattcacaaaccttgagctaaacacagggtgctgattggtgtgtttacaaaccttgagctagatacagagtgccgattggtgtatttacaatccctgaactagacataaaagttctccacgtcctcaccagagcagctagatacagagtgtcgattggtgcactcataaaccttgagctaaacacggggctgattggtgtatttacaatccctgagctagatataaagactctccacgtccccacccgactcaggagcccagctggcttcacctagtggatcccgcaccggggctgcaggtggagctgcctgccagtcctgcgccgtgcgctcccattcctcagcccttgggtggtcgatgggactgggcaccgtggagtagggggtggtgctcgtcggggaggctcgggccgcacaggagcccatggagtgggtgggaggctcaggcatggcgggctgcaggtcccgagccctgccctgcgggaaggcagctaaggccgggcgagaaatcaagcgcagcgccggtgggctggcactgctgggggactcagtacaccctccgcagccactggcccgggtgctaagtcccccattgcccggggccagcaggctgctccgagggcggggcccaccaagcccacgcccacccggaactccagctggcccgcaagcgccgcacgcagccccggttcccgctggtgcctctccctccacacctccctgcaagctgagggagtgggctccagcctgggccagcccaaaaaggggctcccacagtgcagtgggggggctgaagggctcctcaaatgccaccaaagtgagagcccaggcaggggaggtgccaagagcaagcgagggctctgaggactgccagcatgctgtcacctctcataagtatattgaagagatacctgcacttttacatttattgcagcactattcacaatacccaaggtttggaagcaacctaagtgtccatcaacacttagatgaattcacagagaaaatgtggtacataaatgcagtagagtactattcagcaataaaaaagaatgagatcctgtcatttgcaacaacatggatggaactggaggccattatgttaagtaaaataggccaggcacagcaagacaaacttcagatgttcttacttatttgtgggaactagaaattaaaataattgaactcatggagataagagagtagaaggatagttaccagaggctgggaagggtagttagggggtagggtgtgggaggtgggcaaaaaaaatgaatgaataagatgtagtatttgctagcaaaaaagggtaactataatcaaaaataatttaattgtacattttaagagtataattgggccaggcgcagtggctgaagcctgtaatcccagcactttgggaggccaaggcaggcgcgtcactagaggtcaggagtttgagaccagcctgaccaacatggtgaaaccccatctctactaaaaatacaaaaattagtcgggtgtggtggtgcacgcctgtaatcccagctactcaggaggctgaggcaggagaatcgcttgaacccaggagacgaggttgcagtgagccgagctcgcaccattgtactccagcctgggcgacagagcaagactccatctcaaaaaaaaaaaaaaagtataattggattgtttgtaacacaaaggataaatgcttgaagtaacagatactgttacttcacattattaatgataaatgttaaaacacatttaccctgatgtgattattacacattacatgcctatatcaaaatatctcatataccccctatatacacctactatgtacccacaaacattttttcactattacagtttaagatcatcacttaacaaatggtatttatgtcacctatatcctcgtacagactgttctattcccatagaccagaatgtcctcagagaacaaaaacaatgccaacagtgtccctctgctgatattcaaattataatagcaatttaatattaataaagaactatggtttaatgtcagtttgaacccagcatcttctctgcagattgtcagggcctccctggacagtgcagatttaaaaaggttatatgactaaagagaaagcaccctgctcttgtcaggacagagtagggtatggacactctaggggaaaacctccacactcctccccagtacagaggatcacccagaataactttgtaccagatcacagcagaacctggcaggactctgatctgccccctcagatgctgcccacatctccaacatggagttctcagacccagccttcttgtttcgacttggcccacctttcttcaacacctggtggctttcttcctctttctctgtctgtccttccctttctctttcacctgttttcacttcgcttcctgtacctatgcatcacttatctggtagcagcacataatgaaatctttccttccatttgtatgataggtaggaaatcactggtggaattaatccagtccacattatacaaagtttaacagaaaattaagaaacctaggctgggcgcagtggctcacgcctgtaatcccagaactttgggaggccgaggtgggtggatcatctgaggtcaggagtttgtggccagtctgaccaacatggtgaaaccccgtctctactaaaaatacaaaaaattagctgggcgtggtggcgggtgcctgtaattccagctacttgggaggctgaggcaggagaatcacttgaacccgtgaggtggaagttgcagtgagctgagatcgtgccattgcactccagcctgggcgacagagtaagactctgtctaaaaaaaaaaaaaaaaagaaacctaaacaggcataaatttagacagtccctgggtcagtgatctctattccatgtgaacctatttaataggaaatgtcagaaaatttcccaaatgaatgtttagacctcattcccatgcatttataacccagctaggttgaggtattacctcaaccatttcttaagaaattgacttcaccgcagatcttcaaaccatttcaacactgtttttccttagtgtatgcattgcagaaaacctcaaacctctgcagaaagttggcatgctaagcttttttggcatcttgttttttgaatcttatattggggaacccttaaagcgagtatgtgcagctacttaaaataggaaaagtgtgccaccttctggccttgaacgtctgttgattcagttcaaatctacctgtctcaagtgatcctatctgctcctatttcacatatatttcatgaaatttagaccaaaggaaaaacacattttttatcttgtaatttttaaaatttgaaataatttcaacagactttgaagcattgcacattttgcttaaagtaaaattgtttcctttggtgtaggattaatgaaaaattctctaagtacagttccatgaagatttctacccaaaagcactgcttgggcagcatggtaaagaacatatgtacagggccaggtgggaaacagcagtgagaacacacagagcctgttcagtgaaagcaaaggctctgatgggtcaagggtgatgtgtgggagcagggagtcatgttgttgggtaagacaatacaatcagatcacagtttaatctgactaattctagcttgagtctagcatgcaggatgaagttgagcatgtagaaagaaatgagattgttgcagcagtggaggcaaaagtgtgcaggcagagtacacacaattcagcaggaacattaagaacccaacagagaaatagaggacatgaattgttaactttcaagataaaaggtattaacacatactgctggcttcaaaagcttgtatttaacatttactatacacatttccaacttccagctcctagcagcttgtttgctagacctcagcaatattcccagctgtcccctttttctagatatcaccaaggatgtgcatcatatatgtgaaaggaaaatatcttggacccctaaaatcactaagcgaaaggaaaattcaaactggaaactactcagggcaaacctagctcccattctattcaaagtcatccctctgctcactgaggtagatgcatatctgactgcctcctttggaaaagcttatcagaaactcaaaaaaatgcaaccatttgtctctcctctaccagtgccctggaagctccctccttgctttgagttgtccccgcctttctggatggaaccaatgtacttcttacatatattgattaatgtctcatgtctccctaaaatgtataaaaccaagatgtgccccgaccaccctgagtacatgttgtcaggacctcctgagactgtgtcatgggagcgtgtcctcaaccttggcaaaataaactttctaaattagctgagacctgtctcaaatgttcgaggttcacaaatataatgataagccatgtttgctgtagttagcacctagcatccttcatgaaggcagaaacccacagttctcagtcttcaaaagaccacattgccactgctgacactgctcagtccctgacttcctgtcaactgctcgacacacagtctccacaggaccaggcataacgagataaagatttaatgttcttggcacccaaactctagttgaagaaattgcctttatttggagttctcccttgataaccgctggcagaactgagggctgagaacacttgaagggagctgaactgctgggcgtgccgtggggcagcaggttggcagtcacaggaaaggaggggagggggtggggcaagcgagggcagctggggaaggtgagctgggagctgctgccagatgagaaggagggtaaggtgggatgtgtttgaggagcctcggagcagcatagaaggggctgagattcacatctcagttgtatggaactgaacttgaaggcaggcagtgctgtgataacgtaagcttttaggaaatcatagaagtctcagagttttggagttacccagactatggaaataggagttggaggcaaattatattcagatctcaagggccagggaggtttcaatacctggtagtgcagatttcgtatctagtctgggaggtgggcagtggcagtgagaaccttctctcaaagaagactgcagattaaactctgtctcctgctcagcgcacttgttttcacattgtctgtggtggctttgactcaagcagagttgaatagttgtgatagagactggatcacctgcaaagatttactgtctagccccaaaagcacgtctggcaacccctgacctcaagtattaatgagcctttcagtgtgcaaagaaaggcctgtatccaggttgggggaaagacaaacttctcaagaagaacgtaggtacagaagccgcagagagagcgggaaggccatggggaagagcagctccagcccccatggcagtcatgagcacttaaaatgtttccacatgggggctccagtgattaggctcgaacaaagttaactgattaactttcaagaaagatcagagaaacggctggtcttggctagaaaccttggctctaccacagaagagcaatgatgagaagggaactctagagtgaaaactgcagaggcctagaaaggtgaggacggacagagggcctttgagagcaggaatagggtggggctacaaatctcttgttcatgtgcacctttgagcattcatgggggaagtctgatagcagtattagaaattcaaggaaaaaacagctggtttaccaatgtaatgtgattaaaagacggttctcatcagaatccctcaattctctcccccctcaccaaatccccttcccatctgcttaattattaacccttggaaactcagcttgagaattactccccccagccctctcccaggcaccaactctgcatctccatagcccccattccagaccgctcaggatgtcctagctgtggcacagatggttatttgccagtgttccttctccccttgttccttggcagaccaagtggacacatgacctcccagaataaaaactgtatttcgcagctgatacggtttggatctgtgtccccattcaaatctcatgtcaaactgtaatccctgatattgaaggaggggcctgctgggaagtgatcatgggggtgggtcctttgtgaatggtttcgcaccatccccttagtgctgttctcgtgacagagtccgcccaagacctgcttaaacgtgttcagcaccacccctcgctccgccttgctcctgttcccaccatgtgagatgcctcgccccgccccaaccctttgccttctgccattactggaagtttcctgaggcctccccagaagcagaagctgctatgcttcctgtacactctgtggaaccatgagccaataaacctctttattacccagtctctgctatttctttacagcaatgcaagaacagactaatatatcagcttccctttgtgtggcctgaagaccacattctgatcaacaggaagtaagcagtcgtgttgcgtaacaacccacagcaagctttaccagacagcttgtgtgtgccctttgtcccttctcttctttctgctgtttcagaatatgaaagtagtagccagagctcaaatctctctctctgtccctggatggcatactaagtagccacaacatgcaagatggacgtctgggtcccaaaagtggcagagctcccatgcctggggcttacctctggactcctgtgcctaagaaatgcctctcatttaaactactgttttcccccatgaggtgaagctatgtttctttctcccattagtactaccaccccaattccaaccagagaagtactaccaccccaattccatcctcagaagagggtgctcaaaaaacaatcccagcactttgggaagctgaggcaggaggaccacttgagcccagaagttcaagaccagtctgggcaacatagtgagaccctatctctacaaatttttaattagctgggcatggtggtacatgccagtagttcaagctactggtggggaggaggtgaggtgggaggattattttagcccagaggctgaggctacaatgagccatgattgtgccactgcactccagcctgggtaacagaacaagaccctgtctcaaaaaaacaacaacaacaacaacaaaacatggacagcaattacatcatgaagaggcttctatgccctccaaccacctgcattcctgttttattgatgttctaggctaaatattacacaggttagaatttggcattaaggagatagagaatcccagaaaaattttaaagctactcttaccccaaagaaaaggttttgaacactatatttgataactttctcttaaatttttaatatcacaattgatatggtttgtatttctgtccttgcccaaatctcatgtcaaattgtaatccccaatattggaggagggggctggtgggaggtgattgggttatgagggcggatttcccccttgctattcttgttattaaacctggttgtttaaaagtgtgtagacctccccaagctctcttcctccggctctagctatataagacgtgcctgcttccccttcgccttccaccaagactgtaagtttcctgaggcctccccagcttcctgcatgcttcctgtgcagcctgcagaactgtaagtcaattaaacctcttttctttataaattacccagtctcaggtagttcttcacagcaatgtgagaacagactaacaacaatcaactcatggctttaacacaaaaaaaataggtaagttcaaaattaacatattaccacatccaacttctttattcttgagaaaacaaaaaagtccaaaatcaaaggaaagcacccgttttaaaccctcatatctttctcagggctcactgcagtctggccatatctcaagcaggtctgtccaatggcttggaacatagacttttgcagtgaaactttaaaaacattacttgaattaggattacacaaaaaaaactaaattctaagtgagcacaactatcgctgagaccctgaaatttcaggaaataaacatggttcaaaactcaaactgttcatcaaaataattacgcaggtcagccaccactgcagaaccatcactgctcagaggaattgagtcagcaatgactgatctcatcatctcttcattagcacataagcggttcaacttgggatacgcaaggagtctctgcagaggtacgaaaaatttatctccaacacagaagggtgtgggagagttctctatcttggccttctcaacctctgtgaagactggtccaaagcatgggacaggggcctttgagccaccaatgtctttgggcttatcaccccgttccccagcctgttctttccgccttggcaggtggctcactcttaagctttccacttgttgggacacctcattaaccaacacaagtttaaagaacctttcctgctgtaagcttgggtatgaggtggtaaaaacctgaagggaaaaaacaaaacacttacaagtgtataataatataaacatacataaattttcaaagccatcaataacttttttgccatgtaagaataaatgtacatattgaatatatgtcagatcctactaatcgtaaatgcctcagttataatgggaatcaaatcactgacacatagaaattaactatccgatttgctttctaatgctaatgcccaatgtctcccagccaggtttctaccaagtcacatgaacccagtatttctacttgatattacaggggcaagggcaaaaaaaaatgaaaaatggttcagttaaaagggaaaacgtgggtaagtgcagtgactcacacctgtaatctcagcattttaggaagatggggcaggaggattgcttgaggatggaagttcaagaccagcctgggcaacatagtgagaccctgtctctacggaaaaaaaaacaaaaaacaaaacaaaaaaaagctgagcatggtggtgcacgcctgtcgtcctagctacttaggaggctcaagtgggaggatcgtttgtgcccaggaattcaaggttacagtgagccatgattgtgccggtgcactccagcctcggtgacagaacaagaccctgtccctaattaaataaaatttttaaagagggggaggaagtgtttcttcttcttctctctttaaaccaaaagggtctgagaagtttgtaggctcaaagagtaatgtcctaagccaagctggggagaaactgctgctggctttcctttttactactgataatcctaacagattacaaaaagaggttgctcaactattgctttcaagtattctgggtgtttttttgtagagatgggagatctcactatgttgtccaggctgcactcgaactcctgggttcaagcaatctttctaccttggcctcccaacatgctaggatcacaggtgtgagccactgtacccagctactttgaagtattctaagacaaccccagcagatcattccctttaacatgccttgaaacaccaaaaggccaggcagtctcaaaggacaccgtaggctaactcggacagtagtcatggggcctgaagaattctcctagagtgaaccacaaagcaaggtcatttacactcatctctactttggggattcttactccccaaaaaagttcaccatcctaatgtatctctagccctgatagctatctcacaaagaatactcacagctttataaacatgctgatcatgctgctctgaaagacatgattctgttgcctttcctccatttttccggaagattcctatctgggtacagtatccaacattctcagctccagctggtggttccccgacaccagtaaactccacagagtaatcatagcgatttgccacatataaagccctgaaaccaaaacgaggacagcaatcatttttctaaatgtagagctactgttaaataaggaaccatttctggtcagcagtaaaagagaacatgaaaaatacaatgaacataaatacttctaagttacaaattcctaaccaccagtgtatttatttctaagagaagtcaaggcaaggatatagtgtcagtttccaatttaccctaagaatatggaagacgaaaggaaaattatgggcagggtgtaggggtggacaaggaggcaacaagtgctcaacccaactacccatttgggtttgcaattacaccagaaaacatgactaagcctcaggagatatcccggggaggggcatgaggctcattctcactgtcccaaaccttccctctgttttgttcctcatctccatgccagtactacagatgccttcacataaaaggtgcccagtaaccacaccccctttccacacttgcccaaatgcaatggttcctttgtgatcttattacatactaagtcacacattggaatcaattttattggaagaaagtacaaaacaatttaggtaatgtatgtatatcaatatttatttcctaagattttaaactccaacaggatcccaaataaacaaaaacccttctgaacttaccaggtctgaaactccattctggtccactcaaatttatgatctgaatctcttaaggtcactgatggaaacaggggattgaattcagagtttggtgtgctgatgacaatcatggatggagacaggtacccaaataccacttcaggaaatctggccagatcacctgaatccaaatgttctattctaaaatggttaatgagaaagacataataaaatctagcttcacttgcacctatttttctaattgatttatcaaaaacaatttccatctgtgtatcgatttctcccttctttgaatatgtaataatgcttatatgacctaagaacaattattcgggccaggcacagtggctcacgcctgtaatcccaacactttgggaggccaaggtggatggatcacccaaggtcaagagttaaagaccagcccggccaacatgatgaaaccttgtctctactaaaaatacaaaattttgctgggtgtggtggtgcatgcctgtaatcccagctactcgggaggctgaggcgggagaatcacttgaacccaggaggcagaggttgcagcaagccaagattgcaccattgctctccagcctgggtgacaagcaaaactcagtcaagaaagatagaagaaaaagaaagaaggaaggaaggaaggaaagaaagaaaagaaagagagagagacagacagaaagaaagagaaagagagagaagagaagagaggggaagggaggggaggggagggggaaaaagaacaattattcatatattctcatcctttcctaccccccaactccatctatgatggctcccttatccaaccaaggtcctttgctgtgctctatggcctcattatcaatacctctaaaaaaaagtctctgaggttatacctccctgatataatgcatcaaggaggacaaaatcacttctatgatattcttgtcaaaaatgcatgccctgaatctgataatgaggagacactcagatacagcgacattctagaaaatagcacatattcttcagaaatatcaagggcaaataggaccaggcagaaaggctgcacagacctgcttcagattaaaggagcccaggcaaacgtgacaaatgcattgtgtgatcttgggccattttaaattatagctaaattttaaaatagctatagaaagacattactggaacaaatgatgaatgctgaatgtggacttagattaggtaatcgtactgtatcaatgttcaatttcctgatagaattacatggttatggtaagaagtctttgttctcagaatatacataccaaggtatctagggtaacaggacacagtgtatccaacctactctgagatggttcagataaaaaatacacgtagaaagttatatttagggaaaaagacacagtaaataggatcaaatataaataagtggtaaatctaggtaaagaacagatgagaattccttggaccattcctgcaacttctgtaaatttgcaattatataacaattaaatgttaccaaaaccgggtctgacaaagtcttgctgccatcccatctaagtcagtgtgtcctaagcaaactagacattgacaaaaatgcttcacagagggctgagcttctatgcaattcacaagaaaattgtaaaccagccaggcacagtggctcacgcctgtaataccagcactttgggaggccgaggtgggcagattacgaggtcaggggttcaagaccagcctggccaatagggtgaaaccccatctctactaaaaatacaaaaaattagccaggtgtggtggcaggcacctgtaatcccagctgctcgggaggctgaggcaaaagaatcacttgaacccaggaggcagaggttgcagtgagccgagatcgcgccattgcactccagcccaggcaacagtgtttctatgcctgacttatttcacttaatgccctccaggttcatccatgacaatttcattccttttttagggctgaatagtattccattgtgcatatacatcccttttttttttttgagacggagttttgctcgttgtgcaatggcgtgatcttggctcactgcaacctctgcctccaaggttcaagtgattctcctgcctcagcctcccaagtagctgggattacaggggcccattatcacgcccagctaatttttttgtatttttactagagacggggtttcaccatgttggccaggctgctcttgaactcctgacctcaggtgatccacctgcctcggcctcccaaagtgctgggattacaggcgtgagccaccatgcccagcctaaataccacactttctttatccattcatctactgatggacatttaggtagattccgtatcctggctactgtgctgttaataaacattggggtgcacatctctcttcaatataactgatttctttcctttggataaatacccagtagtgggattgctagatcacatggcagttctattttcagttttttgaaaaacctccacactgttttcaataacggctgtactaatttacattcacaccagtttatatgagttccctttctctgcatccttgccagcatttactgtctttttaataacagccattctaaatggggtgagatatctcactgtggttgagttgcatttccctgatgactagtgatgttgagcattttttcatctacttgttaaccatctgtatgtcttttgagaaatatctgttcaggtcctttgcccactttttatttggggtttttttgctgttgagattcttgtatattctagatattaatcccttgatgaatactttgcaagtattttctcccattctataggttctgttcactctattctttgctgtgcagaaacctttcagtttcatatattcccatttgtgtatttctgtttgtagcctgtgcttttgtagtcttactcaaaatctttgcctagaccaatgtcctgaagcatttcctgttttcttccagtactttcatagttttaggtctgcaattaactcgttaatccatcttgagttgatgcttgtatacagtgagagataggagtctaatttcattctgcatatggatatgcagttttcccagtaccatttattgaggagggtgtccttttgccaatgtatgttcttggtgtctttgttgaaatcagttggctgtaaatgcatggatttatttctgggttctctctattctgttccattggtctatgtctctgtttttataccagaaccacgatgtttttattactactgctttgtagtacattttcaagtcaagtagtgtgaggcctccaacttttaaactgaattttttagtagaggcaaaaggccatgtgtatacccttaattgattcaggaaaaaaaataactctaaagggagatggaggaggggtgaacaggagagggagggtgcaatgtacaaatgatttaaaaagtgagatgttaacatctggataaaggggggtataggtattcttggtactatgtatttgtggcaatttatctgtatacttgaaatttctaagtaaaatgttggaaaagcagagtaaaaagatattcccaaccaatgagcagttttccttacaataatcaagacctattatatttaggacactaagatcactgagacttattcaggcttttcaaatgaacagttatacagtgtatcagtttaaaacttacaattcaatacacgttatcaagtcaaatccaagcaaacgagagtctctctccacaacggagccatgatacaatgtgatggtcaaattcagatcccgaggtttcagaaaatcccccaggaaaggagctaacgaatccctgcaaaataattattgaagaaactttctgaacattatctatttaaaaattctcaccagctacagaactcagatcctctgataattatcttctacctctattgatataagtctgacacagcctgttttccttgtcttgacatattaaagaccaggtcatggggaaacttcctctcacagtgggaagttactggccaatgaaaaaaagactgaatatttaatattgttatattgttttcatttgtaatacttttggttttccagcttactttgattcagtgattttgagatttttgttctttagaaaaagaatattcttgaagcaatctgtggaaatctaatgtatatatactatatatacaagagataggagaaatgctatggttcaaaatgcaggcggtggcctggagccttggcctcagtgttctggggcattttaaatcctctgctataaattatcatagtgtccagcattaaagtgatgagattttgctatctgaattttaatttacaatgctttgattattataatcatttaattgaggctattctttaagttggtagcaataaaatgcaggtatttttagtgttatggcaaagcctgattattcagtgagttgaagatccctaatggccccaatcttttaaaacaaatataaaatcaacactttctctaaactcaataatgccattagttttagattaacgcataattctttcagaaactaagtattaccctctccatcgtaatttatcctcattaatatctactccaacaagcaattcaatgcatggattgacttttagcagccttaagagtgaagtatcaccacatcccaggtctgcaacctgtagatgagacagaatgttatttcaaagacatttatagcaagagaagtatgatcaaaaacttttttttgaggaggagagagtggagtatatatcagtaataaaataatgaaagtattatatggaaggatctttttggcagaagatgctacacacacacacacacacacacacacacacacacacacacacactaacctgaaactttataagcccataggcaaatttctatttgatcacactaaaatagaaaggtccattcctattccagaacaactgttattgtctatattgaactaatgagaaacaattacgtacacacagttttcccattcagaatcagaatttggagtcaaatattctcagcatatttcagcaaacaaagctttctaaaacttagctttcacccctcacacatttatttgattaaacaattacctcaaaccatctgaaattccatactgaactctgagctgccaaaaagccaattttagatgctttacctgaatacacatgcctagatggctacaaagatataaactaatacctacgcctttgtgtccaagtgtagaaacagtagtggtggagttaagggaaaccttcacacacaggaatcttcactgagtcttcaacatcaagcagaaaaagaaagctttcatctagaaattcaccttacccgcatctaattcacatccaatccattagtatagtaaccaggtatggatggatggatgtagattatatgcaattatgactttactctgaagttaaccgagtaggttcattatgatctaattttctttttgagacgggctctttctctgttgcccaggctggaatgcaggtgataacagctcactgcagcctcaacctcctgggctcaagggatcctcccacctcagcctcctgagtaactgggactataggcacgcaccaccatgcacagctaattttattttttgtagacacagggtctcactatggtgccaggctggtctcaagctagccacctgcctcagcctcccaaagtgccggaattacaggtgtaaaccattgcacccggcccattatcatctaattttaaaagaaccacaatacctgtggctacaataccagtttgcctgatattctaactaaatgctctagaagtacggtacctacaagatcacatccaactataaaatcttaagattttcttcacatttgaacctgacaatgctgaattctgtctgagccctgtgtttctggcatctgctaaaggaatccacctgtgctttgtgttccaggaaagggctcactgcaaaaaaccaccctcctccataaaacttagataagattccttgtgtttccattctttgcctcaaatgattatcatgaatacttgtccccactgatcaatgggaagaaaattccttttttaaccatactttattcaaactttacttcttcccccagggccctgcactacagcctgaggaaacagccccctccttaaggctccccattccactgtcctttcaaaccaccctctcatcccacctccctagtttctagctttgttcacttctccagtaaaagaaaaaccccttttgcttaactcttgagacacctgcagatcttgtggttacggcattctccctattgcaataacccctgtgaaaagtctctccatactaatccatttgacaaaacacctcatatgactagtctactagtcttaataattaaatgtttggaaagagaaatacctaccttcttaggctcatgttgatccactaaatttttaacgaactggtaccgctgtctgtatagtggaggtttaaactgaattgccgtctccctgggaacttcttcaaaattaccgtcaaccacactactgcactgaagttcacaaacaaaaaaagacaggttctaaatcatgcatgacttcagaaattaaataaggggcaaaaaaaaaaaaactttatttcccccaatcactttgaaaaacacactggccttcacataccctttgtcctaaaatcattaggtagcactgcatttcctccacagttcatgtaagcatcctctcatgccttttaacaagagagaatctagctgtatgctccctatagcttagtttcagctgaagggaacattaccaatgaatgtattcaatgaaaacaattagatgactcctaaccataagggaccttttgtggagtgagtcgccaaagcctgtggtccaagtaggcaggaggctggaaaatatttataatgactgactatatatatatacacacacacatatatatacacacacacacacacatatatgtacacacacttacacacacacacatatatatacacacacacacacatatatatgtacacacacacacacacacacacacatatatacacacacacacacacacatatatatatatatattttttttttccccccaagacggagtcttgctctgtcacccaggctggagtgcagtggcgcgatctcagctcactgcaacctccgcctccctcaattcaagcaattctcctgcctcagcctcccgagtagctgggattacattacaggcatgcgccaccatgcctggctaatttttgtatttagtagtgacgggtttcaccatgttggccaggctcttcttgaactcctgacctcgtgatccacccgccttggcctcccaaagtgctgggattacaggtgtaagccaccacacccagccaacactctttttaagagagagagaggatctcactatgtcgcccaggctggtttaaaattcctgggctcaagcaatcctctggcctcggcctcctgagtagttgggcatctgtaggaacattccaacacaccagcaaaagactctctcactgaccaaacttcagtcaggttcctctgagccatcttcttgaatagacctcaaaccctggccccaatcctatctttgggctgcctagcccagttttaataagaatacttctaagtcagtttagacagaatcttctacccctgatatctgatcaccctatctggtcaaattcttcatctttgcaatgttcttattgcaacagtcctcaataaagtcagactaattttttctttaacatgaccccaagaaaaaacagaatttataagattaatctgtaatagctgttactattcctatacagcagtattataaaagtagtccaaagggtatttgatatctgatgtagcactgtccaatagataaaatacaagtaggcaactttcttgtagcccaagaattggaattataatcggaattagaatatttaaaccaatatatcgaaaatataatttttacataaaatcaatataagagattttagattcttgtttttcacattaagtcttcaaaatccagtgtgctacatattttgtacttctgcgtctcagttccaaaaccttcatcagaaatacttgtctgtattggatttaaaaactttacatttaaaatatacatgcacatacccaagttattccaaacatacttttttccaataatgtaatcaaatatccaattttaaacttaaaattaaaaatgaagttatgagcccaggtggtcagcgttgcagttaaccgtgactgggcaagtgcattccagcctgggcaacagagcaagaccctgtcttaaaaaaaaaaaaaattaaagttcggttcctcaattccactagccacatttcaagtgcccacttgccatgtgtagctactggacagcagggagctacaccctaggtactcccaatgtggtttccaaaccagtggcatcttcacctagaaactttagaaacacaaaagcttgggcctcaccctagacctccttaaacagaatctgcaacttaacaaaatccccaggtgatccatatacacaaccacattggggaacactacttagagtgtttttaaaatagattttgctactttaacacctagtgataaaagtaaaaacatttattttacttacatacaccaaatgtgactctttcatctatgtatacccttgtttacctcaaccaacaccccgggaaatgctaggacctaaatgtgatcaattttgtttgcaattatctcacaatacatccaggtgataattcttaagagtcaaagacgcagctaagaagggtggcattacctgtagattattttcttccattttgtttcgaagttttgttgaaacaaaaatgaagatttatccttcaagctctatttgagagaatcagcactgactcagctgtaataaatacaaaaccgtttttgtaaagcgatacctgaaagaaatagctgcctagttcagaagggaagaacgaaagcctctttcttactccttactacagtatataatttaaatagaacgcttaaaagtaaataatgaattcacctctgagtactcaaaaaaaaaaaaaaaaacacgaaagcaggactcgaacagatatttatacaccgaagttcatagcattattcacaatagccaatctgtggattaaatgtggactaccatttaatccacagaatgtatccagtattttttcagacattcgcaaacaggctcagaaagcgtaacttttcactacgtcaaaccctactaagagcgaaaacagccatcctttccctttactatcatgaatagttcaactagatacaaacggagcaatcttaggagttctgcccatttcattgctaagaccctcaacttcaaattttttcaaaaatttttccacacatcgtcaaaatgaaatttcgagggggaaaaaaagtgtccttgataaactagagatgctccaacatctattcaattcactcacgaacttgaatttaaattttagttctctattgcacatgtgtctccaacaactagactttaatctggaatctaggcaacatgttagtcaccaacttgtattaagaaaccctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaagaaaaagaaaaagaaaccctgctcactgaaaccaacgcttctgtctttgtacgggccgtcgcttccatcatcctgcggtaagcagcatgcccaaccgaaaaaacaaagctcgtcgcggagccgccagcgtcctcaactcagcgccgccctgacgcccgcgcacgcacggcctcgctgcgtgacgctaccgccgcggctacgccggcgcccgcacccgcgcctcggcctccccgcggggctcgccaacctcgtgcgctctcacggtcggccttgggccccgggagcctcatggtgcgccgagctccgtccctctaggctctcagttccaaggcgtcggttttgcgtctcgtaacggccgctgtggcgcatgcccagaagccattttcaaggtcctcttccgaaccttggcgaggacccctgcgcctgccgcgccgttgaccccgctagcgtgcggctgcgacgcggcacggtacggcagctgttggcgaaggcccccaactccgagcgcgtccgcagaccgcgagccggaaggcggcttgggcggctgttgagttcgtggcgctcccgaggcgtggcaaaggcctaaaaacggtcctggccagcggaaggcggcaagaggagcagcaaggctccacgcgaggcggccggcggctggagtcccagtcagcctccgctttcatcccagagcagtccacgggggccttaaaggaatgtaggctgggtgaagttggcccagtgacacctgcgttcagaaaaacgttctttccgctcccaacgccccctctccaccgccacccgacccccgaaatagttttccccgagtgttgtggatagaactgttgatctcttggaaaagttattgtatcctgccatccttccctctggagactccacttaatatatataagtactttctttcctgtatatgatggaagagtattaggggggtgaggggagggacgaagctgccttctttagggaaaaaagattgacttatattttgaaagatgcaaaagctggtgtttttgctactgaattaatagcctattaatatgccacaaatgatatattggaactgtattttcaaacatttaacgcctgctgtatgcaaagcactatgctgacagcttaagggtaccacaatgataaattacaccaatcttgtttttggcattttggggagtctagtgtcataggtaaagaagtacataactaacaataagcttcaaaaattcaatcataaggcccggcaccgtggcttccgcctgtaatcccagcactttgggggatcacttgagccccggagtgtgagaccccgtctctaccaaaaaaaaaaagaaattagctgggcatggtggtgcctgcctgtggtcccaactgtttgggaggctgaggccggaggatcacttgaccccaggaatctgagcctgcagtgagctatgattgcaccactgcactccagtctgggcgacagaaccagaccatgtctaaaaagaaaaaacactcagtgataatttcacattacagtttgagaggttcctgttgacttggggaaactagttttagcagacttcattaaaggagtgtacaccttactacaggatgtaatttaaaatagaatgtttaaataataaattcacttctgggtatatactcaaagcaggaattcaaacaggtatttgtacaccaaagttcgtaacagcattattcacagtagccaaaatgtggaaacaacccaaatgtccattaaaggatgaataaacaaaatgtgatatacatacaatggaatattcagcctttatttttccaatcagagtttcaggaaaatcaacctttaaaaggagtgaaattctgacatttgctgccacatggatgaatcttgatgatgatatgctgagtgatatataatcagtcacggaaggacaaatactgcatgattcaatttatatcaggtacctagagtagccaaattcatagagacaaagtagaatggtggttgctacgggctgagaggaggagggaattgagagttgtttaatgggtgatggaaaagttttgtagataggatggttgcactgaatgccactgaacttaaaaattgttaaagtggttttatgtatatttaccacagtttcaaaaattttaaggaaaacataaaagctatcatctatacagcattcctggatctagggtttttgcctcccctgctggttagcccatttatgaacttgagctcctcatgtccattccctctccaaatttgcctatttcatcattctcctggcctcctactcttattagagtctgaaaaatcatccttggctctgtccatttttgtccttcccacacttggacaatcaccaaattttgacttcttcaagctgtcatctaccatctgttccttcccacagctaatagcttagccttgtcatctcattttgtcattataactcatctttccttcgtacacaaggtaagtcctactgagttatagaccatgtaacgtcttttagagtggattttaagtcaaataggccttaaatccagattttactattactgcataacctttggaagttgcatcctctctgagtgttagggggtttttttaagttaaaaaatgagaaatgattacttatttggtaaatgtgtatagagtatttattatggatcaagtacttgtttgaatttaaaagacagataaagatcctttcatagcttttacagtccagcaggtgtaggtgtctggcacacaataggtaatcaagagttatcctgggctgagtgaggtggctcatgactgtaatcccagcagtttgggaggctgaggcaggaggatggcttgaggctaggagttcaaaaccagcctgggcaacatagcgagacctgtctctacaaagaaaaaaaacattatctggccatgctggcgggcacctgtactcctaggtactcaggaggctgaggcaggaggatcgcttgagcctgggagtttgaggctgcagtgagctgtgatcatgtcactgcactccctgggcaacagagtgagaccctgtctaacaaaaaattaatttcaaaatttaaaatattttttaatattttaaaacggagtctggttctgtcacccaggctggagtgcagtggcgtgatctcggctcactgcaacctccacttcccaggttcaagcgattctcctgcctcagcctcatgagcagctgggattacagtcacgcaccaccatgcccagctaatttttgtatttttagtagagacagggtttcactatgttggccaggctggtctcgaactcctgaccgcaagtgatctgcccgcctcagcctcccaaagtgctgggattccaggcgtgagccatcgcgcctgacaaaattttttaagttattctggatgccagtttgagcctgatgcttaacaggatggaatatttggaggtcttgagaagagggtgattgtatattccatgtaagaggaatgtaaatagtttgtgtctagaaggaagattgtaacagattaagatgtacgaattccttctcacctattgagagaaacggggtctatttcttttccttttgaatctatatgggttttgtgatttcaccaatgaatagaatacctctgccagtttttgggcctaggacttaagaaactggcagcttctacttcctgttttttaacgcatccactcttggaacccaaatgacaatctgcgaagaagactaaggggccccacggagaggcccacatggagaaaactcaatcccccctcacccgctatcccaggctgtcagccagcaccaccttgtcttgccagccatgtgagtgagccatgttggaagtgaatcctccaggcccggtgagccatttaaactgactgaagacagcagctctgtccatgtgcacagagagtgggaagtgcctgaaaatttacattttcctaggtagtgctttgctaatgactgaccggtgtggatgtataaaagtccagctccgtgatctcagacttccggcctccagaactgtaagaaaataattttttgttgtttaagccatccagtctgtggtattttgttacagctacccaagctgactgataacactgaattatgtacataactgaataaccacctatggagcaataagagcacatttggagcatcttctctaccaagcaagaaacaaaaacgttctcaccttatcaatattctacaagttaacctctaacttctcagggttgttaactgtttggactctcttgtttgtagggagtgactcagagaaagttagagtccccaagagagccatatgcctgagagacaggcttaattctctggcatgttactaaaatgtcagccatgtgcagtggctcatgcctgtaatcccagctctttgggaagctgaggcaggaggattgcttgaggccaggagtttgagactagcctgggaacggcccttgtctccaaaattaaaaataaattttttttagaaaatgttaaatactgtgaaataatctatttccaagtgttggatattttttctgcacagtagtgaaattattgctggctgtctcggtgtaagaatggccattgagctgcctcatatcctgatgggaaggtgcagggccagaagttgaatcacactatgagtgtgttttatgggccagctgtgaacctatgaaagtagcaaagaagaaataagatttgaaaagcatgattccaaaagagtctggaaaattcttccagttgtcagacatgcaaagttgtaatttcatatccataattctttatgctttttcttatagcaggccctgacattgtataagcttcaggccccacaaaacctggatctgccctgccaggatcagcatctagaggaaaactactacttccacaatagcacaaccaatctgatcatccctgcatcagtgagcattctccagagaaacagagccaacaggatatgtgtatatatgtgaagaaagacttattttaaggagttggctcatgcaattatggaggtgcaagtccaaaatctgtagggcaggcagatgggcagactggagacccagagaagagttgcagttcaagtccaaagtcggttggaagaattccctcttgctgggtaacactggggaagcaggagtagatggaaaggggaggtgtcaggctttgctctaccaaggacttcaactgattggatgaggcccagtaacattatggagggaaacctgctttgctcagagtttactgatttaaatattaatctcatccacaaaaaaataaataaccttcacagaaacatttagaatatttgaccaaatatctaagtcccatggctcagacaacttaacacataaaattatccatcacaattccattatcccaatacaggtcggcagggccttgggcaggtggtaacctcagctctggagtctacagcaatactctcacacttaacagatgtagttctgtgggtccaggtcccacttcgcaagagagaatctgatgggctaatttcgaccaagtctcctttcctagttcaatcacgtgtaagggttagagaaagggttgggctcacaagggacttagggctgcctctctggacttgggagagcaggacttctcaagagataaatggttagagagtaatataatttggatatttgtcccctataaatctcatgttgaaatttgatgttcaatgttgagggcaggtctgggacctccctccctgcttttgctccccctctcgccatatggcacaactgctcccttcaccttctgctatgaatggaagcttcctgaggccttcaccaaaagcggaggctggtaccatgcttcacgcacagcctgcagaatcatgagccaaataaactacttttctttataaatcatccagtttcaggtattcgcttatagcaacacaaaatggactaatacagagaggaaatattttgagcacattgaaggccccaaaatattgagctttttttttttaacctatatagtacttttcttgcatctcagtttgcttatctatagaatgaggattaataagacctaccaacttcagggggtcattctggtgagataagtgaaaaaatttgtaaagaagtgtataaatttaccattgttttttaaaactaaaatgatctctaacactaagttgatgatctgatcacaaagatggggtagatgaaatgaagagaaaaggtttctgacatttgtatacttagaaatgtatccaggctgggcatggtggtccatacctgtaatcccagcactttgagaggccaacgcaggagggtcacttgaggccacgagttcaaaaccagcctggccacattgagaggtgacagtgtgttggcagtcctcacagccctcgctcactcttggcgcctcctctgcctgggctcccactttggtggcacttgaggagctcttcagcccaccgctgcactgtgggagcccctttctgggctggccaaggccagagccggctccctcagcgtgcagggaggtgtggagggagaggcgggagcgggaacccgggctgcacgcagcgcttgcaggccagctggagttcgggtgggcgtgggcttggcggggaccgcactcggagcagccggcgggacctgccggccccgggcaatgaggggcttagcacccgggccagtggctgcagaggttgtactgggtcccccagcagtgccagcccaccggcgctgtgctcgatttctcgcctggccttagctgccctcccgcggggcagggctcgggacctgcagcctgccatgcctgagcctcccaccccctccgtgggctcctgtgcggctggagcctccctgatgagcaccgccccttgctccacggcgcccagtcccatcgaccattcaagcgctgaggagtgcgggtgcatggcgcgggactggcaggcagctccacctgcagctctggtgcaggatccactgggggaagccagctgggttcctgagtctggtggggagtggagaatctttatgtctagctcagggattgtaaatacaccaatcggcactctgtatctagctcaaggtttgtaaacacaccaatcagcaccctgtgtctagctcagagtttgtgaatgcaccaatcgacactctgtatctagctactctggtggggccttggagaacctttgtgtcaacactctatatctagctaatctggtggggacctggagaacttttgtgtctagctcagggattgtaaacgcaccaatcagcgccctgtcaaaacagaccactcagctctaccaatcagcaggatgtgggtggggccagataagagaataaaagcaggctgcccgagtcagcagtggcaacctgttcgggtccccttccacactgtggaagctttgttcttttgctctttgcaataaatcttgctactgctcactctttgggtccacactgcctttatgagctgtaacactcaccgtgaaggtctgcagcttcactcctgaagccagcgagaccacgagcccaccgggaggaacaaacaactccagacgcgccaccttaagagctgtaacactgactgcgaaggtctgcagcttcactcctgagccagcgagaccacgaacccaccagaaggaagaaaccccgaacacatctgaacatcagaaggaacaaactctggacacgctgcctttaagaactgtaacactcaccgcgagggtccgctgcttcattcttgaagacagtgagaccaagaacccaccaactccagacacaacatgacgagaccccatctctataaaaaatttaaaaattggccagtgtggtcgtccatgcctatagtcccagctacatgggaggctgaggtgggacaatcaatcacttgagctcaggatttcaagcctgcagtgaactatggtcacaccactgcactccagcctggataacttgtgtcagaaaaaaataaaaatgagagagagggaggaagagagacagagaaagagaaagaaagaagggagggaagaggaaagcaagggaaagaagggagggagggaagaaggaagaaaggagggggaagaaagaaggaagggaagaaggaagaaagggagggaggggagaggaagtatgtattcagtcagggttcttaattgcaaacaatggaatgcactcaggctggtttaagtagaaaagtaattttttttttttagatggagtttcactcttgttgcccaggctggagtgcaaaggtgagatcttggctcactgaagcctctgcctcccaggttcaagcagttctcttccctcagcctcccaagtagctgggattacaggcgcttgccaccatgcccagctaattgttgcatttttggtagagatagggtttagccatgttgaccaggctgttctcaaactcctgacctcaggtgacccacccgccttagccttccaaagtggggattataggcatgagccaccacgcccagccgaaaagtaatttattattgaactctcacccaatctcttagacaactaaagaaccctactcattattttattttttaaattgagataatgttttgctgtgttgcccagcctggtctcaaactcctgagatcaagcgatcctcctgcctcagcctctcaagtagctgggattacagatgcataccaccatgactggcttctgaatctaattctcaaatccacgtatctaatggattgagcctaggttatttccagcttcaagggtcttgggttgtaaaatgttttaggtggtggggatgaggcttccatttgggtaagatgaatatcattacgtgggaaactaccgaaatgtagggacagtgttcaaatctacaaataacaaatttctaccacagaaaagtacacgttgagtatccctaatttgaaaaatacaaaatctgaaacttctgagcacccgaaacgatggcacaagtggaaaattccacacctgacctcatatgatgagtcacagccaaaacgcagttaaaactttgtttcaagcacaacattatttaaaatattgtataagaaaggggagtaagatggtggaacagaagcctacactgtttgccccctgcccgttggcaggaacaccaaattttaacaactatctatacacagaaaagcaccgtcacaagaaccaaaactcagatgagctatcacagtacctgattttgacttcctatcactgaaaaaggcattgaagagggtcagagagacagtcctgaaccgccaacaccaccctttcctcatcccctggcacagagagtctatgcacttgggggtgggagagcacagtgactggggaactttacattgaactcagtgcttccctgtcacagtggagaggagaggaaagctgtgctgcaatcaggcagtgcctgcgcgtgaaaggaacatttggaccatacctagccagcggggaatcacccaccccagtggtcagaacttgagtttttttggtaagcctcgccactgcaagtcaaagtgctctggggtcctagtaaagttgaaaggcagtctaggacagaaagactgcaattcctaggcaattcttaattgctgggctgggctctgagccagtggactaggatggtatgtgacctagagagacaccaggcagggtggctgaaggagtgcttccacaaccccaagcagtgcagttcacagtggcaaaagtgactctttccttctgcttaaggagaagagagtgaagagtaaggaggactttgtcttgcataccagctcagctgcaataggatagagcactgaacagagtcataaggcccccattaaaggcccttgctcaaggatgacatttctagacataccttgggccaaaagggaacccactgccttgaagggaagggcccagtcctggcaggattcatcacctgctcactaaagagcccttgggccctgtataaccagcaatgatacccaggcagtatgccatgggccttgggctctgagatgtgctgacttcaggtgagacatagtacattcccagctgtggtggctatggtgacacactccatctgattaagaaaaacagagggaaagggaaaggggactttgtcttgccccttggatacaagcttggccacagttgggtagagcaacaaacaggctcttgcagttcccaagtctagacctaggctcttggcagcatttctggacctgcactgggccggaggggagcccactgccctgaaaggtgagtcccaggccttttagcattcactacaagctgactgaagagcccctgggctttaagtgaaaatcaagagtggcctggcagaaccccgctctgggctgatggtggccataggcagaggctcttctgcctaagtaaagcagagaggggaacaggaaggactttgtattgtggtttcagtgccagcttagccacagtagactagaatatcagacaaatgtatcaggtttttgactccaatccctggctcatctctggacctgcctaggggaacttgctgctctgaagggaaggacataaacctggctggctttgccacctgctgattgtacagccctagggccttaagtgaacataggtagtagccaggtagtggttacagcaggccttgggcaagacccagagctgtgctggcttcaggtctgacccagtacagtcccagtggtggtgaccacaggggtgcttgcatcactacacccccagtttcaggtggctcaggacagggagagactctgtttgggagaaagtacgggaagagaacaagagtctctgcctggtagtccagaaaattcttccagatcttatcaaagaccaccaaggcagtacctctgtaagtatgcaagaaatacagctttattgggcttggggcccaagtcccttcaaatacctggaaagccttctcaagaaggatgggcacaaacaagcccagactgcaaacattacaatagatacctaactctttaatgcccagacactgacaaacatctacaagcatcaagatcattcaggaaaacatgacttcaccaaacaaactaaataaggtactagggaccaattctagagagacagggatatgttaaccttcagacagaaaattcaaaatagctgttttgaggaaactcaaagaaattcaagatgacaccgagaaggaattatgaattctaccaaataaatataacgaagagattaaaataatttttaaaaatcaagcataaattctagagttgaaaagtgcaattgacatactgaagactgcatcagtctcttaatagcagaactgatcaagtagaagaaaaaagtaatgagcttgaagacaggatatttgaaaatacagtcagagaagacaaaataaaaaagaatgaagcatgcctacaagatctagaaaatagcctcaaaaggggaaatctaagggttaatggccttaaagaagaggtagagaaagagataggggtagaaagtttattaaagcaatagtatcagagagcatcccaaacctagagaaagttatcaacattcaagtacaagattatagaatcccaagcagatttaacccgaagaagactacctcaaggcatttaataatcaaatcccaatattaaggataaagaaaggattctaaaagcagcaagagaaaaaaaccaacaaacattggagctccaatacatctggcaggaagcagacttttcagtgggaacctcacaggccaaaagagagtgatatgacatatttaaaatgctgaaggaaaaaaacttttaccctagaataatatattcagcaaaaatattcttcaagcatgaaggagaaaaaaaaaccttcccagacaaacaaaagctgagagatttcatcaataccagacctgtcctgtgagaaatgataaagtgaatttttcagtctgaaagaaaaggatattaatgagcaagaggagactacctgaaggtacaaaactcactggcaagggtaagaacacagaatagtataacactaactgtggtgtgtaaacttctcttgacttaagtagaaagactaaataatgaacaaataaaaaataataactacaacaacttttcaagatgtagacaatacaataagacataaagaggaccaaagctaaaaagcagggggacgaagtcaaagtgtagattttttgttagttttttgtgtgtgtttgttatgcaatcagtgttaacttgtcatctgtttaaaataatgggttataagatagtgtttgcaagcctcatggtaactgcaaatcaaaaatcatacaacacatacacaagaaattaaatcataccaccagagaaaatcaccttcactaaaagaaagacaggaataaaggaaaaaaaagagaagactgcaaaacaaccagaaaacaaataacaaaatggcaggagtgagtccctcctcaccaataataacattgaatataactggactaaactctccaataaaaaggctgaatggatgaaaaaaacaagacccacggatctgctgcctacgagaaagacacttcatctataaagatacatacagactgaaaataaaaggatcgaaaaggatattccatgccaatggaaaccaaaacacagcaggagttgctgtacttacatcagacaaaatatatttcaagatgaaaactgtaaggcgagacaaagaaggtcaccatataatgataaaagggtcaattcagcaagaggatataaccattgtaaacatacatgcacccaacaccggagcacccagatatataaagcaaatattattagaactaaagagagagatagacctcaataggataatagctggagactctaacaccccactttcagcattgggcaagtctcccttacagaaattcaacaaagaaacattggacttaatctgccctaaagaacgaatagacataatagatattaaaagaacatttcatccactagctgcagaatacacattcttctctttagcatatggaccattctcaaggatagaccatatgttagatcacaaaacaaatattaaaacattcaaaaaaattgaaataatttcaagcattttctctgaccacaaaggaataaaactagaaatcaataacaagaggaattttggaaacaatacaaacacatagaaatttaaacaatatgctcctgaatgactagtgagtcaatgaagaaattaagaaggaaactgaaaaatttcttgaaacaaataatagaaacacaatgggctgggcacagtggctcatgcctataatcccagcactttgggaggccgaggagggcagatcacaatatcaggtgattgagaccatccgggctaacacagtggaaccccgtctctactaaaaatacaaaaaaaaattagccaggcttggtggtgggtgcctgtagtcccagctactctggaggctgaggcaggagaatggcatgaacctgggaggcggagcttgcagtgagccgagatcgcgccattgcactccagcctgggcaacagagtgagactccgtctcaaaaataaaaataaaaaataaaaatagaaacacaacatacccaaacctatgggatacagtgaaagcagtactaagaaaaatgtaaagctataaaagcctacatcaaaaaaaaggaaaaacttcaaataataacctaacagtgcatgcatctaaaagaacaaggaaagcaagagcaaaccaaactcacaattaatagaaggaaagaaatagcaaagatcagagcagaaataagtgaatctgaaatgaagaaaacaatacaaaagataaactaaaccaaaagttgggttttttttaaaaagataaacaaaattggcaaacctttagccagactaacagaaaaaaagggagaagacccaaataaaatcagagacaaaaaaggagacattaccactgataccacagaaattcaaaggatcattagtggctactattagcaactatatgccaataaactagagaatctagaggtatggataattcctagacatgactcaccaagattgaatcatgaagaaatccaaatcctgaatagatcaataacaagtaatgagatcgaagatgtaataaaaagtttcccgctctccctctacctctccctctccctctccgtctccctctccccacggtctccctctctttccaaggtctccctctcatgcggagccgaagctggactgtactgctgccatctcggctcactgcaacctccctgcctgattctcctgcctcagcctgccgagtgcctgcgattgcaggcacgtgccgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctggctacaacctccacctcccagccgcctgccttggcatcccaaactgccgagattgcagcctctgcccggccaccatcccgtctgggagatgaggagtgtctctgcctggccgcccatcgtctgggatgtgaggagcccctctgcctggctgcctagtctggaaagtgaggagcgtctccgcccggccgccatcacatctaggaagtgaggagcgtctctgcccggccgcccatcctctgagatgtggggagcgcctctgccccgccaccccatctgggatgtgaggagcgcctctgcccggccgccccgtctgagaagtgaggagaccctctgcctggcaaccaccccgtctgagaagtgaggagcccctccgcccggcagctgccccgtctgagaagtgaggagcctctctgcccggcagccaccccatctgggaagtgaggagcgtctccgcccggcagccaccctgtccgggagggaggtgggggggggtcagccccccgcccggccagccgccccatccgggagggaggtgagggggtcagccccccgcccggccagccgccccgtccgggaggtgaggggcgcctctgcccggccgcccctactgggaagtgaggagcccctctgcccggccagccgccccgtccgggagggaggtggggggtcagccccccgcccggccagccgccccgtccgggaggtgaggggcgcctctgcccggccgcccctactgggaagtgaagagcccctctgcccggccaccaccccgtctgggaggtgtgcccaacagctcattgagaatgggccatgatgacaatggcggttttgtggaatagaaaggggggaaaggtggggaaaagattgagaaatcggatggttgccgtgtctgtgtagaaagaagtagacatgggagacttttcattttgtgctgcactaagaaaaattcttctgccttgggatcctgtagatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtaatcagggacacaaacactgcggaaggccgcagggtcctctacctaggaaaaccagagacctttgttcacttgtttatctgctgaccttccctccactattgtcccatgaccctgccaaatccccctctgtgagaaacacccaagaattatcaataaaaataaaataaaataaaataaaaaaagggacagaaattgtgcattcggggagctcggattttaaggcagtagcttgccgatgctcccagctgaataaagcccttccttctacaaaaaaagaaaaaaaattcccaataaagaaaagcccaggacctgctggcttcactgctgaattccaccaaatatttaaagaactaatactatgtacattttaaaataattaagagtataaatggatggctgggcatggtggcgcatgcctgtaatcctagcacattgagaggccaaggcgggcagatcacttgaggtcaggagtttgagatcagcctggccaatatggcaaagccccatctctactaaaaatacaaaaattagccggatgtggtggcacacacctgtaattcctgctactcgggaggctgaggcacaagaatcacttgagcccaggaggcagaggttgcaataagctgagatcatgtcactgcactccagcctgggtgacagagtcagactctgtctcaatgaataaataaataaataaataaataaataaataaatagtttgtaacataaaggataaatgcttgaagggatggataccccattttccataatgtgattattatgcattacatgcctgtgtcaaaatatctcatgtactccataaatatatacaccttctaggtactcataaaaattacaaattgaaaaatttttaaataaaatattgtataaagttggcttcaggttatgtgtataaggtgtatatgaaatacaaatgaatttcatgtttaggtttgggtcctagccccaagatatctcattatgtacatgcaaatatttcaaaatctgaaatctaaaacacttctggcaccaaaaattttagataagggatgcttaacctgtgtgccttcatgtctcgagccacaaaatccacagaaagagtccagaagagctggattacagtcaataatgacataataattttaaaaaattagtactttattgtaactttttaaattttagagatgggggtctgtatgttgctcaggctggatttgaactcctgggctaaataatcctcctgcctcagcctcctgagtagctgggactacaggtgcatactaccacacccagctttacgataactgaccttttgtaaccaactactctgtgtacattgtggtactagatattttacatacattaatcatttaatcttcataaaaacttgcaagctgagtatcattaattctttttttcatttagaaatgggatttcactaggttgtccaggctggggtgcagtggctatttgcagtgtttgtttgtttatttgtttgttgagacaaggtctcactctgtcacccaggattgtgccactggagtgcagtggcacaatctcggcttgctgcagcctcaacctcccaggctcaagcaatcctcccacctcaccctcctgagtagctggaactctaggcacacaccactgtgcccagctaattttgtttattttttgtagagatgaagtctcactattttgcccaggctggtctcaaactcctggactcaatcaatcttaccaccttggcctcccaaagtgttgggattacaggcgttagctaccatgcctggccctattcacagtcttgatcatatctgttgaccttaagaaagaaatagagtcaaaattaatacagagagtttatttgggccaaggttcaggacaactaccaaggaaatacctccaagaggctcaagttttcttaaagaaaaaaggacaaatcaggaaagggacaattacaaaagttgtttgccaggaattttcattggtatacagaaataacattgattggtgattggctatatattttttaaccatagggtatgagttatggtgtccagagtatgactccattagattaatttatggctattggtgttgacactcagtctggagtccatatagcaggcagattacttagctcaaagtggggtgtgggacacgactttcgatggctttctgggtcttataatttaaaggcgcttgcattcctcagataagtttattttctttttcctagagttttttctacagactcaaactcctgggctcaagtgatcctcccgcttcaacctccctagtagctgggactacaagcacgtgccactgcagctggctccattgattccatcttacaaatgaggaactgagatttatagttactcaagattataaattccataagcaccagagctggactgagaggtcaggtcagtttggctctcaccatgctctggttggagctgggaactgatattttctcccttggtgaggaaataccctccaagtgctatgcacaatttatatacaggagtgcaaaaaggctggggttttcaggttacctgatctgaccctcccaacctacacctctgctacttttttcctctactttctctttcataaaacttttttagaataaggaagaatgaagaacaattacctacagttggtcctccatatctgcaggttctgcatccacagattcaaataacagtgaattgaaaatatttgggaaagaaacaagaaataagatacaacagtcaaaataatatattaaaaaatacagtataattatttacaaagtattacattgcattaagtattataagtaatctagagataaggctgggatggtggctcatgcctgtaatcccacactttgggaggctgagctggcagattgcttgagcctaggagttcaagaccagcctgggcaacatggtgaaaccccacctttacaaaaaataaataaataagtaatctagagatgatttaaagtatatgggaggttatatgcaaatactacatcattttatacaagggacttgagcatctgaggattttggtatccctgggggggtcctggaaccagtcccccaaggatatcaagggatgactgtacgtaagtgttcctcgcctctcaaaaacctgctctttcctttttgtattgccgtaataggttttaacaatgatgcttcaggtctgttattgccagacattgccagcaggctttggctattgttgccatgggtcacatgtctttctgacctaaggaaaggaagtgccgccttcccaaaacaacagatcctttaaccctattttgggtatattagatgttaggtgtttgacagggcttgaattcagaatcaacagacagctaactcagacaaatggagattaaaatgtcatctttgttactgacaaaagctgaactggacgtgttaacccatttcctgtttaggaaaagaaagtgcaactccgctgccagtgctcatttctcagggcaaacaggaaatgggttaggaaaaattatcaggctaggtaccgtggctcacacctgtaatcccagcattttgggaggacaaggtaggaggattgcttgagcgcaggagtttgagaccagtctgggcgacgtagtgataccctgtctttacaaaaaataaaaataaacaattagccacgtatggtggtgccagcctgtagtcccagcttcttgggaggctgaggtgggaggattgcttgatcttgggaggtcatggctacagtgagctgtgatcacaccactgcacttcagcctgggcaacagagtgagactctgtgtcaaaaaaagaaagaaaaaataatatcaagccttaaaaataaagtaggggctgggcgtggtggctcacgcctgtaatcccagcactttgggagaccaaggcgggcggatcacgaggtcaggagatcgagaccatcctggctaacatggtgaaaccctgtctctactaaaaatactaaaaatcagccgggcgtgttggcatgcacctgtagtcccagctactctggaggctgaggcaggagaatggcatgaacccgggaggcggaccttgcagtgagctgagatggtgccacggcactccagcctgggcaacaaagcgagactctgtctcaaaaataaataaataaataaataaataaaaataaaaaataaagtaggatgactgcatgtcctttcattgtcaaacaatttgaaaaccaatagataaatgtttttatcagtcaattccttcatctccacctgaataaggtgcttcaactttgttaatggttaagaaaaaaattcttaaccattaatggttattttatatggtaatataattaatggttatataattaatggtaaaattatatgccagttcttctccaagatttcttcaacaagcttatttcaagtttcattgcctttcttgctatgttgacctgcttatataaaagctcggcagctaaatcaccagcaaattgctttccctcagcctccccggtagctgggactacaggcgtgtgccaccatgcccagcttttgaacatcttttcatatgcctatttgccacctgtgtatcttctttggtgaggtgttgtttaggtcttttccccaatttttaattgagttcttttcttattgttgagtgttaagagttctttgtggccaggtgcagtggctcacgcctgtaatcccagcactctgggaggccgaggtgggcggatcacaaggtcaagagatcgagaccatcctgggaaggtgaaaccccatctctcctaaaaatataaaaattagcagggcgtggtggcgagcacctgtagtcccagctacttgggtggctgaggcaggagaatcacttgaacctgggaggcagaggttgcagtgagccaagatcgcaccactgcactccagcctggagacagagtgagactccatctcaaaaaaaaaaaaagagttctttgtatattttgaataaaagtcctttattacatgtgcctttatgaaatgtctcttagctatctttaaattaatatctaaattttttcatcaaaagtttaagtagaagacatggagatcattgagggagttcattccacctttgagtctttacccagaggagccccggtccacgtgcgtgtgtgatatgatgaggtttctcttcaaataatctgatcaatcctttatccccctcccactttttcctttttctcctcttttcctttttgcctttgttaaatgcccaggcacaccacagtactaggtgttatcagtaccagctcacattcctttccttatttggaaagaggactaactttacagctcattacagacaccccttcccttcctctctacttccttttacaggcccatcttatctaaaaaatcaaatgtttagccaaccgggattagtttagattgcatgacccgaccccggccaatggggaaagggtacaggggcaggacttgcatcaggaataaaggctcttgtgcccctttgttcaggtgtgctctcatggcgactggccaaggaggcacccctctgcacagaagtaaaattgctttgctaagaatcctttgttgaagtgttcaatttccttaggattttaagcgttattcctaacacgtggtttagatcctgatcccccagattatgctgtgttttagggaggaataataactgactcttgggggccatgtgtggagggtgcttggggaggtgtaggaagctctgtgacatccctcaccatgggcgctgaggttccatactgggattaatgagacgtttagaaggtggtgacctgctttgtgtttgcctagggacttttctgaagaaaagagatctatttgatcctagacttggaaatgttaagcgttactagtccaggctcctttttttagatggtaggaatagctggtccagagaggagatttcctgaaagttacatgctagtttggatagatttggggatgaggactcagtgttcttttccctgtatcccttagttgtaacctggaatagctagatccagacacgggaaccttcaagtttcagatggcaaatggcccttgcatggccactccactgctctattcccctcaaacaaataagagaaaacccacagttagactcactacctgtgagtttactaacccagagtcaggctggcttgaactgaaatgcctcacttagaagaaaagcttcttatggcctggacaggacagtgagactacccagactctatagatgacccagaagtgattgttttcttctacggttgattatatatcttatatttgcttgtaaggggggacttcctgccttggtagtttagccagttagagctttagccaattacagcctcagcctttatacactgacaacttaaggtatgattattgagctctataggcaggtcactgcacagcttctataaattatccattctttttgtttcttaatttgttttttaatcgtagttctttagttctgccactttggtatgattgcttaggggagaggtaatgcaaaccccttcctttaatcacctgaacaaaggccctttgactatccccaacatttatgaaaacttagaaaatgtcattttacaggtaatatgaatcaaataaactggtcagcctgaaagattataaatagcactgagttattgattattgattaaattatttgattatttcctcccctatctttttatgagctcccttattcagaggtcagtcctctaattttcttgctttttttctacatgagatcttcactcttaaatgggcctggtatcctccaagctggagaatctatgtcttacccttttccaaggctaaatctctgggcttctgctatgctagggaaggaatctgagcatctcactgatttttttttttttttttttttttttgagatggagtcttgctttgtcacccaggctggagtgcagtggcacaatctcggctcactgcaacctcagcctcccgggttcaagtgattctcctgcctcagcctcctgagtagctgggactacaggcacatgccaccatgcccagctaatttttgtatttttagtacagacagggtttcaccatattggccaggctggtctcgaactcctgacctcctcgtgatctgcccgccttggcctcccaaagtggtgggattacaggcgtgagccaccatgcccagccgcatctcactgattcttatagcagactttctaccattccttatatttttagcccatcatgctgtcttctaggattagctggtgctcccaattcctgagccttatgcagggtttagctgtgtaaatcagattgctccaaagcctgctaagatccctatttctcaagtctgctcaggtaacgaccacttgactcatctactttgcaggttttcaatattttgttgctatttctataaggcagaaaaagaagtgcaaatcaattataagcatgtgaacaaatattcaatgtcactcaaaatgtaaattaaaataaacaatgaaataccatttttcatctatcagtgagtgggaaggaaggagttaagtagaagacctataatccatcttctccctttatagagcaatattcccaggaaagcaagcaaacatatgattcttataaatatggtaattacagacctggcaaactaatggtatctgctaacaagaaagtccctatctggatatggagtggataaaattttatcctagtgacaaatatttttatgttcagacatctcctattggtcacattattatataaaactgcctatgttttaaaaatgtttcatttccaatacggctgttaagttctgaaatttttttcttctgtttgactgtttaaacagttactattaggacataactgatatcaaaataacatagatataaatattgataagtaattactaaacacaaaaagtagcattttattgtaactatgtcttttgatgagatgatatgtctttttagcaattcatatagctgtttatgaatattactgattcaaaaaatgagacagtttagcatcaatactatccctatttttttattagatgtgttgagaaacctcatttatgtaaatgagtaaatgggtctcaaagttttgttatagcagtgtgacaattctttgaaaaagttccaagttacatgctaaaatgacttcgtgagctttcatctaaaattatggtgaatgaccaggtgcagtgactcacatctgtaatcccagcactttgggaagccaaagtgggaagatcacttaagcccaggtgttcaacactggcctaggcaacatggcaagacccccatctttacaaaaaaacaaaaataattagctgggcatgatagcacatgcctgtagtcccagctacttgggaggctgaggtgggaggatagttcgagcccagaaagcggaagctgctgcactccagcctgggcaagaccctgtctcaaaaatatatatatatatgtttaatgatttctcagtggacaatttggttaggtccttcacctattttgttgaaagcagcacactggaaaccaccagacttgcaaaaggaaattttacctggtctttccaacaccatttttttaaaatggcactttggtaccttgaggtttttatacctcaggacaacgcactattgtaagatctggatgagttagatgtgtacctttcttttgcagcatggaagaggaggaggcaggaaaagagaacccatattacatcatcacttttagatacaaatatagcatagaagttgaggacctggaaagtgaaaaagtgaatcccttaaaacaatccgaatgtccatgtatacaggagaacctcacaaaactatgttattgtactacttgtaagttatttaagaaatttttaaagggtaatattgattatgctacattttcatagtatactgacttgagaacttaatcttttctccacttcatagcgcctgcttattttgtttactcagaacctgggtatgaacctgaatgtttccttccctatctcattccattctttcttttagtgcctactgctaactgcttgattctgttccccattcaaattcctaccaggatctggaaaccctagatcaattcacaagggagctatataacaggtgcctggctagcatgtagattagtgccacaggtggtccaactggctgtggtgagagagccagggttgcttggtataaatcatggccacataagtttgccctgtcaatagcactgtgaatgagacaatttcacttacaaggagcaatgggtttacaaaggccaaataaagaagggaccagtcagaactcttcaatcctgacttcattttgcagcaaaagcaattaacaaaaggataaaaaaaggtttggaatccattacctaatctcatttgggcccaggtgtgacaatcactcattcagtccagtactctgtctctgatcagacatacaaagacttgtcttgtaaaagataggctgggccaggtgcagtggctcacgcctgtaatcccagcactttgggaggccgaggtggatagatctcctgaggtcaggagttcgagaccagcctggccaacatggtgaaatcccatctctactaaaaatacaaaaaaattagccaggcttggtggtggaggcctgtaatcccagctactcggggggctgaggcagaagaatcgcttgaacccgagaggcggaggttgcagtgagccgagatcgcaccactgcactccagcctgggtgacgagagcgagactctgtctcaaaaagaaaaaaaaaaaaaagggctaggtgcggtagctcaaacctctaatcccagcactttgggaggctgaggcaggagggtcacttgaggccataagttcaagaccagcctggccaacataccaaaatcccatccctactataaatacaaaaactatctgggcctggtgacaggcacctgtagtcccagctactcgggaggctgaggcaggagaatcacttgaacccaggaagtggaggttgcagtgagccaagatcccaccactgctctccagcctgggtaacagagagtaagactccatctcaaaaaaaagatagtgacagttatcccctcttgtgtaatttttccaaaggtttgagatataacctctgaatatttcttatcagcagcttaaaatgaatccagtatcaacaaatttatgacccatctgctgagcagatcacttccatctgtaaccctggccatgctacatagttggcagccacacaaaaatgtccctggcaaacactgtatcagaatttagattcctcatgggaattaaagttaactgttagattttttaaaataagacttctataacattttcaaggtgaatttaaataacttcaataattttcatgtaaagttttctaaaatatataaccccatgccataatcaaatgaccataatttaaataattcaggttcattcttatgttatcttacattgtaatattcctcccttgaataaaactgctgcatctgtgagacgtatatcttctttcccctgacatggctttaactgacttcctggactgttctcacattcattaaaggctttggatcagtcttactttccagccacgtagaaccaataattctttcatttatttgttatctcaataaataaatatttacttagtacctactatatgtcaatcactgtgtgcctggggcctggaatgattagatgaaaggcatagacccttcctctggtggccggagatgacaagcagatattcagccccattcttcagcaagtatgcatttgtatgaaccactagtttttatttttattttttttgagacagagtctcactctgttgcccaggctggagtgtagtggcacgatttgggctcactgcaacctatgccttccaggttcaagaaattctcatgactcagcctcccaagaagctgggattacaggcatgagccaccacacccggctaatttttgggtttttttttttttttttttttttggtagaaaaggggtttcaccatgttggccaggctggtctcgaactcctgacctcaagtgatccaccggccttggcctcccaaagtgctgggattacaggcatgagccaccatgccaggccaccactggtttttaatttgtccctgaaaaaatagccaagtgccttaatagtgacaacccattccaaacacatcatctgttctttcgtgcctcagagactttgcacaggtttgccctacctagaatatctgttcccctttattcacctagttaactccaagtaattcttaactctcaattcataactcatctgattcagtgttttgaagtaataaccaaggagatgggtagttttgtccaacacccttgattcttcaacacaaaccaccaattgcttcagatttttagttcttgcgtactttagtcaatggcttcttatgttactctagatttgtgttgttctgaacgatgaaatgttcagtttctgttattttagttacacatggtcatcattttaatcatttattcaagaatgatacatgttcactgagcaccaatacatatcaatatgccaggcttttttttttaattgatggaaatataaaggacctagagtaaccaaagagacttttaaaaggaagaatcaagttggaatacttactctacctgattccaaaacttactgtaagtgatagtagttaagatagttttgtatcagtgaaaagataaacacaaagatcgatagaacacagccagaagtagacccacacatggtagggttgattgatttttgacaaagtgttaaagcaattccaaacggaaaggaaggtcttttcaacaaattgtgctggatcaactcaggacctgtggggggaaaaaatgaacatcaaccctacctcacaccataagcaaaaattaattcaaactggatctgagacctagatgtaaaaatccaaactatacctttttagaaaacataggagaatattacactctcctgtgtggttgagattggtagttctcagaacacaaaaagcaggaatcacataaacaaaacaaaaaatggataaattgaacctgattaaaaaaaaaaactgctctttgaaggacatcattaagaaaatgaaaaggcaacccagcacaggggctcacacttgtaatcccagcatttggggaagctgagaagggaggattgcttgagaccaggagtttgagaccagcctgggcaacatagtgagatcctgtctctaccaaaaaatatataattagctgggtatggtggcacatgcctgtactcctagttactcgggaggctgaggcaggaggattgtgtgagcccaggagtttgaggttacagtgagttatgatcacaccactgctctccagccagggtgacagaaagagactctgtctccaaaaaaagaaaaataagataattcaatagcaagccaaagactgtgtaaaaatacttgaaacacatatatacacaaaagacttacatacagatcatgtaaccagtccttgccactcaacaataagacaaacaaaataacaaaattggcaaattatttgaagttacttcacagcagaaaatatataaatgacaataagcacctgaaaaaatgttcaacatcattagtggtaagagaaatgtaaattaaagtcacaatgagataccaccttatacccattacaatggctaaaaaaaaatgttctgttttcctttttagagacaagatttctctgtcacccagaccggagtgcagtgttgggatcatggctaactgcagtctcaaacccctgggctctagtgatcctccctcttgcgcccctgagtagctggatctacaggcaagcaccactacacctggctagatttttatttttttgtagatgggtattactacattggtccgggtggtctcaaattcctggcttcaagggatcctccctcctcagcctcccaaagcactgggattacaggtgtgagccactgctcccagccagaatagctaaaactaagtgttggtgaggttatggagcaactggaactgtcatacactgctggtgggaatgaaaaatgtacaaccatctcagcaaacagtttggctatttcataagtgctgggtgaggtgtcagagccctagcactagaaagtggtcaactcacgggttggtaagaatttacagacaacagtataggtttaaaaaggaaacttctattaaatagaatgctgcaaaagagtgcagcggggcgcctcagaaagagaggactgagtgtgccagtgaatttttccttagggatatttatggacctcaaagagggagcttacgggcaatttggaccatattagccatgtaggtcatgataagtgattacatttgtagacattctggtgccttaatgtcagcaagggtcacacaatgagttttgatatgcatgcattcaagagatgtatagaaattctagttacttataaattttggggaaaaaaaactggaaccagatgcctgtgttacataacaggaaagtctaattacttctgaattcctcagataagaagtttttgtctccagggcctgctggatggtcaccaggtaattttgctctggtcattttcccctgacaaataacttggtcaaatcttggaccctttatattcccccatgctcaagtcagcctgttgcatatcatggtctcaagaaagagaaaatagcatagtgaagagggatgtcaagtctatctggctacttcctgctgaaagagggctctccagcctgggccagagagtgggactctgtctcaaaaaaaaaaaaaaaaaatccagacagtctagtcacaaatgttcacagcattttcaacaacaatttgtgttgtttctaatttggggctattacaaataaaaatgctgttcccatcaatgattagataaacaaaatagtgataaatccatacaactgaatactaatcagtaattaaaacaaaacacaacctgctgatacatgcaataaggaggcaaaaaaaaagagaacactgtgtggggataatgatttcatttatttaagattcaagaaaatgcaaactagtctctactgacagaaagtggttgcttcggtatgaggttggaaagagagatggattacaaagggcacaagaaaacttttgggattgacagaagattatgtttattgtagtagtggtttaatgggtatacatatatgtcaaaactgatcaaaccaaacttacggctttatatatgtgcagcgtagaggtcttcaattataactgaataaagttttctaaaaaatggggataaaaataacatcttcagcctgttgtagggattcactgaatatgttaaagcactttatcataatacctggctccgagtttgatgccgctgacacttagatatcaaactcaacctctctaccaagctcttcatccaaacagactaggggtaaagactgtctaagactatacagaaagatcatgtatctgaggaattaaaaatagggcataagatttggcaatgtgtcactcggcaaactcaataaactagtattatcaaggcaaaaaatatatacacaaaaagaactgggttaaaaaaaattttttctatggacttttaacgtgataactcatgacacaggggttaggatcttcagttttcctttggaagttaataaaaaccactatagagaaaaacaagatttgctagtaagaaggtgaaaactgcttctcctctcagggttctagttctcttgcaacctaaaacaaaggaaccagacaggatatccactttcgtaccgtacagctccaaacactaatcaatcactccattcacttatcttttctatttccttgtattctgtcaaacaactgtctcttggtttaaatacttttctgctggtcttcgctctctctctctcctcttctggtttattttcatccagatgtggattttccccaaagtttccatcttatccttttctcctcctgtgtatgcgccactgaagtcaagattgccacattcaaactccccacacattcacacacccactcccaatatacagtatctcgcccaatgtttatcactccggatacattcctagaatccaaagatctggagcagggagaaaaagaaaaggcgcctaccagatgcctggaacagtctactaggcactacaagtacattagctctttcaatgctcacaacagcccagccagatgttatctcaatcttacggatgaataaatttaagacttctggctggacactagaggctggcgaagtacgtgacctttgatcagaatctcctggaggagtggggtccctgaccattgtaccttccagagaaccttaaaactgagatcccaggagacccctctcggatactctgcagaagtcagagtgacgatattagcaagcacaccgcagccatgcgaacccttcctggctcagctcccgacaaaagaaatcaagcccccagtcaaaatacaacaacaacggattaggcctacaaccctctcccccggcccccaaattctcaggagaaatcccctaagagtcaggtacggaggtcactgcagcgacttcagcgtgcagagaacgcggggacctaggaagaggacgctccagcccaactgagcgtctctgattggccgccagctcagcttggaacgctggggtgcgtggcgtcatatccgccgggcccgccatcttgttcccaggggcagttggcggaagagatcgagctccctggctgccggctcgccttctgcgtggagttctcgcggtctgggtttcgctgtctgctcttggcccggggtcattttgtcggcgtcgggtgccctctcttgcccagctggggcacagcgaggcggccccttctcccgacgacgttcgatggagtagggtcccagaccgttgtcccgaagagcgagatcgagcttggccccctcccccccctccttccctccctccttccttccgccgcaacatggctaacaacagccccgcgctgacaggcaactcgcagccgcagcaccaggcggctgcagctgcggctcagcaacagcagcagtgcggcggcggcggcgctaccaagccggcggtctccggcaagcagggcaatgtgctcccgctctggggcaacgagaagaccatgaacctcaaccccatgatcctgaccaacatcctgtcgtcgccttacttcaaagtacagctctacgagctcaagacctaccacgaggtggtggacgagatctactttaaggtacgaagtgtgtaggccttggctttgggggtaagttcggaagagggggtatggaggaaacgggcgaaggcggcccccgaaatctgaagatttgtgggtgggggaaggtggttcggcggaggggtggctgcggcctgtagtgtgtctgggaggggtcggactggggccgccctctcgtttccattttagatttttagggccgggagagcccgccactattgatctctctcctcccccaacctcctgcccacccctggggggagttgggcaagagggatgggggagaggaggaaagagtaacagaagcctttccagtttacagctttaaaattattccttttgacgtggatctgctgagcgccaacttgttggtgcttctcccgctcacccctggccagggcgtgtaatgacttcagtattggcctcgtgttgttggtactcactatccgatccaggcagggaaatggtcagtgcgtgtgtgtcgggtggggtggggggatgagggtggagaggtgccatttcaagaggtgtacagaaggcctggaaattttcccagcaggaagtcaggagtaagaggtctcagccacctgtgcattgggctaatttagaattatctgggccctgggcttctgcggcagggtcggtgctggcttggctgtgctggggagctcacctggcgcctcctcactgcactcttgtctcagttcttgtttcgttagcaggattgactcagtcttgcagcgaggctcggagcagcccagggtcgcaggtagaggtatgcactattaatcatgctcaatcgccataaatgcatttccctggttaaatgaacgactaattagatttttgtgggtttttttggccattgcttttggtccttcaccaattaggtaggctttttccacttccctgcaaattatgtagtataaaaaataccttccaggcctccgaaagttaatttctattttaaagaatattaataatagccttagtggtctttaaaaattttatccggagcatctaatacacaatccatttttgtctatattcactcttaaaaacttgacagaccgcacaaagtgttttctatcatttgaacgtatgtgtagagatggtaacaaaaggacattctcttttgtcttgcccaccttttcccccagttgagtaattaggttattgaaggattttgagagattagttgctttttatagaaaacatctcttgaatacagttcaactttgggttgataaagtacacaaataaatttggaatcctcttacgagagtaggtctgattgtaattctatgaattagtttttttagcttttaaaaggtaagacctttttagcatggatacagtatggtgaataacatttaatccttagctttatttatgcagtaaactttaaacagttgaaaattgggttcctgctctttctgcggcaggttctgttttctaacataggcaaaatgttaatgtaatagaggaaagtctcgtttttaagtttcaaatgtgttttgaaacaagattctaccaggaattgtttttaaattccgttaaaaaactaaagacccagtttttttactaatattaagaagacttaagactttcagatcaaatactcactgaaatttataagtttccaactttgtaattttattttgtatgcatccagccctgcctttggctagcttttaaggaattgaaacatcttttacatggcaatctgtggggaagaaaggaaacgttaaagcactgcaaaatagtgtagtgcttaaacttacatgcacgcttttctatctaaagccattgttcaggactacaaaatttaccatgtgggtggaaatagaattttagaaatatgcagtgaaaaaacaggatttttttttatgtttttaaaaaaaaacaaagatgggtcttcccaaaagacctttttggattctattttagagttaatattcttttgttgttgttgctgttgttgttgctatttttagataaggactagtttttgtaagatgttcctcttagcaaatatgatactgtatcatctttgatgatacttagtatatgccagtgactattcacactcagtttttgacacaatttatattctggggaataattggattggttcacacataattaggctgaagcttaattacaacaatgatctctgtaagtgtggcctttgtaattttatctttaatcaggaataaacctgaccctggtggaaaaaatgtacaaataaaaagttccataattttgcatcacaagtaactcgttactgttttagaaaattttcttcaagtaattttccttaattttataatgtagattttaaattacaataaaattgaactattgaaggtgttttgaagtttttaaattaatgcttaacgttaatactttttgctttaaattggagacttaaatccatttttaaaggaaaatgttaagcaacccataagttaaattgtcaaatattatcaaagttaaaatattaccaaatagtttttgcaaccaagtgagactatagaaattttctgactcccagatgtagatatcagctctttataaagctagttgagtgggatttctcctctgcaaagctattaaggttttgttaaaccctagtagctttatgggtgctgtctaaatgtctaagcagtttttccaaaaatgatttacacacttaatatcagtaaacatatacttaatgccaaaataattttggaagagctgctctattatggacttgggtttacttttatcaggcttttaaacaaattcaaagtatgaatgtttgttgtgttcctcttttctattttcaggtcacgcacgttgaaccatgggagaaaggaagcaggaaaacagcgggccagacagggatgtgcggaggggtaagtagaagtacgtgcatttttcagtttttctgtgtctaataactaagtttatatttagagaactagaggcctgtcaattatacacttgagtgacaatttttttaatccaaattcaagtgttcagtgaaatagggttagaaaagtgttactttttaatgctccttagttctggattatggattgttattgatacctaacaggattaatcaattggtgttaagagtccgttaattattttactactttttcttaactcgtttcccctaaaggttcgaggtgttggaacaggaggaattgtttctacagcattttgcctgttatacaaattatttaccctgaagttaactcgaaagcaagtgatgggtcttataacacacacagactctccatatattagagcgcttggatttatgtatataaggtgagcgtacatttatgtacatttccagtaaatatctcattttaattcacatgtgtttaataatagtcttttgtaattctagatatacacagccccctacagatctgtgggactggtttgaatccttccttgatgatgaagaggtatgtcaacaagggtaataatttgttttcttctgattactctcatatttttattatcttttatttattggtggtttaatgtcttcaagaacttcctgtagttaaatttatttcagtgagatacttttggaattaatgtccttttactgagacctgatggcttttatgtattttagggtaaatttctgaagttttattttcttgttttaaaattgtttaaatgtgtttggtaactattggaaaattttctcttcttaattatgttctgtgtattgtattgatcctgaattgtatagttaatagtgacttttcaagatggggcatgctcaagatcgaacagataataaaagatatgcacatagaatactaattgtagcttttttttcttctggaacatttcagttcttcaccctctagcttcttccaaatatcagtattcccacttgcatagaagtgcagaattgaagagttgggtgttacataaataggctaagtgtttggatgacttgttcaaggtgacaaaattttaattccagttttctgactcctagtacaccacacacacctttaaaaaagaaattttttaaattgtaattcgagtctccctaatttgaaatctgaaatactaagttagatttaaatcgtgtatgcattggctgggcgtggtggctcacattgtaatcccaacacttcgagagttcaagaccagcctgagcaatatagtgagacctcatctctacaaaaaaaagtttaaaaattagctgagcatagaggtatgcatcttagtcccacctacttgggaggctggggtgggaggatcacttgagcccaggagacagaatttgctgtgagccaagatcattgccactgcattccagcctgggtaacacagtaagaccctttctcaaaacaaaacaaaatatcatatatgcattaatttacttgcatggtgaagtccaacatgtcaaaaatgaaatgatgagctgtattgtccctatgtctacccagtctactactttgtgttttaaggttcataagactttttgagtgctatgtgtcagtagtctatttacagagttcatccaaagaatttattgaattaaaggatggttctaatggaaatctattgtgttttgttattacatgcacacctaaaaaaaaaaaaaatctcatttagacatggagaatttttatttttctctttttttttgcctgttaactgagttacttcactcagaagaagcaaaacgtgttttaaatcacaatctttaaggtctttttatctttagatcagtttttcagactgaagtgcttctcccttctgtctttaaaaaagcatgttcctcttcataattggtgttgtattggttttgtttctggatgcctctattttatgttttttattgtgtttacaaatctgaggtcctctatttaagctaacttattgttttcttccttagatatctgcagcgattatatttggaaatactgtatatctgaacacttaaatgtgtgtgagtgcaagcagttttacctttagctcttgttttcctgtttagataacaaatctcactttccttgtgtgcttgcactataggtttgggactgacaatagctgactaacatgtcctgagctgtgagagggcatagcaagaaggccttcatgcggtaatgacccttttcagagacaatggtcatcatggattatgcgtttccaattatttgttcatttatttattttctacataactaaattagaaacctcactgcttcatggcagttggtttgctattgcttccagttttattagggcttcattttatattagagctgttaaaagataacctttagacaggaattatctaaagtagatcatatgtagctaggttatggtgcaaggtatatgatgtgtgcaaatatgtccacagaaataaatacatagtaggtatgtggaatgtaaatttaagtcaatcgttccgcatagtttagaaatgtaaggggctttttcatattgttaactgagtgagatcagttccctttatgcctgtgaggctgcagggtttgttctcacttgcatgcacacactaagcccaaatatttctgttcattcattgtcagatcaggatatgaaaataaaatttttctgttagttttttttgtattgagattccaaagatggtaatatttttataatattcatgtatatatggaaatactttttttgacggctagggtatcttttgtgtttctgtaggacctagatgtgaaggctggtggaggctgtgtaatgaccattggagaaatgctacgatcttttctcacaaaactggagtggttttctaccttgtttccaagaattc

SEQ ID NO: 133 - protein, 953 aa, Homo sapiens [sequence omitted]

SEQ ID NO: 134 - DNA, 2852 bp, Homo sapiens
ggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttgaaaaaaaaaaaaaaaaaa

SEQ ID NO: 135 - protein, 678 aa, Homo sapiens
MWKLLLWVGLVLVLKHHDGAAHKLVCYFTNWAHSRPGPASILPHDLDPFLCTHLIFAFASMNNNQIVAKDLQDEKILYPEFNKLKERNRELKTLLSIGGWNFGTSRFTTMLSTFANREKFIASVISLLRTHDFDGLDLFFLYPGLRGSPMHDRWTFLFLIEELLFAFRKEALLTMRPRLLLSAAVSGVPHIVQTSYDVRFLGRLLDFINVLSYDLHGSWERFTGHNSPLFSLPEDPKSSAYAMNYWRKLGAPSEKLIMGIPTYGRTFRLLKASKNGLQARAIGPASPGKYTKQEGFLAYFEICSFVWGAKKHWIDYQYVPYANKGKEWVGYDNAISFSYKAWFIRREHFGGAMVWTLDMDDVRGTFCGTGPFPLVYVLNDILVRAEFSSTSLPQFWLSSAVNSSSTDPERLAVTTAWTTDSKILPPGGEAGVTEIHGKCENMTITPRGTTVTPTKETVSLGKHTVALGEKTEITGAMTMTSVGHQSMTPGEKALTPVGHQSVTTGQKTLTSVGYQSVTPGEKTLTPVGHQSVTPVSHQSVSPGGTTMTPVHFQTETLRQNTVAPRRKAVAREKVTVPSRNISVTPEGQTMPLRGENLTSEVGTHPRMGNLGLQMEAENRMMLSSSPVIQLPEQTPLAFDNRFVPIYGNHSSVNSVTPQTSPLSLKKEIPENSAVDEEA

SEQ ID NO: 136 - DNA, 187386 bp, Homo sapiens
gaattctttatttctcctactcctaccccactccaaaaacgtaagggtatagaggttgacaagtgacctaggcctagccaatcatattctattgcctgaaaggaaagatggtctttttatctcagattgggacaaaaaggatgacatgagcctggagttatgtgaagccaaaggaaagcagagctgagaaatgaagggagggaaagagggtgagaaggagagaggaaaggacacagaaccactaagggcaagctaatggggttgtcgaacccttgaattcaatagcacctgaagctccctgaacgtttcagttatgtcagaaaacaaagtctatccttaattcctttaacctgcttagagttgcaactcagaaccctgcctaatatataataatatgtattatatatgcaatcaaatatatgcacatatagaagaatatattctattctgtgtaccatcccactacccagcattattcaagctatctgtaaacaagatattaaaatggaaatttccagccaagtatggtggttcatgcctgtaatcccagcacattgggaggccgaggcggtggatcacctaaggtcaggagtttgaggccagcctggccaacatggtgaaaccctggtctctactaaaaaatacaaaaattagccaagtgtggtggtgcatgcctgtagtctcagctactcgggtggctgaggcatgaaaattgcttgcagtgagccaagatcatgccattgcactccagcctgggcgacagagcaagactttgtctcaaaaaataaataaataggctgagtgtgagggcttacgcctgtaatctcagcactttgagaggccgaggcagatggatcatctgaggtcaggagttcgagaccagcctgtccaacatggtgaaaccctgtctctactaaaaatataaaaattagccaggcatgatggcaggcaccggtaatctcagctacttgggaggctgaggcaggagaatcgcttgaacctgggaggtggaggtttcagtgagtcaagatcacgccactacactccagcctgggcaacagagcgagactctgtctcaaaaataaataaataaatacaataaaaataaataaataataaaatggaaatttccattaagcattaatataccttagttgtaaaacaatgtgatgtgtgaagtcactatatgcaaactttcaaaagaaataaccttaagaatctgttatatgggccaggtacagtggcttatgcctgtaatcccaacactttgggaggccaaggcaggaggattgcttgagtccaggagttcaaaaccagcctagtcaacatcgagagactttgtctctcccaaaaaaaaaaatcagctgggcgtggtggcaagcacctgtagtcctagctactggggaggctgaactcaggaatttgaggctgcagtgagtcatgatcgcgccactgcactctaggttgggtgacaaagcgagaccctccctcaaaacaaacaaacaaacaaaaaactgttacatgacatttgaacctcctcccttacctcaagaatataagtggtcctgagtggagctttgtgaggagattatctatgggaagagatagtcctgtgttgtaagctcccctcccaatgttggggggtaccaaactccctgccaggaagactcaggcagaggcacattttgtatgtctgggaggatgtatgttgcaggctaggaagccacaaggcagattggagtgggactgccaccccagtcacaatgactctctgactgctccccttacccacgggtgacagccattttgagcagcgggaccctgttcctctggtcccagtttgaattaactgggacagaattccttcctataaaatgtataatagagacaaagagggggaaaaaacccctctttgggtagctgaatccagaatgtcgcattcttccattgagatttggaggggggaggagctggtctgcagagacagaaaaatgcatcagacctgaagaaaaaagaagcagagatgagaagtcgatgacaacttgttccatgagaggagatctggattgaatgcgttctattttcttttcatcaattccccttttttgttctagctatatatatgtatgtatatatgtgtgtgtgtgtatatatacatatgtgtatatatgtatgtgtgagaccctgtctcaaaaatatatatatatacagtcccagcctgtagtcccagctcctgggggaggctgagcccaggagttcaaggctgcagtgagctgtgtgtgtgtgtgtgtgtgtgtgtgtgtgtgtgtgtgtgtgtgtgtatatatatatatatatataaatatgtatatatataaatgtgtatatataatatataaatgtgcatatgtataaatgcgtatatatataaattcatatatatatgaatttcaaggctgcagtgagccatgtgagtgtatatatatataaatgtgtatatatataaaaatgtgtatttatatataacatataatatataaatgtgtatatataaatgtgtatatatatataaattcatatagatatgaatttcaaggctacagtgagccgtgtgtgtatatatatctataatatttatataatatatctaaatataaatgtatatatataaatgtgtatatgtacatatgtatgtgtgaatacacacacatatatgtattattacgtacacacacacacacacacacacacacacacacacacacatatggctcactgcagccttgaactcctgggctcagcctccgccaggaggtgggactacaggttgggactgtatatatatatatttttgagacagggtctcactctgtcacccaggctggagtgcagtggtgcaatcatagctcactgcagtctcgacttcctgtgctcaagtgatcctcccacctcagcctaccaagctgaaactacatgtgcacgctgtcaggcccagctaatttttttgtatttgtagagacggggcttctccatgttgcccaggctgttcttgaactcctgggttcaagccatctgcccgcctcagcctcccacagtgctgggattacaggcgtgagccacgacgcctggctaagctatcttgtttttcatacgatccatggggtacatgtgaaattttattacatgtatataatacataacaaagaagtcagggtttttagggtgtccatcctcccaatacaatacatttttattaacggtagtcaccttactctgctatcaaacattgaatttatgccttctatctaactgtatgtttgtaccctttaacccacctctcttcatcctcccctctgcccccaacttgtttaagctatcttgagttggtttctggtgtttcaacaagattcataactaatgcaactgctaacattcctcaatcatttgtcaaataccatttggcatattctgttgttcaatcatctactctgcatctactctcgggtctccctgaacttctccactccgtccatcctcttcctcctcctccacattcggggaccccttcataattcaagtcaggctttcacatatgctatctgtgatcgtcccaggaatcctgtgagctagttgttgttcctatttcagttcaacagtcctttatcaagtacctactaagtgccaggaaccaagctgtagagtccattctcctgttctcccatagcacgagtacacaatccctctctaaaatctctggggctcagccaggtgcggtggctcatgcctataatcccagcactttgggaggccaaggcaggtggatcacctgaggtcaggagttcgagaccagcctgaccaacatggtgaaaccccatctctactaaaaatacaaaaattagccgggcgtgttgacgagcacctgtaattccagctacccaggaggctgaggcaggagaattgcttgaacccaggaggcagaggttgcagtgagccgagatcgcgccattgcactcctgcctgggcgacagagagagactccatctcaaaaataaaataaaataaaataaaataaaatatctggggctgacgtacagactcactcgaacatgcaggcctggaggcccacatatccatgcctaatatatttacgatatgtaaatcaagttaacaagctactaaataagaactgtcttctgagttgcgcatggtggctcatgcctataatctgagcactttgaggggctgagacgggatgatcacttgagcccaggagttcaagaacagcctgggcaccatagtgagacccccatctctttgaaactaaacaaacaaacaaataaataaataagagctgtgttctgtcctatgttgatagatatagccagggtcaaatttacaattttggataactatatctatcccctttctctttgcacactcaattctatccttaccttgagtggtctcacgggcacatgtgtggacattttagtttgcacaaccagcctctatccatacctgctgcaaacagctgctctttggttatgtcttggccttaagagtgcatatgacagcggtaacccccaccccccacccatccagagggtagaccaattaaagagatctgcacagactttggaccacttgggcagcaaactccagtggcccaggtacctgggacatgatctagagttgggggggcggtgctcaggtggtgagaggcccttcattttgcctcacaggcctacctaatcagcaagggctatctagaagaagggcaaagtaaggccctccaaaatgtggggtcctcttgcgtgggtctaagatgagccctgaaatttagaagtgttcagttttcagagagatatgctgcacacactgcatattattcattcccccagtggggtctggggagagcttgagcaaatatgttggcacttttgcaacaaaatacattaatattcattctaagtgaatgaaataaagactataaatagtctatagatgtctctataaattcctcatgtcatttcaagtcagattttgccaccacttgagtctgtgccaaacttaagaaaaaacttttggccggcctcatgcctgtaattctaacattttgggaggccaaagcaggacaatcgcttgagcctgggagttcaagtccagcctggaccatatagcaagaccccagtctctataaaagtaagaaaattagctgggcacaatggcacacacctgtagccctagctgcttgggagtccgaggtgggagaatcccttgagcttgggaggttgaggctgcagtgagccgtgatcatgccactgcactccagcctgggtgacagagaaagaccctgtctcaacaacaacaacaacaacaacaacacacacacacacacacacacacacacacacacacacacctttccaattttcacagcttttgagatttcagaacttggagataaggagttatggaactataatagagttgtaatatagtcattgctgttcaattgatgacacatttctagcctttctttcaactaagtgtagccatgtggctaagctctcagcaagagaatatgagcagaagtcatgagggctgctttgggtctgaacttttaggcaccaggcacgtattttcccacagtctcttccctctttctccaacctggaagaccgatgtgcctgctatccagcttctgtcaagcagatgaggacagagtccttacatttgcaaagcaacaatctggaaggaactagagtcttcagatggccatgtggggcaagatccttaccaaactgcactattcaactcaggactgctatgagggagggaaatgaacttctattcttccttaagtcactgtaattttttttgtaaagatatggtctcagtctattgcctaggctgattttgaactcctgggctcaagtgacccttctgccttggcctcccaaagtgctgggattacaggtgtgagccaccatgcctggcaagccactgtagttttgagcctccagcccacttagtcttgaactaattaatataagagacaagtgctgggcatattaaagatggaaaagatacagtccttacctccaagggatgataagcatattttaagtaaggaaaaccaactcatatgtggagacttccaattaaatgtgctgcatgctgatgtggccgccatggaaaaacgggtctacctgagggcttcagggaaaacttccttgaagagatggcagctcggctggactgtgaaggttcaagagaggctggtcaggtgagaaaatggaaaagggtatattatgggttacattttgtccccctccagcaaaagacatgttgaagtcctaaatcccagtacctcagaatgtgaccttatttagaaatagggtcgttgaaaatgtgatggcttatgcctgtaatcccagcactttgggaggctgagacaggaagatcgcttgagtccaggagttcgagaccagcttcagcaacattgtgcgaccccgtctccacaaaaaataaacaaaattagcagggcatggtgacatgcatctgtggtctcagctacttgggaagttgaggtgagaatattgcttgagcccaggatgttgaggctgcagggaaccttagcatactggagtagcgtgggctagaatccaatacaactggtgtccttttttgttttttctttttattttgagacagagtcttgctctgccacccaggctggagtgcagtggtacaatcatagctcactgcagcctctatctccagggctcaagtgatccttctgcctgtctcccaagtagttgggactaatttttgtatttttgtggagaacagggacttactatgcttccccggctggtcttgaactcttggcctcaatcctcttgcctcagcctcccaaagtgctgggattacagatgtgagtcatcatgcctggctgggcgtccttttaagatgaagaaaatttagacacagagacagacacacagggataatgccatgtgaagacagagagacacacagactcagagacgatggccacatgaagatgatcacatgagtttggagttttgctatacaagtcaaggaatgcctgggcctaccaggaactgaaagaggcaaggaaggatcctccccctggaagttctggaagggtcatggtcctgccaaccccttgatttcagacttctagcttccagaactgtaagaggataaatttctgctatttttaagtcctgcactttgttacttcaaccctaggaaattaatacagggtgtataaccacaggcagagaggtgagaaacaacatggtgtactcaaagagattataggcaactccgtatttacagccttaaggtgcaaggcaaggcatgtcctgcaatgaagctggagagtggaaaaaacccactcactgcgtgtatgatatgtaatttttaaaaataggaataaaaaatgcaaagaagaatgatcaccaaaataacatggttctctcacggtggtaaaattttaggcaaagtttacattctttttatttttttccttattaatttttaaaatgatcatgtcttttgttgttgcttcttttgagacaggtctcaccctgtcacacaggctggagtgctgtggcaggatctcagctcacagcagccttgacctcccatgactcaacctatcctcccacctcagtcttcccagtagcttggacaacaggtgtgtgacaccatgcctggctaatttttaaatttcttgtagagatgagatctcactatgttgctcaggctggcctcaagcagtcttcctgcctcagcctcccaaagtgctggcattataagcatgagccaccatacctggctgaacatgtatttttaatataatcagaaaataatctatttcatttaggaaaacaaaggcagatggctgccagcagtgaggacagtagattaggggagcatgactagaagcagagagaccagctaagaaactattgcaggccaggagcagtggctcacgcctgtaattccagcactttgggaggccgaggcgggcagattgcttgaggtcaggagttcgagaccagcctggccaatatggcgaaaccctgtctctaataaaaatacaaaaattagctgggcactccagcctgggcaacatagcaagactctgtcaaaaaaaaaaaagaaagaaaagaaaaagaaagaaagaaagaagttattgcaattgcaatgttccagatctatgaggagggcctgagctcagaaaacagaagtagcatggacaagagaaatatttagaaagtagaattagagagacatggtgattagctagaagtattggggttcgtgatagagagggagattccagaatgattctcacatctctaggtggggtgacttggtagatgacagccccttcatgggggttaggagaagaggagattcaggttttcaggggaagattatgagttcaggggaagatggtgaaatacctgtgggggtatccaagtagcaatgtcctcagatggcaactccacatggtggtctgtccagcactccactctaggcttcctctggtaaattatcctgcccctattcatctccatgattctcgtggtggtttgctgtgtccgtaggactccacttccctagctacagctaattggtcaaggatggatgcgtgacccaaagttgggttttgtttgtttgttttttgagactgtctcactctgtcattcaggctggagtgcagtgatgcgatctcagctcactgcaacctctgcctcctgggttcaagtgattctcctgcctcagcctcccaagtagctgggactacaggtgcttgccaccatgcccagctaattttgtattttttgtagggatgaggttttgtcatattgcccaggctggtctcaaactcctggcctcaagtgatcctcctgccttggcctcccaaagtgccaagatcacaggcataagccactgcacccggcccttgttttcaaatttaaagagtagtagagaaggcaggactggtgacataaacctgggaatcaccccacgtgggcagcagttggattcacaaaaggatgagactttccaacaagagcatataagaggagaaaaataaaagtcagcatagaacctaccaagggtgcaggagagagcagcagaagaactcacaaccaaaatgaaaagaatgttcagagaaactggaggaaaccaggagagaggagagaatacgtccccagttagagtggaggaaactggagcttggaggcaaagctaagacgctcactgatccaagactcagattcaggtctttgctctttgcatggcaccactgcccatggattttgattttactgagcttctattttctttaaatggacttctagggagagagtctatatagacaacttgttttcatttcccagtttccctctccaagcctatgcctgctttgaactgaagcctgcctctactctgccctcccgatgttgctgtcctgtgggttcatgcatctgcctaggatttgatattttaggcctgtgtgcctgattaacacagagaagaagagtaacaaggtcctcaaaaatgctttggataagaacaaattgattattgaagcggagtgagggtggacacgggactgaaggttgctgaggcccctagagccacatgggagagcattcagaaccacatgcccatgacattttctcagagccatcagtttttatcacatttgtcatttccccccatcttattcttaacgtcataagtcatgaagatgagtcattaagctggtttactcaatttatcttgtgaacatactgataaaaagactgttattgaatccccatgatttagagggttgtaggagcttcaggggatccaataaaactcttgaattaaactcaatagtggtcatgagaactagtaattagcatcacttgcctggtaattgcacggttggtatgaaaaatgactctgtgttagaatccatcttataatgaaggtaggaggtgtacacatgtttacatttcttcatattgcttgtgcatctactatatatcaggaattatgtgagcaacagactcaagacaggtgagacctcttcccttctgaagcttgtattctagtgggctattttcatttcataccccactaactaaggatgtttctaataattgaaaatgcctttccctgcttcccctgttagtaggagggaaagctcacccaccaggatccaggccaaactgccagaagagaataatataaattccacatttaaattctcactacagccctgcaaagcaggttaacatggtagaaatggatagacctgggttcagaggctggctctgctacttcctgctgcttgttcatctctctgggccatagtctcctcctattaaaccctcgagatgataacacacacagtatatggcatataagtccttggcatgtggcatcatagccattcctattgccattagctcatttttgaagatgagaaacttaacacagagaggtaaagtgacttgcccaagatcacacagctggtaattggcagagcaggaacttgaactcaaatcttctgactccgtgccatgtcctctttccagtctcgcatcactgtctggtataaggccaggaagtaattatccatgtatccagggatctatgcttctggaagggtgcaggcctggtgacttaggaaggacagtatggaggtagtggtcgggggtggggagaatatgaggagtctcgataggctagaacccagttaacggccaggggacaagtccagacagattggcaggggcaagacccagctagaagaaccagattcagccccggccgctgtctgttcacctgcggccaaacactgacccctgccggccgcccgagggaaggcggcgcccggcccagctccgggagtgctgggggcgctcgcggctggaactggcgagtggacgctcatcgagcagacaggagcctagggggctggtggtcacagcgcgtccctctcctggaacctcgagacctgggtgcctgccttggccaccagggtgacgttgcatcgcctccttcgctcacttggcttttgaccagagctgagggttttccctgccctgggccccgaccccgagcatctcctgggtttctccttgccgcgcagccccgcaccgtgtttgagacttgaggcttggcgcctgcccttcctgccccgtctagggtgccggccacctggagcaggcggggagcgtctctagggctggattcgagccttgtgcgggccagatggaccaactctagaccaaaggccacttgctggggctgaggagacgctgtggcagtgccaccaaatacagctgcttcttgcctctcctggctgctcccatccagatgggtccagaagggttgtccctgcagaaggcgctcactaaggactctttaccccttccctccttgttcagaactgagagagagagagagagagagagagagagagagagagagagagagagagagagatgggggagttctctagcatctagcatcccacgcagggctcagcattttattctttgagataaaaacaaggcagagaggcttgttagcaattcaaatatactgatttggggggaagattttttttttttaatttcaataatatttagaaagtaacaacatgctttcaagagtaaggattgatgtcaggtcctttatcttattctctccaaatcaagaatctccatttgcagtggaagagatctgactcttaagtttcctgtgaaaaaggagggagggaggagggtggagagggtgagttggctgagctgaccaccgctcagggtgagaagcctgtagccagttgcctgtagagtgaaggtacttgagcctgacaagagtaggcaactctcatttacattgcataaagaactttctagtgcatccttgggccatctgaacttcagtctgaccctttgaggtgggcctggatgctagtgctattctcaattccagattagaaagagggaacttgaggtcaggcttgatggctcacgcctgtaatcccaacagtttgggaggccgaagtgggtggatcacctgaggccaggagttcaagatcagcctggtcaacattgcgaaaccccatctttagaaaaaacacaaaaattagccaggtatcatgacacatacctgtgatcccagctacttgggaggctgaggcatgagaattgcttgaacccgggaggtggaggttgcagtaagctgagataataccactgcactccagtttgagtgacagaggaagaccctgaagaaggaaggaaggaaggaaggaagggaggaaggaaggaaggaaggaaggaaggaaagcaggcaggcaggcaaaaacccatctctactaaaaaaaaattagctgggcatggtggcgcatccctgtagtcccaccaggggctgagcagggaggatcactcgagcctggaaggttgaggctgcagtaagccctgattgtgccactgaactccagcctgggcgacaaagtaagactctgtctgaaaaaaaaaaaaaaaaagtacatgatcatgatagaccaattgaaaagtttatggtttcaggttccacattgcaattaacctttaagaaactatacttgtccagttttggtatgtaatctaagaaaaatatccacaattatttgaaaaggctattaagatagtcttccttttttcaaccacgtatctgtgtgaagacagacttttttcatatatttcaaccaaaacaacatatctcaacacattgaatgtaagtagaagcaggtaagagaatgcagctatcttctactcagccagacatttgacagcaaaaatgcaaaacaatgtcactcttctcactaattcttttgttttggaaaatacaattatttttcaactgttatttatgataacatgtacagcatatggtttattaatgctattttaaaggaaataatgcatatttttacaaatttctgttttactttctaacatggtaaatgtcaatggatattgaacataagcacacaaaaacaaaatacataaacaagagctttttggggccctcagtaattgttaagagtctaaaggggttttgagaccaaaatgtttgagaaccatggagctatctatgaagaaaatatcaacttttttctctctctttttttattgagctataattcatatactataaaattcaccatttacaaatgtatgactcagtgttttttagcagattcacaaggcggttcaacaatcactactatccaattccagaacctgtgcctgtgtgcagtcatttctcattactccctacttctagcccctgacaaccacagatctcaatgaatgtgcctatctgaacatttaatataaatggaatcatataatatatggccttttgtgactggcttctttcacttagcatagtgtttacaaggttcatccatgctgtagcttgtatcagtacttcattcctttttatggtagaataatattccactgcatgaacagaccacattttgtttatccactcgtcgactgataaacacctgggttgttccctgatatggtttggctctgtgtccccacccaaacctcaccttgaattgtattaatcccacatgtcaagggcgggaccaggtagaggtaattggatcatgggggtggtttcccccatgctgttctcatgataatgagtgagtctcaggagatctgatggttttataagcatctggcatttcccctgcttgcactcactcccgtcctgccaccctgtgaagaaggtgcctgtttctcctttgcttcctgccatgattgtaagtttccagaggtctccccagcaatgcggaactgtgagtcaattaaaaccctttcctttataaattacccagtcttaggcaattctttacagcagtgtgagaatggactgatacatttccaccttttggtcattataaataatgctgctatgagcattcatgtatatgtatatgtatctttttttttttttttttgagacagaatctcattttattggccaggctggagtgcagtggtacaatttcggctcactgcaacctccacctcctgggttcaagcgattctcccatcctggcttcctgagtagctgggattacaggtgtgcgccaccacttccagctaatttttgtatttttagtagagatagggtttcaccatgttggccaggctggtctcaaactcctgacctcacgtgatctgcccgccttggcctcccaaagtgctgggattacaggcgtgagctactgcatccagctacaccttttttttttttttttttgagacagagtcttgctgtgttacccaggctggagtgcaatggtatgatcatagctcactgcagcctccaactcctctgctcaagcgatcctcccacctcagcctccccagtagctggaattataggcatacaccaccacatccagctgattttttatattttgtagagataggatctcattatgttgctcaggctggtctcaaattcctgggctcaagggatcctcctgccttggcctccccaagtactgggtttataggtgtgagtcactgctcctggtctcatgtacaagtatatataatgttctcaattattttgggtatatagctagcagtggaatttctaggtcttacggtaactctatattgaactttttgaagacctcccaaaccattttccacagaggctgcacctatttatattcccactagtgatttatgagggttccaatttgtctacatccttgctaatactagttattgtcttttaaactatagccatgctagtgggtttgaaagttttgatttgcatttccctaatggttaatgatactgagtatcttttttttttttttttttttgatatggagttttgctcttgttgcccaggctggagtgtagtggtgcgatcttggctcattgcaacctccaccatccaggttcaagcagttctcttgcctcagcctcctgagtagctgggattacagacatctgccaccacacctggctaatttttgtatttttagtggaggcgaggtgccaccatgttggccaggctggtctcaaactcttgacctcaggtgatccacctgccttggcctcccaaagtgctaggattataggcatgagccaccatgcctggctgatgctgactatcttttcatgtgcttcttggcatttgtatatcttctttggagaaatgcttattccagtcatttgcccaaatttaaattgggttatttgtctttttattattaaattacaagagttcttataggctggatgaggtggctcactctaatcccaacactttggatggcagaggtgggagtatcgcttgaggccaagagttcaagaccatcctgggcaacatagtgagagctcgtctataaaaaaaattttttttagttatccaggcatggtggtgcacacctacagtcccagctactcgggagactgaggtgacaggattgcttgagcccacgaggtggaagctgcagtgagctatgatgatgccactgcactttaggctggatgacagagcaagactctgtctcaacaacaacagaaaaacagctcttctatcttctggatacaagatcctttccagatctatgatttgcaaaaattttctcccattccgtgatttatcttttaactttgatagggccttgacactcaaatttttaattttgatgaagtctaattgatttattttttcttcagttgattgtgcttttggtgttgtatgtaagaaaccattgcttaatccaaggtcatagaggtttacacctatgttttttctaagagttttatagttttagttcttatctttaggtctttgattcgttttgagttaatttttgtagacaataaaagataggagtccaaattcattcttttgcatgtggctatccagatgtcccagcactatttgtggggaaaaaaacttatttccttatttaattgtcttgataccttgaccgtaaacatacaggtttatttctggactctcaattctattccattgatgtacatgttgatccttatgccagtaccacattgttttcattactgtagcttttgaacttggaaagtgtaagttctccaacttttttttttttttttttttgagacaaggtcttgctcttttgcctaggctggagtgcagtggtgctatcttggctcactgcagcctcaacctccctgggctcaggtgatcctcccacctcagcctcctgagtagctgggaccacaggcgagcaccaccacaccaggctaatttttgtatttttttcgtagaaacttttttttttgtagaaattttttgtatttttaccatgttgcccaggctggtattgaactcttgggctcaagcaatccacacgccttggcctcccaaaatgctgggattacaagcatgagccaccgcactgggccaagttctccaactttgttctttttcaagattgttgtggctggataatatcaactttaacattaacctttttttcatgccaggtgatgagtacatgggtgtttgttgtatcattctcttcacttttcagtactaacaatgtattaatagaaaggatgacatctaggtgtatagcaattaaatgacttaaatgagttaataaatgtaaaacacagaaaactatctggccccctccatactgttagttgctgttgttgttattcttttaagtgaaaatttttaaaagcatcttttgctgctagactatctgggttcaaatactggtcctgtcactccctaatggtgtgatcttgggccagttatcaaaccttaccaagttctaatctgtagaatgtggataatagccttagtctcagagagttgttgtggggattaaatgagataaagacacaattaaatcagataatggagatcataggagatgcttgaacccagtaggtgctaacctattatttgccttcctacaagtctgcagggagcgatcaacttagtgaaaagcctagaaatcattccacaggaaggacatgaaaaaaatggagcatgaagctgtttttaaatatccaaaagccggatgtggaagatcttttctgtgtaccccagagagtgccagggctcctgaatttcaggaagccattctggccaatcctccccagcccccactcttctgggagcgcccttaatggtctgtggtcatcgtgccagcacttgccaatttgtaattataattatttaggtctcagacgcctccatcggttggtcccattccataaatatttacaaagcgctcactgtctgccagacactatgtgtgctagaccctggggctcatgggtgaatgagacactgctggaatcctccaagtcacagtccggcagaacgccaattggtgaaagtttgaaggagccacatttctgctccatatagcctcttgcagtctcctcctacttccgtaaaaagcctttagtttcagaaccaaggcagcagccagttctccccagtaaattaccagacccaaagagagagtttcagaaccggcagtcgaagcgcttcctggcagaggtcccgggcctggaaacactcggctttctgagcgaggagcaccctctagtgtctgtccacggtaaggcgggtccaacgtaaaacctttcaaagatccctatttattgcaaagaatttctttccttatttgagcgctgctcatggctaagctgctttcaggtctccgctgtaagacaacaacattgacagtttaaaaaataataaataggtcgggcgcggtggctcacgcctgtaatcccagcactgtgggaggccgaggcgggcggatcacgaggtcaggagatcgagaccaacctggctaacacggtgaaaccccatctctactaaaaatacaaaaaattagccgggagtggtggcaggcgcctgtagtcccagctactcgggaggctgagtcaggagaatggcgtgaaccagggaggcggagcttgcagtgagccactgcactccagcctgggcgacagagcaagactccgtcactaaatacatagttaaataaataaataaataaataaataaataaataaataaaaatagttgccaacatcttttgagcacttactatgtgccaggccttgtgttaatttgtcttacatggcttacccagaggcagttactattaagatgatgatgtcccagatattgataaagaaactgaggcaggtggggcagccagctcaagcggtcagactccataaccatgcgcttaattttttggtttactgtcaaagagaagcaacaaccatgggcaataccaagatagttctagtcaaatttctcctgattatttgggagaactgtaatttaactaaatccagcagatttatgtcaaaatatcaaatatggaatgatgatgagcctttctcatgttcatactgaagggaatagaaagaaaaaaatctagactagggttttcaaactgtgggttgaacttattgatgagttggataaacaatttagtggatttttactagcactatagaaattgaaatagccgggcgaggtggctcatgtctgcaatcccggtactttgggaggaggccaaggtgggcagattgcttgagctcaagagctcaagaccagcctgggcaacatggcgaaaccccatccctacaaaaacaacaacaacaaaaaattagctgggcatggtggtgtgtgcctgtagtcccagctacttggggggcagaggtggaaggactgcttgagcccaggaagttgaggcttcagtaagccgtgtttgcaccagtgcactccagcttgggtgaaagagaatgaccatgaaaaaaaagaaaaagaaaaagaaagaaacagagagagaaagaagaaggaaagaaagaaagaaaaagaagaaagaaagaaactgaaatacactcatgtgccatttaacaagagggaaacattctgagaaatgcattgctaggcgactttatcattgtgataacatcagagtatacttacacaaacctagatggtataacccactagacacctaagttatatggtgtagcctgtcgctcctaggctacagactcatccagcatgatgagtactgtatactgaatgctgtaggcaactgtaacacagtggtgtttgtgtatctaaacatagaaatggtacagtgaaaatacggtattataatcttttttatctttaagatggagttttgctcttgttgcccagcctggagtgcaatggcagggtctaggctcactgcaacttccgcctcccgggttcaagtgattctcttgcctcagcctcccgagtagctgggatgacaggcgcacgctaccaagcccagctaatttttgtatttttagtagagacagggtttctccacgttgaccaggctggtcttgaactcctgacctcaggttatccgcctgcctaggcctcccaaagtgctgggattacaggcgtgagccactgtgcctggcctggtattataatcttataggatgactaccatatatgtggttcattgttgacccaaacattgttatgtatcacatgacagcataacaaatcaggactatatgagcatgcataacgaggcagtacatattctcctgccccacccgcctctctctgtctctcttcacgcacacatgatgcatgatatatatttaagtgactcaaatcttccatccagaaacctttcgggagggttccacctggcagcccactcctatcctgaggttactgactgctttaggcagtttgagctgccatagcaaaagcaccctagactgggcagcttaaaccacaaacacttctcagagttctagaggctgagaaggacaaggtgaaggcgctggcagatttggtgtctggtgaagcctgcttcctgggtcgtagatggtcatcttctcagtatcctcacatggcagatgggtgagggagccctctggagtctcttttatgaaggctctaatcccattcatgaaggctcatgacctaattacctctcaaaggcctcacctccaaataccatcacattggagattctatttcaacatatacattttggagagagataaatgttcggtctacaacattgatgaagcactatatcgcttgcatcttgtctttcagccagggcaagaacaagctttcccacccagcacagtgctgtggaagtgtggatgctttgctgattgggttggaggcatgctgagcccctgtcctgtcactctcctgtgccccagcagctccccagttgctccactgatccaccatcatttctccataattctgtatgcactagttctccacacatatatgagcctttacttatcgtttaatatccacttgaccaggtgaaattatcatgatgaatgtgaaatattcataaaatgataaaaaaagtgattatgtgcttttttctgtggtgaggttctgtagcttaggtaagattctcaaaggagtctgtgacccccaaagtattaagaattaaccactacaggccgggcgcagtggctcgcacctgtaatcccagcactttgggaggccaaggcaggcagatcacaaggtcaggagatcgagaccatcatggctatcacagtgaaaccccgtctctaccaaaaatacaaaaaaaattagctgggcatggtggcgggcgcctatagtcccagctgctggggaagctgaggcaggagaatggtgaacccgggaggcggaacttgcagtgagccgagatcgtgccactgcactccagcctgggcgacagagtgagactctgtctcaaaaaaaaaaaaaaaaaaaaaaaagaattaaccactccatttgtctggaagccccacagggccaggatctatttctcttattcatctgttatttctctgtcatgtgtttcgagctgacaaacacagtagatactcgaacaccgctagtccctaaacacttctgccgtcacaacctttattcaagtcactatttgtccaccttgactacaacagcagcttcctaaatggtctctatttctgccgttgccccctagaaaccattattcatacagcaatgtgatctttaaaatcagatcatgtcactctcttgcttaaaacctttcagtgacctcccgttacacttggaataaaatccaaacttctcactctgacatcccaggcccggcatcatctgggttctacctggctctccaatctcatcctacaccactctcctctcttcctctgctctggtcacatctagcctgcttcctcttcctccaatgtcccaagctctttcttccctggcttggtaaaagattcttgggaaaaccttccagagacgaaatcatcttcaaaccaattaaatatacacttaagtaggtgaagcctgtgaattttaaatataaagctagatacatctaggctgggcgcggtggctcatgcctgtaatcctagtactttgggaggccaagacaggtggattacttaaggtcagaagttcaaaaccagcctggccaacatggtgaaaccctgtccctactaaaaatatgaaaaattagccgggtatggtggtgcccgcctgtaatcccagttactcgggaggctaaggcaggagaattgcttgaactcaggaggcggaggttgcagtagccaagatcatgccactgcactccagcctgggcaacagagctagactctgtctcaaaaaatatatatatagtaataataaagctagatatatctgaaagtttgaattatagagccatttcagtacttcatttgaaatgttaagtacatggttggattttagccatgtattttattttatttatttatttatttatttattttgagacagagtctcactctgctgcccaggctagagtgcagtggtgcgatctcggctcactgcaagctccacttcctaggttcaagtgattcttgtgcctcagcctccggagtagctaggactacaggtgcacaccaccatgcctggctcatttttgtatttttagtagagacggggtttcaccatgttgcccagactggtctggaactcctggcctcaagcaatccacctgccttggcctcccaaagtgttaggattacaggcgtgagctactgcacctggcctagccatgtattttaaagggatcactgtgggacttccacttctgcacatgaaggataaactgttgtagagatggcttcccccaccacacacacccaaaattagtaaattaaacaaaatatatgaaacaactgttttcacacattagacagcaggcaatgcaagactaagatctctgagaaaagaaaaataagttcagcctcaccagagccccagcttactacgtggagacagtgaagagagtgctacatggagtacccaaacagagccccgtggtctcactgagtttaggagacagggtttagagttcaaggacatgaagacagctagaatttgtgggagagagtgctggagaagcaagagctgcatggggagagacagagagaaagcgacaaagcctcatagaccattagagattccctcaagtctttggggactgatctacacaggtgtggggtgaaattccagaaggttggaaaaagtaaaaccagaaagcaggaggccgaacaagtgttggagtttacacagggctaggcatagtttgtgtttccatcaaccagagtaaagagacctcataacacacaggtattgggtagagtcttcagaaggatagagacttagtggggctaaattattaatatctctggagtagaggccaacctgggcttttcctaacaaaacttaatagcaagacttaaaagaagaaaacaaatcacaagtaactaattatatgccaggacaaagttcagcactctgtttttttgtttgagtgtttgttttttctgttttgttttgttttgaaacagagtctcactctgtcgcccaagttggagtgcagtggcatgatctcggctcactgcaacctctgcttcccaagtagctgggaccacagacatgagccaccatgcccagctaatttttgtatttttctctagtactctttaaaagaatataacaatgtcttgcacccaacaacccaaaatacacaatattcagcatccaataaaaaattgccaggtagtcaaataaataggaaaaaattacccataaccagtagataactaaagcaatagaaacagaccacaatattcagagatgatgaaattagtaggtgaggaccttaaaatagccattataaatctcataaattatgcccaaggatataaagaaaaacataaatatgatgaagagagaaaagaaatatatttttaaaggacccaaaatggaacttcaagagatgaaaagtttatgatctaaaaatgaaagatgcacaggaggaattaacagcagattatacactgcagaagcactgcataagaaaagattggtgaacttgaaaatatagcaataaaaactattgaaaataaagcacagaaaatccacaaaaataacagagcaccaatgtcttataagataatatcaaaaccaagacacatcataatcaaattattgaaaaggttggctgggcgtgtggctcatgcctgtaatcccagcattttgggaggccgaagtaggtggatcacttgagaacaggaattcaagagcagagcagcccggccaacatagcaaaaccttgtctctactaaaaatacaaaaagtagtcaggcgtagtggtgcacgcctgcagtcccagctactggggaggctgaggcaggagaattgcttgaacctgggaggcggaggttgaagtgagctaagattgcaccactgcactgcactccagcttgggcaacagagtgagactctgtctaaaaaaaataagtaagtaaaaataaataaaataggctgggcatggtagcccatgcctctaatttcagcactgtaggaggccgaggcaggcggattacatcaggtcaggagtttgagaccagcctggccaacatggcaaaaccccatctccattaaaaatacaaaaattaggctgggtgaggtggctcacgcctgtaatgccagcactttgggaggctgaggtgggtggatcatttgaggtcaggagttcgagaccagcttggccaacatagtgaaaccccttctctactaaaaatacacagattagccgggcgtggtggcgcaggtgcctataatcccacctactcgggaagctaaggctggagaatcgcttgaaccgtggaggttgcagtgagctgagattgcaccattgcactccaatctgggtgacaagaatgaaactctgtctaaaaaaaaaatacaaaaattacccaagcatggtggcacatgcctgtaatcccagctactcgggaggctgagacaggaaaattgcttgaactcaggaggtggaggttgcagtgagccaagatcacaccactgcactccagcctgggcaacagaatgagattccatctaaaaataaataaataaataaataaataaataaatagaaaaattaataaggaaaatcttagagtacctagagaaaaatgaacacattacctagaagggcaaagaagacaaatacagtggacttcttgtcacaaactatgtacaccggaagataatggaataacatctttaaagtactaaaataaaaactattaacttaaaattttttccatctttaaactatgaacatgagacacctattagcatcctgtacctcataatgtcatgaactgagacaggtaaacatcacttctgtggttttcatgccaaaatgtatgcttacgtttagtcatgagagacatgaaactcaaattgagacgagttttacaaaataattgaccagtgtaataaattagttgattccatgatgttcaactgctgagttttcaagcccccacccccactcctcctttcccttttatccaaaacctgggcaagccaataataaaggcagaagctgggcgtggtggctcacgcctataatcccagcactttgggaggccaaggttgacggatcacttgaggcctggagtttgagaccagcttggccaacatggcaaaaccctatctctactgaaaatacaaaattagctgggcatggtggcgcatgccagtaatcccagcaacttgggaggctgaggcacgagaattgcttgaatttgggaggcagaggttgcaatgaaccgagattgcaccactgcactccagcctgggcagcagggtgagactctgtctccaaaataataataatgataagaataataatgccagggtactctcctcccttaatgccagggtactctcctcccttgcaccagtagggaaattcaaaccacaaaaccctggcctgtgcatcagaactctcaccccagctttactccctaacagtaaaacccagggccacttgcatctccttgttctcaagctgtttttaggccttcttaagagcctgccctgttctgcacagaaaacctcattacacgagtaataagctttttcaaaccctctgtatgtgtgtatgtggcatcaccaatcttgatgtctaaaccaaatctggggtagagatttgatcccttcctctgtggggcaatcacaagacaactggcacagggaacagcgtaccttagatgatagccacccaccatcaggggtctctctcctctcactttggcttgctattgattctgctgcctattggcaagcttacacttcgagctgtgctgctttgttccacatttgctgaggactactaaatctctgttacagatgtaactgacctgaattgaaagtttctataattggcattttgagacagaaatatgaaattgaggatgtccttaaagtggccctaaaatgtgagccccgtctggacctatctgtgcatcttagattgaattgtatgtcttgattctggcataaaccatcgccgatcctaggctcaagggcatgacacttattattttgtgactgttggttgtatgtcccaaccaggcattagcctatgttctatagagtgtgcaggagaaaggctgatactctgtgcaacatacagggccatctggtggttgctccggtgaggaagcgcagtcaccaggattaaagataaaaacactcaatagcactccatgccatgaacccttataaaaactaggccagaatgccttactccatctctcttaaagggtcagaggacaccaccatcaccctaccagataactataaaacagacccagaaagaagctgggtttgattaagtgctgcaccttatcaaactgtcaagggattcattcaaatccaactcaaggctgggtgcagtggttcatgcctgtaatcttaatgctttgggaggctgaggtgggagaattgctggagtctaggagttcaagatcagcctgggaaacatagtaagacctcgtctaggccgggcatggtggctcatgcctgtaatcccagcactttgggaggccgaggcgggcggatcacgaggtcaagagattgagaccatgctggccaacatggtgaaacctcatctctactaaaaacataaaaattagctgagtgtggtggtgcgtgcctgtagtcccagctactcgagaggctgaggcaggagaatcgcttgaacctgggagatggaggttgcagtgagctgagattgcgccactgtactccagcctggcaacagagcgtgactctgtcaaaaaaacaaacaaacaaataaaacctcatctatacaaaaaattttaaaattagccaggtatggtgacatgtacctgtagtcccagctacttggggggctgaggtgagaagattgctggagtttgaggctgcagtgagccatgattgtgccactgcactccagcctgggtgacagagtaagaccttgtcattaaaaaaatccaggggttgggtgcagtagtcatgcctgtacctgtaatcccaacacttggggggctgaggtgggcagatcacttgaggtcagcagtttgagaccagcctggccaacatggcaaaaccccatctctaccaaaaatacaaaaattagccagaggtgggggcgtgtagtcccagctactggggaggctgaggcgtgagaatcacttgaacctagtagcagaggttggactgagctgggattgtgcctctgcactccagcctgggcaacagagtaagaccctgtctcaaaaaaaaaaaaaaaaatccactagcctgggcaccacagcaaaaccccatctctacaaaaaatgcaaaaatcagctgggtgtggtgttgggtgcctatagtcccagctactctggaggatgaggtggtaggatcacttgagctgatgagtttgaggctgcagtgagccaacatcacaccattgcactccaacctgggagacagagcgagactgccaaaaaataaaaaataaaaaataaataaaaatccaacttaagtctacagtccctaaatcaaataaaataacaattgccatgaaagtggctgccataaggccaggtgcagtggctcacgccttgtaatctcagcactttgggagtccaaggcaggcagatcacgaggtcaggagatctagataatcctggctaacacagtgaaaccccgtctctactaaaagtaaaaaaaattggcctggcatcgtagcgggcccctgtagtcccacctactcgggaggctgaggcaggagaatggcgtgaacccgggaggcggagcttgcagtaagctgagatcgcaccactgcactccagcctgggctacagagcgagactccgtctcaaaaaaaaaaaaaaaagaaaaaaaaaagaaaatggctgtcatgaaagtggcccctaaccctgagggtactgatttgggactctccagaagaagaaacgtaaatatgagcagagaagagaagctccctccccctgaagtacatccagtaactccccccagacacacacacacacacacacacacacacaacttaacagaggttcatgatttaacccagttgcaaatcttaaatttactctaaaaactatacaataaaaagatatttaaagaaggaagggagggtcttgttggcttttgcacttgtacaacataagttctaaattaactttaggccaggcgtggtggctcatgcctataatcccaacactttgggaggccaaggcaggtggattacctgaggtcaggagttcgagaccagcctggccaatatggtgaaactccatctctactaaaaaatacaaaactaggctgggcgcggtggctcatgcctgtaataaaagctctttgggatgccgaggcaggcagatcacgaggtcaggagatcgagaccagcctggataacacacaaaaaaattagccaggtgtggtggcacgcgcctgtagtcccagctactctggaggctgaggcaggagaatcgcttgaacccaggaggcagatgttgcagtgagccgagatcatggcactgcactccagcctgggcgacagagcgagactctgtctcaaaaaaaaaaaaaaaaaaaaaaaaaaaaagaaaagaagaagaagaactattgatttgcctaaattccccatattcatagtgcctgttgccctaaaatattccacaatggacatgtactctggcctagtgagtactaaacaaaaacaaaattaagtttttggcaattacaactggcttaacaaaatgagaacctgagcctttatcataacctattaaaactgttcacacagataaaactaggtatcctgagagtgactctgtataaaaaataaataaataaaatgtactaggaccttttcgagacagggtctcactctgtggcccaggctggagtgcagtggtgcaatctcagctcactgcagcttccccttcccaggttcaggtgatcctgccacctcagcctccctagtagctaggactacaggcacacgccacttgtttcggctaatttttgtatttttgtttgtagagatgggttttttcccatgttttccaggctggtctcaaactcctggactcatgcaatccacatgcctcagcctcccaaagtgctaggattacagatgtgagccaccgcacctagccataagctcaaaacccattatataagacctatttagagaagggtgattgtccccagtttttctccactccaaattgtcctggtcttaaacctagaatgaatgaaggatgcctgatggtggattaccacaatcataatgctgcagttccacttaagagttcctggcactcctgaaacccttgaaatctttaggctaatatgtgtcttttgcatgctaatgaaatgattagctgggagtgctagatagcttcaagatgggggctgatgatcagaaagaccaaggcattaaaagtttggaactttcaggctcatctcagacctatggggcggggagagggctggagattgaatcagtcaccaatggccaataatttaatcaatcatgcctaggtaattaaacctccataagtcccttctaccctacagggttctgtaaacacgtggaggtcccgggagagtgaagcactcagggcatggaaactctgggggtaccctcctccacccccgctcaatacccttccctgggcatctcttccatctggctgttcctgaattgcatcctttataataagccagtaaatgtaagtaaagtattttcccgagttctgtgagctattccagtaaattatggaaactgaggagggggtcatgagaacacccgatttttaactggccagtcagaagtacaggaggcctgggacttgtgactggtctctaaagatggggcaatctcgtgggaactgatgtgaactccaggtagatagtgtcagaatgaaactgaattgctggacacccagttggttttcagagagttggagaattggttggtgtattaggtcgttttcaggctgctgataaagatatacccgagactgggaagaaaagaggtataatggacttacaattccaaatggctggggaggcctcacgatcatggcagaaggcaaggaggaacaaatcacatcttacatggatggcagcaggcaagagaaagagagcttgtgcagggaaactcccgtttttaaaaccatcagatcttgtgagacttatccactatcatgagaatagcacaggaaagacccaccctcatgtttcaattacttcccactgggttcctcccacgacatgtaggaattgtgggagttacaattcaagatgagatttgggtgggaacacagtcaaaccatatcagttggtataggggaaaaaacccatacatttagtgtcagaagtgttgtgagtaaaaaacaggccagcttctatactactaaaattactgcctccctccaatcagcaactggcaaatactttgctatcatatatttgggctaatatgttctcttaagttcccgtttcagccagcttgtctttaccattgcatggacacaatatactaactacccatgggacccccaacagacctgccattgcacacgatctttgcaaacaaaaaccttaactgcatccaactctctccagaaacacaagtatgatgttagatatatgacatccttctcagaggaaattaattttttaaaaagacagggtcttgaggccgggcgcggtggctcacgcctgtaatcccagcactttgggaggccgaggtgggtggatcatgaggtcaagagatcgagaccatcctggccaacatggtgaaaccccgtctctactaaaaatacaaaaaaaatagccggatgtggcggcaggtgcctgtagtcccagctactcgggaggctgaggcaggagaatggcatgaacccaggaggctgagcttgcagtgatccgagatcacgccactgcactccagcctgggcaacagtgtgagactctgtctcgaaaaaaaaaaataaataaataaataaataataaaaataaaaagacaggatcttatgatgttgcccaggctggagtgcagtagctattcacaagtacagtcatagcacactgcagcctcaaactcctgggctcaaacgatcctcccctctcagcctcctgaagtagttgggtgcagtggaaattcatttgatacactaatttaacgcatacaaacattcaaaaggcagctcatgaaaaaggatgggtcatttcttccacacaaagtacaaggtacaagcacaagtatacctcagtaaaatttctgggtattacttagtaaattgagagctgtttatccttgacatttctgacattgtcaagaaatctctattgaccctcttagcacccacaatgctaaaagcccagtatcttttagaactctgggggttctgaagcaacatgttcctcctttgcaaattttaattaagacatttttggtttttttttttgagtcagaatctccctctgccaccaaggctggactgcagtggcatgatcttggctcactgcaacctctgcttctcaggttcaagtgatcctcctgcctcagcctcccaagaagctgggataacacgcacccaccaccacgctcagctaatttttttgtatttttttagtagaaacggggtttcagcatgttggccaggctggtctcgaactcctgacctcaagttatccacccgctttggcctcccaaagtgctgggattacaggtgtgaaccactgcacccggccctacttaagcccatttttgctgttccttacaaattggttcacctgaatggggtccactaaaacaaaaggcttaaaacctgttcaaattgcaaaaggacagaccctactgttagtgctccccagaaattccttcactgtagaggctttagcaacctcctctcatacttccagagactgttagtgctccccagaaattccttcactgtagaggctttagcaacctcctctcatacttccagagtctttggttcacttatgatggccataaatagtctgtgggtttccgatgcaagaaatcgccttcctcagcctgatgctatacattattagagtgacaatagctgactgcatactggactcttccaaaaaaggaggctcttacaggccttgagaccatgacacactagctgcccgctatgccttgggccatggaaggcacacccccaaagcttggcatggctattgaggcttccttgctaaaatgaaaatagtatctacagtatggagccaaatctgggtcctgtagcatatcctgcctgcaggaggccatgggctcccctgtcctcagtttctggccagacaccacagtgctgaaggaggtcattcctctctcagaccccttggcttcttggggatccctttgggatcaactgagtgaacagcaaagggaattcacatactttaaaaatggcagtgctaccgtcacaactgattctatttgtgttttccatcccttaacagacatccctgataaaagacaggacccaagggtccacacaatttgccaaacttcaagcagtcatcttagcaacaaaggatgccctgcccaataagcaaccccatcttaacatttttcagacccttaggccattgccaattacctggctatctggtctgactaatggcaacaacagttctttatccaaggtcatcctctttggggtaaagaactctggaaatgtcttgcttgaagatacccagaaatataaatcaaggtcagatatatctctgcacatactcaagccacaatacaaggcctcaccaagatactccttatccccttcagagttccatacattcttgagagtgaccgaggcattcatttcacttctcaaaatacataacattaggctctttaataagaaggcattgaacagaaattttatcccccttactggcctcaggctgcaggcctcatagagtaccatcacagcatacttaaacaggtttaaatttaatttaaaaaaacaggatacatttcagtaatccattaaacatcaggggtgaattgtaacagaatccaattccatatttgatgtttgaccactgacagctttgaagccccacaactcctccttaatcttttgccctccatttggtagacaaaaaagcctaggtgtttcctcccttggctccagcagggaagttcaaacactggcctgtgcatgggaaaaccatgccctatccccagcccttaacctcaataagacccaaggcaacttgcccctcccttgttctcaagccattttggggccttttggggagcctgttgtgctctgcccagaatgcctcatgccctctttgtgtatatgtggcatcatcagtctccacattcaaaccacatttgggtagagttgctgatctttgctctgcagggcaaccacaaacaaccagcacaagtgtcaagaaaggaagcctgaggaactatcccagattaaaggagactaagaagaaaagacaattaaaggcaataagcaaccctagattgaatactggtcaagaaaaggggcaatagtaggacaatggacaaaactggaataaggtctccaggtgagctaatagtattgtatcaatgtcaatcttttagtttggatggtagttttgtggatgttaccgtatgaagaaattgggaaataggtttatggaaattttttgggcaattttgtaattcttcataagtataatattattgcaaattataaagttttaaaatgttttacctttaaatgactatttcagacaaaagctaaaagaaactgtcgccagcatacctgcagtatacaaatgttaaatatgcatataaatataaaacaccttatttcattttaatatatttaaaagacaatttactatttaagcaaaacataatagcaatgtactgcagggctcatagctacagataaattatatgtcagcaatagccacaaaagagaaggaaatagaagtatactattgtatcaccatacatgaggtaatattctttttattttatttttaatttttttagagacaagctctttctctgtagcccaggctggagagcagtgatgtgatcgcagctcactgcagcctcgaacttcagggctcaagcaatcctccccacttagcctcctgagtagctgggactataggcacacagcactacgcccagctaagtgatataatattctttgcagatagaccgtgataagttaaagatgcaaattataaatctcaaatgtgatggttaattttatgtgtcaacttgactaggccatggggtgccagatattcagttaaacattattctgggtacgtctacaagggtgtttctgcatgacattatttgaatcaatagactgagtaaagcacattgccctccctaatatgggtggaccacatccaatcgattgaagaactgacaagaacaaaaaggcgctcctgccagtagtggaaggctctccctgcctgaatgtttttgagctggaacactgatcttctccagcctttagacacagattcagactggagttatgccactgatgctcctgggtccccagcttgtcaactgcagatcttgggacttctcagcctccataatcatgcaagccaattccttatagtaaatcctcctctgtctgtctatctatctatctatctatctacctatctatctcctataggttttgtttttctggaaaaatctgactaatacattaaaataacagtaaccactaaaaattaaaacaaaaaagtagggttaataagccaacagttagttgaaatgaaagaaatcctgaccaggcccagtgactcacacctgtaattccagcactttgggaggccgaggctggcagatcacctgaggtcaggagttcgagaccagcctggccaacatggtgaaaccccatccctactaaaaatacaaaaattagccgggcatggtggcatgcgcctgtaatcccagctgctccagaggctgagacaggagaatcgcttgaacccaggaggcggaggtttcagtgagccaagattgtgccattgcactctagcctggggaacaagaatgaaactccgtctcaaaaacaaaacaacaacaacaaaaagaaatcttaaaacatattcaatctaaaaaaaggcagaaaaagaggaaaaggggaacaaataacagatagtataaataaaaaacagatagcaagatggtagatttcaacttaaccaagtcaataggtttaaatatcaatataagagtagagattgtcagactgaataaaaacacaagactcgcctgtagtcctagctactcaggaggctgaggctggagaaccgcatgaacccgggaggcggagcttgcagtgagccgagattgcaccactgtactccagcctgggtgacagagcaagactccatctcaaaaacaaacaaacaaacaaacaaacacaagactcaaccatattctgcccacaataaatcgcttttaaatatagagacacagatagatcaacaataaaaggataaaaattcccattcacatcaaaaaaaagtttgagtgactatattaatatgatatatatatatatttttttgagacaggatctctgttgcccaggttggagtgcagtggtggtgatcatggctcactgcaaccttcacctcccaggttcaagagattcttgtgcctcagcctcctcagaggctgggattacaggcacacgccaccacgcccggttatttttttatttttatttttattttttgagacagagtctcgctctattgctggagtgcaatggtgccatctcggctcactgcaacctctgcctcctgggttcatgcaattctcctgcctcagtctccagagtagctgggattacaggcatgcaccaccacaccaggctaatttttgtatttttagtagagatgaggtttcaccatgttggccaggctggtctcaaactgctgacctcaagtgatccacccgcctcggcctcctaaactgctgtgattacaggtgtgagccaccgcgtctggcataatttgtatactttagtagaggtggggttttgccatgttggccagtctgtctcaaactcctggactcaaaagatctgcccacctcggcctcccaaagtgctgggattacaggcatgagccaccacgctggccatatatatatatatatatatatatatatatatatatatatatacacacacacacacacacacacacacacacatatacatactagtatatatatacatatatagaatatagatacataatctattgtatatatattctagtatatatatgtatatatatatatatatatatatatatatattagaaaataagttacgctttagaacaaggactatagccatggacaaagaagagcattacataatgacaaaggggtcatttcactaagaaaatatatcaatcctaaatgtggtacatacctaataatagagcttcaaaaatacatgaagcaccaaaaatgatagcattgaaaggagaaatccacaaattatagttggatatttcaacattcttcacttggtaactgatagaagaagtaaaaagaaaatcagtaagtatacagaagatttgaacaacatcaaatactttgaccttatcgatctttacagatattccactcagcaatagcggagtccacattcttttcaagtgtacatggaacattcaccaaaatagaccataatctgagccataaattaattctcaataaattgagaaggattgaaattatataaattatgttccctgaccagaacagaagtaaactgaaaatcaataacaacaatagccaaaacatctggaaatgaaacaacacaaacttaacccgtagatcaaataagaaagcatgaagaaaattagaaaatattttgaactaaaggaaattgaacaataccacatgtcacaaagtgtaaatgcagttaaggaagtgctcacagggacattatagcatcaaatacttacattagaagagaagaaaggtctggcagcaacactttaagcttgcaccttaagaagttagaaaaaaataaaagagcaaattaaacccaaagtaagcagaaggaaggaaataatatagatgagtgaaaattactgaaatagaaaatgtgtaaacaatacagaaaatgaaaccagccagttttaagaacagccagttttttaaaaggcagactgatcaagaaaaaaagaaaaaacacaaattaccattatcaggaatgaatgaacatcactacagatcatatagacattaaaaagaagatactaaggaaatattaggaacaactatatgcaaataaactcaacactatggaatacattaacaaatttattgaaaaacacaaactaccaaagctttcccaagaagaaatatataatctgaatagtcttatgtatgaaaagaaattgaattttttttttttttttgagacggagttttgctcttgttgcccaggctgtagtgcaacggcgcgatcttggctcacagcaacctctgcctccctggttcaagtgattctcctgcctcagcctcccgagtagctgggattacaagcatgtgccaccacgcccggctaattttgtatttttagtagagacagtgtttctccatgttggtcaaggtggtctcaaactccagacctcgggtgatccacctgccttggcctcccaaagtgctgggattacaggcgtgagccactgtgcccggcaagaaattgaatttgtatcagaactcttcccacagctgtgcatggaggctcatgcctgtaatcccagtgcttttttaaataagccaggagtggtggcacacgcctgtagtcccagatacttgggaggctgaggcgggaggatcacttgagcccagaagttcaaggctgcagtgagctatgattgtgccactgtactctggcctaggtgacagagagagaccctatcttaaaaaaaaaaaaaaaaaaaaggccaggcccagtggctcaagcctgtaatcccagcgctttgggaggccgaggtgggcggatcacgaggtcaggagatcgagaccatcctggctaacacggtgaaaccccgtctctactaaaaatacaaaaaattagccaggcgtagtggtgggtgcctgtagtcccagctactcgggaggctgagggaggagaatggcgtgaacccaggaggcggaggttgcagtgagccgagattgcgccactgcactccagcctgggcaacagagcgagactctgtctcgaaaaaaagaaaagaaaaaaagccaaagaacaaaaaactacagtgagccatcacctcacacccattaggatagacactatcaaaaaacaaaacaaaacaaaacaaaaattaacaggtgctgacaaggatgtggagtaatttgtacgctgtgctctgttggtgggactgtaaaatggtgcagccactacggaaaacagtatgcagattcctcagaaaaattaaaaataggattaccatatgactcagcaatactacttcatttatttatttatttatttatttatttatttatttatttattttgagatggagttctgctcttgttgcccaggttggagtgcaatggtgcgatcttggctcactgcaaccaccgcctcccaggttcaagtgactctcctgcctcagccttccgagtagctgggattacaggtacccgccatcatgcccggctaattttgtgtttttagtagagatggggtttcaccatgttggtcaggctggtctcgaactcctaacctcaggtgatccacctgcctcggcctcacaaagtgctgggattacaggcatgagccactgcacctggccaatactacttcttaatatatacccaaaaggactgagagcaagagagagcttgaggagatacttgcacacccatattcattgcagcactgttcacaacagctaagaggtgggagcaaactaaacggccatcaatggatgaatggataagcaaaatgtagtatataaatataatggaatattacttagcctttaaaaataaagaaatcctgtcacatgctacagtgtgggtgaaacttgaagacatgcaaagtgaaacaaatcagtcagaaaaagacaaatacagtatgattccacttatatgaggtatctaaagtattcaaacttatagaaacaaagtaaaatgataattgccaggtgctggggaaagaggggaatgggggggcggtttttactcagtgggtattgagtcccgttttgaaagatggaaatattctagagatctgtggcacaacagtgtgaatgtgcttaacatactgaattgtacacttaaacaaggttaagatggtaaaatttattatatgtttttaccacaattttttaaatgtacaaaaaaaaaaaaaaaaaacaactccgaaaagcaaacaagcaaaaaacctcattgcaagattaccacaaacccaccagaatgaagagagacagtgtcaggtgttggtagggatatgcagtaactggatcctgagtcctctctgtcattttttttttttgtaaagcttacttctctatggatctcacacattactagtgggagtgtaaactggtcaaccactttggaaaactgtcattatttaacaaacaaacattttcctactctgttatccagcatttccactcctgggtctccaagtccaggcatccatcaaaagacacagatgtaatgttcataacagctttttcattatagctccaaactgaaaataacccttaagtccaccaagagccaaacaggttaaatacattgtaatatattcatacaactaatatgacacaatgataaaatgaatgaactgctgccatatacaacaccatggatgagtcccacacaagtaatactgagcagatgaagccagacaaaagaatacatacttatgtttatatgaagttgaaggattagacaaaactaatctatggtgatagaaagccaaataattgttagggggtatggagggattgaccagagagctattgattggtaggagttacaatggggccttctggtaagccggaaacatcttgatctaggtggtggttacacagatgggatctatgcaaaaatatattgagccagaggtttaatattaggttctataatactatatatcaacaaaaagtgaagaaaaagtagaaaaatagacccaaatagaaaaaattctggggccgggcatggtggctcacgcctgtaatcccagcactttgggaggctgaggcgggcggatgacctgaggtagggagttcgagaccagcctgacgaactggagaaaccccatctctactaaaaatacaaaattagctgggcgttggccgggtgcagtggctcatgcctgtaatctcagcactttgggaggctgaggcgggcggatcacctgaggtcgggagttcgagaccagcctgaccaacatggagaaaccccgtctctattaaaaatacaaaaaattagctgcgcatggtggcacatgcctgtaatcccagctactagggaggctgaggcaggagaacccgggaggcagaggttgcggtgagctgggattgtgccattgcactccagcctgggcaacaagagcgaaactctgtctcagaaaaaacaaacaaacaaaaaaacaaaaacaaaacaaaacaaaaacattttggaagcaaaatttagttttgtcatatttctatattcatgtttacgtggatatagaataaaattcccatttggatgcatttttctctcagcggttcaagctcaacagaacctgcaaatgagaggaggctgcagaagcaaagcataagaagacatatcatggctaggagccgtggctcacacctctaatcccagcactttgggaggctgaggcaagcggatcacctgacgtcaggagccgagaccagcctggccaacatggtgaaaacccgtctctactaaaactacacaaattagctgggcgtggtggcacacacctgtggtcccagctactcgggaggctgaagtgggagaatcgcttgaactcaagaggcggaggttgcagtgagccgagattgcaccattgcactccagcctgggtgacagatcaagacttcatctcaaaaaagaagacacatcaatcctaaatctaaatgtggtacacacctaggaagacacatcaaccttaaatgtacacacctaataacagagcttcaaaaatatatgaagcaccgaaaatgatagaattgaaaggagaaatggacaaatccacaattatagtaagatatttcaacagttctcacttggtaaaatcacttgtaaaatcactctgcccattttacagaggaaaaactgaggcctaaaaggagaaggggtgggggctgaagtcagtggcagagccaggcttaggacacagagctcaggcacacctctacatgccccctggacaaccacctgcaggaagggactggattgtgagggggtgtccccagtcccatgcaggttgaggaggaagcagggtctcagggctgaggtcagggagggggggcactccttagagaccagacagccaggaatgccactgtttgtcgtagtttcactgattttaaggaggttaaacctctatttgggtctcagaaataaagagaagagcctgcaattccaggatagcacgctaacgaagggccaaaacgcaaaggcgtcctgagggctaagatggaaagtgaaactttcaagctccttctctaaccttggccaaggtcgttccctctgggttcatagaatagggaggaacccatgtaaggcacagggaacagaagaaaggaggcaggtagagggacaaccttcagcctggtgcagccatcccggtcgaacaaccccaggcaggagccgctcggtggccgaggatggcgggaagtcgctgggctgcggctggggcgggaggtgggcggaggagggtccggcgctctctttctccggattcggagccctaagtgtggatcagtcgcctcccgcccagggtgtgagcgccccctccccttctcagcctccttcggcctcgcccctccctctcacatttccaactcccaaggataacttgtcgctcgcttcagacgcccatggcttctttcagcccctgggactcagctttctcctctacctcttttgtctatttgtgcatttgatgtttctctgggcgcgcccttggatctgcttctctcttgccttttatattctcatattctcatattctctctctctctctctctctctctctctctctccctccctccctccctccctctctccctccctctctccctctctgcctctctccctctctctctcttctctctctctctctcttctctctctcttctctctctctctgctctctccggccatctgggcgctgctcctccgcgcctctggcctccccgcggcgcgccaggcccatctcctcaccagccgctctgggatccgacggcgccgtgggtgggggcaggtgagacggccgagccccgcccgggcggaggcaggaagcgctctcgcctatccccctcccggaccctgtcctcgcccgccactcaccggcgccaggggaacgcaggagcgtgagccccttcgcgcccccagcgccgtcggcgtcgctgccccagacacagacactgcctcgagaggcctcacagaggcgggggcagaaggcggcgacccagagccgccacatcccccgccttgggcgccgtcacagtccccagacgccctggactcctgcagtctacgaagacgcgcgggggacggcgtggttccgagaggtaggtgaggaggcgggcgcagcccttcctctcgcagctggggactgcggcgtgaaaggcccctctccaagctgggcagccccgtggcccgagctttcaggaccaaccgcccgtggcaggcgtgggcttcccggggccaccggcttaaccttgatctccagaccgaggcagcttcccgggtagggcctcggggcgcacccgaaaacgccttggcctccctgtccgctggcacccgaccctacctctccaacaggtgtgtgtgtggggaaagggggtcgcctcccctcgttctaccggaaaccctggctccccagagccgagtgctcagtgccccgcccagcctgaggccctgcgtcctgggcctcctgctcacaaccccggattccaggcggatgccgtgagagaggcaagggccagacgccctgagcagccttgggggtgaggaatcgcttgggatggaagaagggccacttttcctaacggaaattaggaattggcctggaactcttggtctagacagaagcccccagctccccaaggtgcagaatcagctctcccgcgcgctgtctctctagctgcctcctggcgtggagggggcagaatacttgggggagtctcttgctttggcttttgggggcctcataggttttcttcccctctggactgtgagcagcctcctgcctgagagagcgtgtatctgaatctaaggaatgccaggagacgccatcttatttgaaacccacactcacaaaaacggggcatgtgcatttttgtggagggacctgttgtttatgggagtgggcagagggcatccaaaggatttcaaactgtatggactgactcatgggtcaatacaaaaattattcgcctttgaaaaggcatgtaaagaaaagcaagcataaaggggtgtgcatcgtgcatcgtgggtattgtggagtctgagaggaattagtaactcgccggagtcggctaggaatcttatatgacagcaactgtgcctctcggagtagtcaagcaccgtttaaagattgaggatttatacagacatgcgaaagagatgtgaaattatgtgctcccaactgtgctcaataataaaggcagtagaagggaaattcatattttcatctatatgcctcccccctcgcaaagtagaacattgcatggtatatttcacatagtccacataccagaggcggaatgtgcaactgactgcccaggactgtgctttccagtacaaatggaagcacaaagatgcctaatggagaagagttaagtgaaagttctcttttctcagtgcacttccctaaccctttgaggaagcaagtctggggggcctttcctgataggatcttccctccaaatcccttttggagctggagctcctctctttccctaaagtctggcgcacttggctccaagtccccatttctccagtccagaagggatgaagcctcctccaccccaaacatatagcctttggctcgctgggaggagaattgctcaccttctgcggtggtttagaacaccaccctacacagggatacacatacacagtgccccagaggaaatgcaaagaaaggttttgctagtccaagcaaggtgttgtgggagacctcagagacccttagaaagagcctcactccccacactgcaacttgaaagacccaggacatccctcccacccccaggacagacagggttctcaccagctgggaacgcacagagcccgtgacaacaggaggatctgttgggctgggaacttcacatcccacccaccctgcctccaacttctttttttttctggccagattaaaagtcaagcttaaagtgctgttgggttagagagtttcattgttttagtctattggtttctctccctcattttcttctccctcatctcccttttactcccaggttttgcccattttttttctctctctccacacagaaaatctgtgaattttctgggcttgaacggaaggaatgaggagggaaaggagggaatatttgacctatccaggcagcactcagagctgtaattgacaccaagtcatcctagtagaccttgtcctcacaggcttagaggatatttgattccagaatcccccaccagcaccccaagatccagtggtacctccttcctccttggggcttctatagttttcaaaaatgggagaaatcaaaaatgccatcattattccagtgaccgggtgtggagggagtctgcagtttggccagaggcctggtctcagagaaaggagtcctgagggctggggggttggggcaaggcctagggccaacttggttctgaccttgcctgccagtagagaatcttgggctcttcaccaagtaaaggcaagatcaagggactggaggtctgagtccctctcttgcctaactgccccaagggccccagaaactactctgggccaaaaatcagtaatagttgaaagaaagaaacaaatactgaaaacacccagatttataatctgcttagacacccaaactcatccttaaagcagtaaataaaatttatctccttgactgccttgcaactttctactcagtttggcaatgtgtagatggggtcagcttgagtttcagagcttgggggtccagcactaaatgtctagagagctagatctggggcctctcaccccctttcctcatatacctcctcttgcttccttcccctcccagggcttctcagaaagtgacagctgacttccttttagaactgtgaaatcccacaatttcagaggatttcaaattccttgaacttcaggttgagagctatttggattaatcagagaagtttgtgtctggaaaatgatgccagatttagccagaaaactgaaagaccaaatgctttactttttttttcctttgtctgatctcagtgcttatcaggtcaaccttcacctttaaaaacaccctggtggcagtatttctttgccatcactgtctgtaaagcaaagggcaagcatctcagggcttttagttgggccgggaattcaaatgtctcctttctcaagaagatgccaaagtggccaccctcagcccactttccgtccttacctcctctgccctttccccagctgtagttataggaataatggcctttaacttgcagagatcattaaggccaaagccctcactccttcccatctctcctcttggggccgtctgagtcgcttcctccacgaccctcctcttttgaagcactccctagtactgttaaaggccgaatttgggctggagcgaagatgggggctcagtccaaaataacctagatattaagtaatagtaatgatttttttaaaaggtaactatgaactctcaagcctcgaccacccagtaaagttcctccttaaattgttgccggccctgggtgcagacacgcaaggactggccagaacgcgagaaacttcttcaaggagagagaagtcagggcccaaattcctcatgctttaaagcagtataagaggagagagtccaaatttttactcgttaaacctcctcttacctcttcctcaggtctgttcactccttggtccagggaccggagctcctgggcttcgaggtgaaccagagggaacgtggctccccgcagcaacctttttgcttcagggctcctcctgggggctgagtggtcccctttgctttgctattcccgctgcggctcctggggggacagctccgtgggaccaggtctctcagggggtggagggtcgccgaagtcgtgaccaggagttggagaccgctgcgtccctccgctgcggacctgcctgggactgcgtggaatggaccaagtcctccgtctaggattccctagtgctcgacggcgcgcactccgcagtgctccgctggagatctgcacctgtgtcccggggctgggcgcagagtgaagatctccgtgcacgctgctgaccggctcggcgactgcctccctgctgtgagcaggagaacaggaagtctgcccgacagggaggtggccgggcgggagcggcagagtcggcgttgagaggagggtcagctgcacctcgggattccgcgcgccttcaactccctcttgcggacagcccagccgcgggttggcgccgcagtgatggaacctggggagggcctagcttagagtcccagcagtccagaggaggggaccagagcagaggattaggaacggggctttcatatccagcctaggcgcccagaagcggcacttaaggggcgaagggaggccgcaattacaaaggtgcgccctccgacgcctcaacgtcaagggcctgtagattcacaacctcctctgtcggggatgggggaagatgaggtgggatagggaggctatgtccagccaccagcgcagggagtggctctaaacgctgacccaacgcctcgccccaagcgggatcttggcgcgcagatagaccgagcccgtggtggggcgccatgccgggctccctcgcccttaccgagtgagcatcttcttcccaatttgctgctcagagagggagtgggtcctagtctctggatctcagcgctcacgactacctcgctgctcctaacgaacggttcatctgctctctcctggccgcctgcgccagcgccgctcacccacttttccagccctggatctcctctccccggatgcgtccttccttcccacaattaacaaatgatctagcgaaaccccgccaggtccccggcagagaagcacctccatccgccctaaccaaccaattaatcagatcattaaggagcctgaggagttgtaattgggtggtttgggacgagggggcgctgaggaggtcattaacctccccgtaaagatggggaacggagacgcgcctggccgcctctgccgcccctgccgcccctgccgcccctgtgggctcttcttagcacgcgggttttggccactccacctgcctgctgcgctccagttcccgcctccagtccagctatttcacttctctctttgtcattctccgtcttttctctggcaaccgtccagggcccctttctttgtgcctacttctgtctacctgtccagctgcctcttgcaccctttctgtggcccagcggccaagaaaactcaaaggtcatggctgttggcccccgctgatgatctctgggctcccgggtctcagacaattcctcagggctggctagaaatggtgggagctggagatttggacactatacccattccccaagagaagggcatttgcaaaggggaagtgtttcctgaaacgttcaattctctttcggtatgagatagctttggacaaggtgacaaatggcggaaggtccaggccccagtggataaaagctccatattaatttaattagagacacagagaccttgcatactccttgtctgcacaggcaaatatggaggaggtagtgattgggtgttgtggcctgactggtctcagtctaagagtccccagcacctgtgacctggttcctggtgttccaagaagtccaggtgacagtatctgttcaaccttgtggaacaataaattgtttgtccttttaatttgtcttgtcagatccccaagtatattacaatgcctccctctgcattacatttttggttggttgtgtaagaatggtggatgagaggttcttaacattttggggccactccctgatatgataatttaaattttgatgaacaatattgattcccctctacccagaaaaaaaatgtgcgtatgtagtactcaccaaatcccacaatttcagagagtttcagactcctcagacaccaagttaacaactacaatttggatagatcaaaggagctggtgtctgggaaatgccgaggccaaatatagtcagtttacgtaggtcttcaccctttctcttggctgacatctccattttgccaggccagccttcacctgtaaaaacactccggtggcagtgtcctctccccaccattacctgtagggtctgggctcccagtgggagtcagtctttccttcccagcagctgggagcctgagaacgtgggaagagctttgctggggaaagctgatcttagactggccagcagttggaccagcaatggaaggaaatcaggcttaagcagcttcccagggactaaaaaccataccagaactcctggaagggaagactatctggaaacagcctcctaactaaagctgcctataagtcaagcaaatggggactgggcaatagaatgttcctttgtgtcccttattgactcacttattccatttcctcagggacccagctctacttggggctgatttagccaaggttagaggctggggaataccaaatgctgaacttaaaggggaaggatttgctccctaatattttagtaatcttgtttgtaagagataaacagcatgtgacccctgactatcctgggggacctcctaattacgcccagcctcttgtgttgtggcctgtttagacacagagtgtaaagaaggacttagctcttctttcccggcctattaagtttcctggccatctccccacatgtgtgaattgaccaagctagatctcccaggagaaaaatcaggcttctttggggtctgggaagtaaaaagaaacttcctttttcaaggactatgttaagacaaattaggagaactggaaattatctggctaattgtaccctccccctccatacatacttacactccaaacccaagccctcctggctgctcctcaattgtctatacatttcaaacaaatgtgacttggcacaggaaagactccaactcatttctagttgcccctctctgtgctgcacaaccaccacccacctgcccagcagttcgaggctgtgacaagaagccaatggttggctaatagtattcagacccctgcctgaaaatacaaagaaaaaaataaacaattctcttcttgggacagcttaaactggataatcttggctgtgaaaacctgacctaaatgcttttaatcagagcagaagaaatatatgctcatttgctccctactttactaattaaagaaagctaattggtgttctcagaaacttccaactgagggtcaggagcctctagccatctctttgcctgccccacccctccctgcactgggccatctgcaccatggagttggcctttttctgatagacaattagaagggggtgctcccgaccttctggctccgcccctgcactaggacttggccctgaaaaggcagtgctgctattggccagaagttcttgcccagcaggcttgtcttccttcttgtgtcctggacttgtttctaggagccaagacctcttgctggctgccacatcggcactgccaaccggtggggtgcagccctgctgaagccccagagctcagcccagtgctgggcacatagtaggcgctcaggaaatgattgctgaatgtggaatgaaagtccccagcaggcaaaaggctgtgacttctgttagtggggtggtggtcctctggggcgagtgtatggagaacttcaaggcctcctcctggctgcccaggaagtaggtaagacctgatttttgtcaagcgtttcttagatgttttgtttaattccagcttcgtggccccctatttcttgtctacccattttctaaggcaggaccgtgctcaccacagcaaagggaaataactccttgaaaagccaaaggaatacaagccaccacttctcagacctttcccctatgagatccagatactacaggctaaagggagtttgaacctgaaatgagccagataattgccccaattctctgtaccttattgaagaggtagttacaggccaaggggtccaaggggcctcacttttatagacattgctctaagtcaaaagaatacattatacatatacagctgagacacacaccctccgtcctaggctggctctctgtgaacaaagcaggtttcctccttgccactcacccccaccccccataccactttccccctcctcttttctcttcgtcctcctccttattattaatagttactatttactaaatgctgcctgtgcacctggtattgtgctaaatgctagacacatagtacatcatagtacattaattaatccttacatcaactttaagagttaagacaccagattttacagatgcagatactaagagttacttttcaagcatgaagcacgtgtgtgtgtgtgtgtatgtgtgtatgtgagagagagagagagagatacaggcagatctgagtgctcaagtgttataaagatagaaataaagaaaattgagaatgcggagatcttaaagttttgaaatatagatgctttaaaaggatgcagataattcctcctgccctaaagtgaacaaagaagtgaggcaattaactggctaattccaagacccaaatgctttcccttgaaatgggcagataatgaggctgacagtatgttcgcagttgaattcgcctgatgttgctccatttttttccctaactttagcgaatccgttgggcaatcacagtgagatgcacagacgtcaccccagacgtgcacatattcacacacacactcacacacaggaatgctgacacatacagacccgactttattctgcctctacagtcttttatgactcagcctccagaatgaaaataggggttggagcgaaataatgtgtccgagggtgcagctgctccagatgtgcgctgggtaattaggcatcctcaagagctcctgcccggctgggaaatgcacctcttgtgggactgtagaccccagcaggcgccccatcatagtctgccccatagtaggtgcctgtcctttgctgcctggtcccagcagcccgtccctcctcttgttgccttcctcctccgcaggtgattctctggctcctctgttttaggaataactttgcagaaatgtctctcagagggctctgcagtataaaatggcatctctgccacaggggaaggggaagagggaccctggtttctcctatcctgctcttcctaggccctggacgtttctgaggggctcattccagaacaagacctctctttccttgctccacaagaatttaacaaagaggccctatttgggccaagaaggagagtggcctgactggccctaacccccctcgtttgggggctgtggagcagtcctgctgctggcagcttctcttagttgttgagtctctttcacaaagcattcacacttcacaacttccctttccagtaggtcttcatctgggcacctcggggcctaaggcacttggccagggtcatgcagctagggacgtcataagtgaggagttggcatttcttggaagagggggctggatttgccctggctttgaatcctgtactggctgtccctatatccgcctctagttttcttatgggcctccccaaatttgaaacccaagaaacgccaaacttccaacatagaaaacaccaaaaagctgcctttctggagatgaattttgcttacaagaaagacacgtttggagggggtgaatggtcgtggtaatttggggtaaagaacattccacttggaatagagggctcctcctccagccctgcttcaccacttttaatagctgctccgatcttgggctaatcacttaattccttcggacctcagtgtcttcttttgcaagctgggggaggggtttaaagatgctggcgctgccctctagccggctgctggggacatcaaaggagattcgggctgtggaaggctccctagcgtcggagatggagttaggaggtaagggccagggggtgggagcggatggggccttgattagctgtggatttctgtcccagcgcactcatttaaccgtgtttctcttggttggcagagggcgccaaaggcgacgtgccggccgccagctccaggccgagccccgagcgcctgcaggaacacgccccttcacccggcgcgggacgcagagctgcgagagaatcttgttcagcgcggactcaacgccagggcgccgcctagaggttggtctctgtctcggcctcacccgccgggagaccacagagctgcttccccagccgcccgccgccagaaattggaaaaaaaaaaaaaaaaaaaaaaaaaatccagctggggtctaggaactcggcttctggcacctctgaattctccgagactgtctcctccctccccgcctgtaatgaaccctgtgaagggagacaggccaggaagtcccagaaatatttattcttgtgactctcacaaaatggaaaagggtctcaatttttgtttctttaaggaacttgtgttctgcgtctgtgtctacactgcctcctctcaccaaccaaattgtctagcccccctccagttacgctagaactctgctttatcttcaaggaagaaagggagtggggagaagttacctctaaaccctccagcatggccatcaattttctgaataatttggaggtcaacatgcttttggaaaagtgtttggaaaacgtttgggggtgaaaagaaatgttgcctaactggcctttactcacggagtgaccatcatctcagctagttagtgtatgagcggcaccagcaccccggccatgggtgtctgtgctgagcctctgaaagttgacttatcctttggggagccctcggaaagacacagctggtatctatgggaatggctttggggtgtcctttggcaccatacagataattttgtttttttaattggaatccatggcctgggttcttgggatgggggtagggggaagccacaaagcccctggaaatgtatgcaaaacatatgggtgtgcaggtgcatcatcctaaggctatggcctcttcagtttttccaaagagtctaagactataaaaggtttccatctccttttctcagccagggagccacagagacccaggccagcagtaggctgggagccagcacaccggcccccaccaggtgcccggtaggggatgggtaataacactcttgaatggtctggaaactgctggcccctcagtcctgccgtcctcccagagggaaatcctaatagaagaagtgacagccagtagctgccatctcagtattttgaatgaaaatataacatgataaagagcaaatgagggaggctggaggggcctccccatgcaaatactggaatatgaatgttggccagaaataagatacttcctgccctccagctgttaaagagctccccaattcctcccttttggtgctaggaaggggccagagggcactgcccccagaccaccacccacctctggagagctggggccgagtgggactgcctgcagcagagttaacccttcagaaaattcaaaacctatactgcctagtattttccctgcccgtttattttttaatcagatttttaaaatatccagcagcactttggtgccttttcttggggttggggagtggggttatctatgtgtgtatctatgggaaggtgggtgccttcagtgcactaaaccccctcttgggcctgcagctggacctcactcctgtacctgaacactctgcctgagcctgagctaatcttagccatccattgtgtctcaaaactgttttggaggtgaataactgtgaggcaggatggagaaccttttgctctcccatccagaagggcacctaaccaggcccctggagcagacaaaaggagcaggaagtcaatcacttcgatcccagttctctgaagcccaagaagaaaacggattttccttcgttttggttcggaggcctagtagagaatttggattccaccaagttctcttttttcaaaaaaagtaaacggtccagagcagacaaaaactgtggaaacttgaggcctgggtagtagtggttttgtttgattttgaggctttaaagagataaggagacggtggtggagctccgccacgccgcgtggctctcacttccacgccgaggaagaccgaccggcccctaggtttatcctctgggagcccccggcccaatcagcccccttcaggccttgggagtcaccccgagtcttatcttctgtccccttccagcaagtacccggcaataaacgggcagggctgggcaaaggtctggccgctagaaacggaaaaggaaagagaaaagtaaagttaaacaaaaaacaaaaacaaaaaacccttgggtcgggcgcggtggcttacgcctgtaatcccagcactttgggaggccgaggagggtggatcacgaggtcaggagttcaagatcagcttggccaatattgtgaaaccccgtctctactaaaaatacaaaaattagccgggcgtggtggcgggcgcctgtagttccagctactcgggaggctgaggcaggagaatcgcttgaaccgggaggcggaggttgcagtgagccgagatcgcgccactgcactccagcctgggtgacacagcaggactctgtcaaaaaaaaagaaaaaagaaaaaacccgctttcagcggaaagatgcaaaaaatggaggccaccgggcgtggttgggagagcctgggctttcgcaaggaagcgccagggagcccagttctgctctagcgagaagcagggagcctcatcccaagcccggcgggccgagccgatcatagggtctgcgcggggctctgtggattttccgtgtaggcggcggcttccagtctctgccgggcgcgggctgggtcagcgccgactcctccgagagaagagcgcgcctggcggccggttcggcggaggccaagtcccgggggctggggctgcttctctccacgcggacaaagtgtgcgggcaaagaaaggggccgaggcgggtgcttctgccgctcgtaaatttgtttccccttccttttaatccgcccccggacgtctttcttttcaggacaggaggggatgtaaaccgtttgaagttcatcaacacggtgaagttttattgtatttccggtccccaagatttatacccgggagggggagcgggcggccaggtggactccctcgctacctcggacttccctgccggacacgtggccactcggaccctcgcttctgggcgagggcgggagggagcctggactgggccgcggccgctggctccgcaccttccgacggccgcgcactgccggcaccgccgccgcccaggtaagtccgccgccgccctcggcctgcacagctgcgtttttgcgatgggtgcgggtgtgagcgtgagcacctgtgagcaggcgggtgtctggagaggcagaggtgaggagcgggcacgttagggggccaaggacccagaccgaaggtcaggaaggaggaagcaaatttgttctctgtgtcccaatcccagtccttagcctctcagtccttattctgcgaagattcggaatgaattgtcttacctggggcagctcggcctctgcagagccagggccctgggacattttgggcagggtgccttcacagcaactgttcagatcaaccggctttcccctccaaatcccattcttcctctgtttgttccctagaattcccgaaactttctgacactctgcttttccacctttctctctgtcactttctttctcagcactcttttgtctcactctcctgtctgagccccaatctcaaagctggggggtgtgtaggacttgaagatctggcctctcagagctacactgggaggctgggtgacctggaatacaggggctagcagggtgctgagtatagatgcaccttcgtatctgtttgaagttgagaattctttttatctgtggagacctccagctgggctgagaggcagagactgagcaggtatatcaaagaggccctgcccaggcttgtgcctgtgtctagggtcttcttctctggccagggctcctggaaggcagcaaatgtctctggaatctgagctatcaggaccggctccaaaatggttttacctagagtcctgggttcagttcttccgatgtgttgtttagtagcaactgggttcttctgttggggaagaggtggagcaaaatgaagttaagccgctttttggcccacaaaaaaatggccacagggtttgcccccagtgagctcttgacctagagcttgaattggaactgctgagtgaattaggtagtttcatgttgttgggcctgggtttctgaacacaacaacattaaaccacccgattcacggcagttactgctccttgcttagctggaggagttgggggaggggagcagaatcaggactggaagatcaaccttgcaaaatggggaagaggtttgaggtccttcatccaggagcaacaaggatgttcccccagagaagagatctgggaagtgtcttcccacttctgaatgtttttttgtgtgtgtgttaggaggggaagggggatgaggagcagtcaactctcccgaggcacctccctggccctgttgggctgttcagcccaacccaaagatggcagtcagagctccaacttccagccttagggtctctgagctctcaactacatccagaactttccagagaaactctccccaacttcacaaatatttgatttcaaaagaaatgcagggggttcttgaggtttttgtaactctttgcgggctggtgctccacctcagcaggaagcttcaggtccttgaagagggctcagtaggtctcattctgaaaggcaaacactgagagctcttgcaatctcagcctaaagccctcagggtcctgtcgaaggccccctatgggaccagacctacagaagtaggtccgaaaagtccttcctttcctaatccctcagttgactttttcctccccacccaccccagtggccaaaggcttcccactggccttgggctgggctgggggtacacataggtcctgagtgccacctccttggagaggggcctgacttgcaagctaatggggagcccaggttgttggacaattcaaccccgactgatgcagtgacaagggatgaaaccaggggttgggcagggcaagactctgataccctctctgacctcggtcctcttaaggctgttggccctgtgcccaggaaaggaataactagaagtgctggtggaagaagggggactttccaaagcataagctaacttttgttcccaaaccttccccctgctgcttgaggcagaggaaatgtgcaaaggggcccgggaaagaggcccgaccggatggggcttcggcgccaggctgacttggagggccagggggtctctgaacaaggggcttctgctagagcagaggggcattagggagacccacccctagcctaggggaaatggagccttcaacccactgtcctgataagcaaaggctaacaactctgtcccttgacagtttctcatcctctggtctgggtggagatggcctggcgcgtccctgcggccttatctcacttctccctgggcctctcacaaacctgcccagtcactcagagcctgactgtcttccatccctggtgtcccttggccaccccctcccaggaaaagtgctgtaaaaagaaaaaaggagaatgttagagagaaaggaggaaataaagtctttggaaagcagagttttacaacagccacaggttttatggaagcaatttcgtaataaccttctacctgctcgcctcctttccgcctgcctgccgcccaccccgtttggcctcctggatgccccctcccaaggagtcagccacccccatcgccttggatatccttgatggctgagagttggtaagaagattcctgaggtgggcttgggccactgacctctcagtccttcctttcacctctgacatcctgggagggaggtttggcagaagatttcattacttcacaattaagatccccacttggggggtgtggaagcaccgagatttgaacctgagtatgcagattcgatgtgatacctgttttggaggccgttttgcataaagggtaaggattttgcgatcttgtgtcctttcccactggggcaagtgtcctcatgcctcactctttcccagagtgggtctggactgtgatcttgagtctgaagaaatacctctggtgcttggagacatagatttggggacttttctaattttgttgtacacagcagtgcttttgcttgacctccacagtcactttcacactcggctcatctctgtccacctctgcttcataattctgtgagacacatgtgcttataagtaactgtgcctccacccccgcgctcatcgctgtcatgaaataggcatcacacaatgcacaccgtccctgcggtcttgggtaagaaacacagtaaaggattttatggtcaaacaaagaagtcacaaaatttcataacctcttctgggccactttgaagcatttattttaccttccagagaaacattttggaaagaagttgtcgtagaatcaacgtagtgttaagtcatatgcacttgtttgaggatacgctgtatattttgcttgaatatcaagtcaagggacagattttcaagtgcgacatctgaattagctaatattttatagccataattcaagtacacaaatacccaagcttttgccttttccataggtgtgtgatggttataaaaatgtacacacaaccttttgggtaactgatcttcttacacgagcagaatcagaaacctccatcactcacagaggttatgcatgcatccacatatgcacgattagatcctgcatacacgaacgcccaagcacagcaagtttcatagttgggcagatttatttattacatattctatatacagtatagagcagagtgcatttgcacactgggttccccatacagaaatattgatttgaaatatacatataggacacacacatctatttacattaaacacgcgtaaatttcagctaagcttattaattaaaaacaaactatttttccccattctcacttattgtttttctttcttctcccatttccttcccttcctctagattttctctctcttcttactgacaaggacccttccaaaagtcacccccacagcataggcactcaccggctggtcggcctctgctcttcaaacctcggcctcactgttggctgctctgggccccagtgtggccaggagctgcgcttttttccctgcttgcccttctccaagctaccagctactggccccagctgtgttcaggcgaggctccagtgcagggaatggcaaaaggctgcaagggaaggcagggttttccttctttctgtttaggattgggggtggggtatggagcagttttgctctcttaggataaggtgacccccactgaagcaacccctttactaagtgtctttggaagctgggctccaggagccacaatcctgtttgctatcctccttcatggtgggtaccattgtctggggagaaaacaaggcttttttggtgggagggagtccacagtctctcagctgaccctttaatcatttgcctgagctggagttgaactccagtttggggcagcagtgctttccagaaagcttggctggggtgggactccttgcttggtgcatttacctggacggcaaagagctgggatgcagactacagggcttaggggccagttcattctctttcctctggagtcattgctccctgagaagaccaagacctccaaaacctgtcattttaaaattgtctccactctccagcttcttcatgagcaaaggctaagttccgatctcagaaaagaggcctaagtccccttctcacccagcactcaggagccaccagggaataaagggcaactcctcagacagacagcaacccacaaacccaaatcttgtctgctgggagaactcacccttgtagagcacaagccatcagcccaagtgttcttcttcctctaacttcttccctaaactgagtggtcctcttgactcctctcttgttgcagagaggcagctgcaaagtcagggcaggagagggaaggggaaccaggaagacggcagtcagagcgcagtgcctgctttgcttgggtcttaaggacagcccagcgctgtgacttttcaataaataaaaaaaccccagtccgtagtaaacatgtccttttaggccctaatttatatactacagaaatcatatactcagcccaccatgcttcataacaccattatttatggcgggggagggaatcttttttcctgaagagtgtatttatgacaggtaaagccaacagcagacttcatagggctggcaaattgagaacaggtgctttgccttaactgtgattcattcgctcagtgcccagctttttcgctggtgagtccggggagctccctcgactttcccaagcgtccaacctctgcttggaagaatttgcatcggatttttgtttccccacttgggtcctatggaaaaggcagaccttcatgctgtttggttacggatctgccgggctgtcaccctcggagagcaggggtgggaaaggagggggccagatgggcgccggcattgatctttaaaaaatcattttgaaatcgccataatgtgaagaaatatggcgcttcaccctcgtatttcacgtgtaatgacacgagatggcttcatttggaaagacaagcgggtgggagtgtgtgcctgtgtgggaggtgatccgcagccttctacaaggcagaggggtaggtggccaaaaagatacggactcaagttagagtggcccctcttttgctaaaaggaccggactgagggcagcctgccttattaggactcagagtcagagagttgccgagaaatccaccccaatctacccctgagcctaaccagaggagaactgggtctgtccaggggtcacacctccccaagtgccaggagaggcgactgcaaccagggcagaagctgaggagcaggggctgggagaggagcgaggaagccagtcggtgggccccgggggagtccctgtgcagggccacagaatagatatatataaaaagggctatttggaagctccaatgaaggggtctgcagggggtaaggcagtgaggggaagagactgaccatgggctcgctgtccacactggcccctatatcggtgtttggaaatctccagagcaggagcctcaggtgagaggagtagtacaggagggctgaaaactcagcccaggctccttcctctttggatggaaggggagataacttgggaccccttcccttgctgactggggatcctttcccaggcctctgctctggtcacacctcaggaaagtggccttaaccctttctcctatttagctccctcatcagggcaaatttaggggcctgggtggttattcagtggagaaaaggagaaatggcttccctcacccccaccccccacgtcaccaccaccatcttaaatccatccttctggccagagtcagagaaaggcccaataaatgtaaaggcgctctggttccttgtattaaactctttcctaggctcacgtttccgggacctgatggatccctttaacctcaagtagtttctaatttcaggacagatagtggattcttggacactcagtcgttttattcacctctctcctcctccctcagctactgaggggcccagggaagctcgcagtcatgtaaatctctacaaagagtgcaaggagagccccctccaaagcggacaacgtcctaaaatccccaacttttcccctcatcattttacttcatctcctgtggattgctgctgctgttgttgtttaataaacatcttttgtcaaggggaaagagaagaggaaatgagggcctgcggggtggaggtgtgtgtggggggacaggagcacctcctcttccagtatcctctcgggcctctatggcttctccccgggctggggctctctccctccctccgcccttgctctccctccctccccgacccgcctggggagagggctctacagcctgcgtccctcccaaggcagcccgccgcttccctccgcctctcctccgcccccgccgccccatgttgagaactgccccccttcctgcagcgggagggggggaccgggcggccggtagctggggctgaggttacgtggccgccggagccctgacgtgatagcacattgcatcagcataaaacaatccatcctcgatatggagtgcggtgcggacggatgacagcgagagcgcagccccctcgcccgattgatttatgtcggagctgacgctttatcaggcagtcggaaaaactttgaccaatcattttgcaaggagagctgagacgggctgctccactgtactttgttggctgagaagttgagcagggggtgggggtgggagggtggggggctgggggggtcgcgtccgaaagccctcacaccggtccgggtgccacctctccctgcttgggcgccgccgcgcgagcgcttcccttccccctgcaagcgcccggataatgtctgagaatgtccatttctgggacgcttagcagctattatgtcgactcgatcataagtcacgagagtgaggacgcgcctccagccaagtttccttctggccagtacgcgagctcgcggcagccgggccacgcggagcacctggagttcccctcgtgcagcttccagcccaaagcgccggtgttcggcgcctcctgggcgccgctgagcccgcacgcgtccgggagcctgccgtccgtctaccacccttacatccagccccagggcgtcccgccggccgagagcaggtacctccgcacctggctggagccggcgccgcgcggcgaagcggccccggggcagggccaggcggcggtgaaggcggagccgctgctgggcgcgcctggggagctgctcaaacagggcacgcccgagtacagtttggaaacttcggcgggcagggaggccgtgctgtctaatcaaagacccggctacggggacaataaaatttgcgaaggaagcgaggacaaagagaggccggatcaaagtaagttataaaaagtgaggaaatacccaggccgaaggccaggaggggggcggggaggggaaaggcaataaactgcggacaatgtgaagggaaactgcggcggtggccggagagcgggccgggaggaggaggggagaggaaggaaagacggagggaaggggaaagctgcgtgctctagaaggggagactgaggccgccagaggagcgctgcccccacttctccaagtcctgcggggaacaggggctcggggatcgacttgcagctctctcggccctctttccccctctctcccggaggccccagctgaaagcccggccagagaccggcgacggccgggagaggagctggcgggggccggggccagcggccagcgaggccgagagccggcgagggcaagggccggagcgcactgggctgcccggggccgtgcggctggcagagctccccgcgccacgcgcagaccgtaaaagccggccaaggggaagggggagggagctcattaggattttatttgcgatgcaacagcttggcggaggattgttcctagcagatctcgcgctgtagccgcgcagagtccgcaaccggcgacaggaggggcgggggaagcccaggacgcggtgactgagccccctccccggatgcgccggcccctccccgggagccttccctccggtggcccctctcctcctcggcgtcctcgcaggggctaccgcttccttttctgcggtcccccgctgctctctgcggggctcccgagccccagcccgggctgtccgcctcttggggagtcggggaatcgcttccgaatatcggggcatctcgaagggaccccggggagaggaggggtggggggaagagagagttgcagagaggcggagaactttaccctttgtgggtagtttcccgtcacctcccactcctcaaaagcaccccggccagaacgccaagtctggctgattttcaggaggtgctactagatgagaagagagggttctcctattatttatttttaaggttgagaagggctcatcggtgagggaactcagcctcaaacaatgactcgcaggctggtggatcaggtcctcgtttcttactctttttgggaagtagggatgttttagtctctccttgccctgctagatttcccattgacggagtggccccagggccctttagagcatccttgcctgctggagagtaaagagcagccccattccttgcagggtcctgtcacctccaacctgccaggtggaatcctaagagctggcatttagggaacacattcttccccaaccctccccgcacactcccaaacagatcccccaccctaaacccccaaattctgcctgaaaagcccattatggcaaggcagccatttggctaggatcaattattaacagttttttccctctttcatatttaatgcggctgcgggtcccatcccaggcaatcacattaaggaaatagcgctgcaaattggtaagacacggtacttagtgtaggatgaaccaaattttttatataaaaaaatccagtgtttttcacttggggagaaggaagctagtagctggtggctgttatttttaattggcttagctttatttggcaacttttttgagttccagagtagggggagagaaggtaagaagagaagcctgtatatatttttgtttcctctcttccactcggttaccctcttctcccctccagcccccacataggatcaattaaggctaggtgtgctgtgaagggcttccttttacctccacatcacccctggctccccaccttgggactggagcaattttattccctaatttccctgcacttgcgttaaccaaactgtgagctgagcaggagctgaaaaggagagagactattgcaaccataagttatctgtgagcccccagtgctcccctgtccataagctggagttgataaatggttgcaattgcattgcgtgtgaattggagtgtgctggctgtttgtggctctaagtgcagacccatattcgtggtgtgtggtggtggcagggggggagatttctacgcagacacacatgcctgctgccatgtggtctagagacacaagcttgtttgtgatcaaggcaggggatattgggactggactgaagggctgagaggtctcttggggtgaagtgacaccccaaatgcagtgactgaacagacatctcacttccccacccaactcctcctctcacctcctagagccaggacccttcaggtcagccacccacccctagtcagcctgggagtgctgctggtgggacttcaaccatgctgaactctgacctgagtcctaagcagtttggacccaagtagagaaaaattgagagggaacttgatgtaggcagagctttggaagtgctgaggaagcctgggcccacgtttggctccatcctttccacacagcctctcacctggaggtgtctatagcaatggctggcccatctgtgacacccttcctgggagcttgaagacccaggtggcctcttctccagtgcaagatggggagtggagaccaagggagtgccctcttgatctggggcccttcacccccttcctttctttgattctatcgctgcttctctttcagccaacccctccgccaactggctgcacgctcgctcttcccggaaaaagcgctgtccctacaccaaataccagacgctggagctagagaaggagtttctgttcaatatgtacctcaccagggaccgtaggcacgaagtggccagactcctcaatctgagtgagagacaagtcaaaatctggtttcagaaccggcggatgaaaatgaagaaaatgaataaggagcagggcaaagagtaaagattaaagattacccccagtcctccctagctcttccccatctcactcttagttatgtgacgactgcaaagccagtgctgtctgggatgtattcaagtgaatggggaagggagtctctcttccaagtcctttatctgcacctagaacctccctcctttcctttgcccttacctgtctctctcttctctctaggtgtcaggagaaagttttgttgatttagaagatagaaatagttggttcctaagaatgtgatgggccacaaggaaagagagaccccagtcaagctcctagtatgccctgtaatttttctgggaagtcctagcccctcacttccagcttgcctgtttcttctctacacccacccaaaagtcacccagggacactccaactctacacagctcagcagacatccacacacagtaatggggtgagctcacaaccaccattcagtcaagtgaggtgacactccagttgcagaccatcgcacaccaaatttggcaaaacagccctcagactgtcaggcaagcccgggttctacccctaatgcaaatacccaccagggagatgtctagaggcagactcctgagtgaggtgttgcagcccaaaggctgcagcattgccataccattcccatggagttgccaactattctcaggccaagggccatggggaagatggagcaaacctagcccccaagccggtgggctagaaagtacaagaaaaggcagcacgtggttttatgaagctatcttaggtggagctactccccacctcccaccaacatatacattttgttgcaggaaatgtttaattccgcatgatgtttccctctccttccaacaaaagaaggtcaaactgtgggtcgtagagccttgacaatgttgtcctcctgttcatctgtgcaccacttgacagactgtagcttctcttgctctcgaccggccctgcattcttccgcaccctccctagctctgaaatcaactctcttcggtcgtatccaccttgcacccgcaagtcaagccgccccttgtagaaaaatccctccaccttccgttccccgctaggtcaaccccactgtagacaggaaagccaggccaggagagtccgaatgagaatttattgtgaatcgattcccaagctcccttccgggacaagtggtctgggacagggaggagcaacggccccagcgcgcaacgctctgcgcgttcctccgaatcccgtcggcttctcgacccacgcagagaagccccgggcttggcggctctagccccagcgccaaaggagacccgccccagggccgggcttggcctcctgcttcatgggcctggatgcagatctgcgtggctggtgcgtgcgcgcgcttctgggaaacagtcccgcgtgcaaaggaaaggggcaaaatggcacctaagcatcagatggaagcttactctctgcttccgttcctccccctgctcccctacttctcagtccccttcaatttgtagactcttgctcctgcttctcctgatcctgcaaggggacattccagtagaagttttttgctttgtcggtggctgtcgtgaaattgtgcttgtgtttcgtgatttctttgggggtgattgtctcgcttgttttcagttgtcgattatatgggagggttctgggtgggagtggggagggcgaggggcctagagctctaattgtttgttttggaagaaaaaaagaaaaagaacaaaaaatatatatcactctagaaaataaatctctcctgtgtcttattctgtgttggctctctgggcctgaccataggtagagatcccagttgtcgggagaaaggcttggaaaaaaaaagattgctgagtccaggaggtttctccttacaccctgcagggcaaggtcccctgcagagctctctagaggtggagctgagagccagtcccagaccccaggtcccaagactactggttaaactgatcaagagccttccaacaggagaactggaaaacgagcggggagggaaggaaatgtgggttgtttggagagggcacagggtctggggagcaatgaggtcctgaaacctcctcattgactagagaataggagggaaggtaggtcttcctgcacctcctgggggtagctctcctccctcagccactgagaatgtcaccttagtttggccgctttaaaatatgatgcaagggaggaacacagtaatttccctctgttcttccctgcagtagggtgcctaggtctagacagaggcctccagagggctggaatctctttccttccattcaaagggagccaacgccttagggttctcggcccccacctggggttggaggctccagtttgagccacagggtagcagccttggtctgaggtgggctgggttggtaggggctgagccctgggtaagcacctctgcaaagggtggagaggtcattgagtgtgaagcagaaatgtctcagtagaaaaattcacctcccaaaaggaccccagaattaaactcagtttcaagaggcacatttttgtccctctcagactgagggatttcgccagagcctcttatgaagatcgcagttctcggcagcctgcgcttctcatccaggccttgggattccgcttcggcgggccggcgctcccgagcccgcctacctcaggagcctctccccaacccaagccggcaacactgcggcccgcggagaccctgcgagttggggtagagttgggaacgaagcatggcccgaatgaagggagactgcaagtgaaaaggccaggcctaccctcctccaacgaaaggacgaactgatccaagagacggcgggaggcaggagaaagcggagctccgcatcaggcaggcccggacaggcaccctccaaagagggtttcattagggatgcaaaatgaatctggctttacagctggtgtagaccaggctcctgccccatcctgggctacccaggcccagccggtgctgacagcaaagacagaaggtcggtttctgcctaaagcaaacgctcagcgaggctggaacagaggggagtgctgcgtggtaggggcgagggcgcttggaggggcctctgcctgcagcgtctgggtccccagcccagggctgcttctttaaagacaaacaaaggcgaagatgcggaggctcggaagccggagatggggaaatcagttgtcataaaagagagattcagagagggacaccgccagagtgcgaggcagagagaagccgggagaggaattcaatgccgtgtgcgcagcaataaaataatatgaccgctataaaagtttatagcgtataaatttctgaaggttaagaaactaaacagcagcaaagcaaacagcgaggggaaactttccggagctgagagagccgcagctgggccggggctcccggcctggcgggggaatgggtgggccccgctccggcagccttcaccctcacccgcacagaacacggggctccgggcttccggggcggggggtggcagggggcagagagggagaagagagaagccgggaaagaacactttgttgtcgcaaatgcttcagaaattgcaactggggctcttgtctttgttcttcacaccccctccagaatcaggcgtcggaaacgaggagcctcctgcgcgcgcgcgcacacacacacacacacacacacacacacacacacacacacacacactcaggtccggcggggccagacgtctgggcgcgggcagcctcttgattcttttacagtctcatcctatcctctcaggcctcctctcccccgacaaaaagcccaactgtttctcctcagaatttgaaacaatcgcgtggagtttgaaaactgctcggtccccctttttacaggccataaagggcgcactgctttgcggtctccgctagaaattaggggcaggggtgggaggtgtacgtagaaagaaaaaagcttagggcttcttttttttcctcccctctgttgtgttttttttctattttttagcttatctacacaatttcatgaaccgtttcctgattccgatgcccactccctatccctccccttttactgctagttatgaaagtttctcctgctggccacctctgcggctgctctcccagaaaactggtggagccggtggctgcggcgccttttcgcagagcagccgctagatggcacccttgctccatgtgaaactccctggagcggcagctgcggatgtctgctcccggcaccgcgccttggtcggccctgaatccaggaactgagtgctaccaaaagtcatgaataatttgtacctaataaaaaaaatagggctcgttatggccttacccccattttatagatttcagttatagtagtgttcccccatctcctcaaatggtcaattttctgaattttccccaagaggagggctcagtgattctcacccagttgctgtgttcggtggggcaacaaatgcgtgaaaacggggaataatagtaataataggaataatgggtccaaatccaaaaggagaattgattcgaaacaacgagattttccgtgaaaggaggcgaaaggaatgtccctggatgcgggtcagcaggtcaggtgagaggggctagccggcaaaagaaggtaggatggagaggaagctgcccatcggctggagagaaaatcacgtaagccagcccgagaccccccagtttgtgtgtgtgggggaatggagccatagcttttgtggggattcggagatgcccaaagccggcagggcggcttcgcacgggcgcaagctctggagcctttgtatgagtccagggctgggctgggctcgcgcagggcgacctaggcacggggcaggggctccccagggcagcagggtgcgggaaggctcggatgtggtctctggatgctttgcgcgctcccaaagaatgcgcgttttcccatgggcgcgaaggcgggcgcggcgtcaggacgcaggagctctgttctccctgggttcctgggcttccaggtgagaggtgcggcttcagtgcgccttggccctggccgcaggcaaacctgggggcgccggtcctttcctcattgagcagctggaggtctggactccgggcactttcgttctgagacccgcaccctggttgttcacagccccttgcattccaaatctcctgtgtcctcccggccccgccggatccctgccttccatccgacaaacctgcgccagcaatagatactcccaccccctcaaaatcaccccagctgcagcctctcctctcccccaccaggacttagtgcaaggaggtaagcggagtttctcctcaacttgagtttctctaataaatctgcgctccgctgggtgtttataaattgtctcctcgctctttcgttttttttttttttttttcctataacagaaacattttccttccatcaggaatttctggcacggtgtagagatgatttagaacaagccattgaatttgtacctcgccggtgagttttcaaataatgaccataaaatcctctgcacttgataaaaatgtttgcttcggcaacaatttaactcggccctccgttgcctcacggtcccctcagccacgcgctgaaaattcaaagccctggttctctccattcctcctcttttcctttatctctctcccgcttctagcccctctctcattctctaggttcacttttgaagaaccaaatgacctcactggtaaggttccctttggaaaagtgatagtttcatttttacaaatgttggggtgtatggggtccccaaaaggtgcccgtcaaaaaaacaaaccactgtttcctgaataaacaatggattgaatatatttgtaaagcctccacttttgttgctcaaaattttctttctgtctctcattcctctcccttgccaatctactgctacaggaggctactggttctgaccctcagactggggccttctaaagcctggccaccaccatcgtgaagccgggtaggcagggaacgcagtggccacagagtgtggcacccagtcagcttgttccagctttccgtgttcagacctctggttcccaggtctgcagggagagccaggtttaactacaggctccccaaggcgaaaggagagaaaatgggagactcagcaaccttgctttatctgaattccacacccaagtcagtttaggtggtgacagtggctcaaaaggtcttggggacactgaggactaatagatgccctcccaacacatactctgcaggcactgcctagggtggctgagagcataggacagcggacacgaaggccaggtgccagggcctgatacccaaccttctttccttttgatgcagtgatgggctcagtggtcccctctcacccttaggcactgcagaaggtgtgggggtcggcctgggaaggttgggagctattaataattgggcttggctactgggtcccaaggcctgggtgcaagtgtcgggtagcccattggggcttcatccctctgatggcatcaggccctctcccttcatgcaaagtctgccctcaaaagtgctgatgggctgaagggccttcaggagacccccttttcagcaagcagagagtgcacaaacctgcagaatcggcagtggcagctcgaactttgctctgtgcttcaaccactgctcattaaccagaaagtttcttcttccctcccgttccctcctcaagatctcccagatccctgtttcacagaaaatttttgcttatttgtttaatgagaggaagttttgtgactggccagggcagggcagagagggcagggcagagaagggaccttttgggggctccagagaaggggtgggggcaggtgcttgccaggacggaaggaggtgaaaatctcagaaaagtcaccgtttgtgccaaaaaaaaatccccataatcattctcatttcggcttcgtcacccccaccgtgctgcaatcgggcggcgggggcgatcgaagctgcagttttatagctgtagaggaaagaactcgtaaaatgctaacagcttttatgcgctgcggcataaacaacaacagactccggctttattgcgttttatagtttcttaaagagtttacagccgttttttggggggccggttatccagccaattccctccacacgatagttaaacctttatcaataataaggaaattgatcattaaagctttaaatatgactacctcgtttgtttgaaaatacgtttaggagaggaagctgtatgatttgataacttgtattaaaataccaattacatttataggaccttttaaaactcggcgcaattaaaccgtgttcttttacatttttccgaagcgaccctgacatttagaaagactccaattgcctcgttaaaatcgcgaaattaacagcgtgcctacgcctggcgcgttgtgtatgtgtgtgtgcgtgtttttttccgtgactcccccacatcagtctttgggggtggtctgcgaaggtatttgatttgttgtgaggcgagagatatctcattaatgtaggtagttaaacagatttaatccgtattcattctctctcaccccctctccctctccccctctctctccccctctccccctctctctccctgggtgtttttttcttcccctcctttttttttttccgctctctcctcactccctggcgctctctcgctctagctctctctctcgctcgctctctctcgctctcaccctcgctctgcgttctgtccgggaggagtacgaagaagccaataggatgcggggtctctaatggatgcaaatgatcatgaaaagacagtgcaaaatatgaaacaactcatttgcagggaagtaaatcaccgaaaactgtttatgaactggcatcccttcttcgaaatgtaaagcgaggacctctttaagtggtggtatatttttgtttggggggtggggggtggggggagggcgagcgagccgcggctgccatgcaagcttagacttttggaggcttctctgtccttttctattcctggaaaccacaaaaagtgtgtcggcttcgagatcttcttcgccttttctttcttttctttttttccctcctctctttccctctcctttcctggcgagggtgactaggagccggcgaatccgcgtttttttctctctctccctccctttccccctccccaccccctccccaacagcccccaactatagcctccgccgccgccgccgcctcaaaattcaataaaatgagctcttatttcgtcaactcactgttctccaaatacaaaaccggggagtccctgcgccccaattattatgactgcggcttcgcccaggacctgggcggccgacccaccgtggtgtacggtcccagcagcggcggcagcttccagcacccgtcgcaaatccaggagttctaccacgggccgtcgtcgctgtccacggctccctaccagcagaacccgtgcgccgtggcgtgccacggggaccccggcaatttctacggctacgacccgctgcaacgccagagcctattcggtgcgcaggatccagacctggtgcagtacgcagactgcaagcttgccgccgccagcggcctgggcgaggaggccgagggctccgagcagagcccgtcgcccacacagctcttcccctggatgcgcccgcaaggtgagctcgcctcggggccgacaagggcaggagggggccggaagggcccaaggcctggcaggccggggcgcatttcctccagcttctggaagacttgccggctccgttccgatcgcctgccgcttttcccctttctttcttatctttctttcttctttcttttttctttcccttgaagggggtcgcttagaaacatttcctgaatctataaacccctcatcctgccttacttttcttcttcttctcctcctttttttccccttttactgttttatggggggtagtgaagagagggtggtgggagtgggggcgctcaacttttgcacttctcaattgctttatagtttaattaccctgaagaaacttttcttctggggcagaggctctgggggcttttcaaggtgggtccattcgtccccacccggcttttttattcttattttcccccctccttcacatccttcctcctaaagtttatggcacttctaatagatctgaaccacctcctacacaactctggtgctggttaccgggggagggggctcccctttctggctcccttagattcacttgtgtctaatccccctcgcccctcctcctccgccgaccgcggccttcttgcgccccccccgcccccgcacggggtagaaggtcccctgcccttattataatggtctcccaggctcgttcacgaatcttccaaccttctccgtccctgccccctcccccaccctcccctcccctctgtctcgccctttcccccattcccagcagccgccggacgcaggcgaggccgacagacctacagccgctaccagaccctggagctggagaaggagttcctatttaatccctatctgactcgtaagcggcgaatcgaggtatcgcacgccctgggactgacagagagacaggtcaaaatctggttccagaaccggaggatgaagtggaaaaaagagaacaacaaagacaagttccccagcagcaaatgcgagcaggaggagctggagaaacagaagctggagcgggccccagaggcggcggacgagggcgacgcgcagaagggcgacaagaagtaggcttcagctgggactgccagggccgcggccgcccgcacgtccgcgggtcccggccgcgccgccgccgcgcgcccctgcccgagagagctctggccccgctagcggggccaggagccgggcctcccaccgcagcgtcccccgccgcgccagtccccgctagtggtagtatctcgtaatagcttctgtgtgtgagctaccgtggatctccttcccttctcttgggggccggggggaaagaaaaggatttaagcaaaggctccctcgccctgtgagggcgagcggcaaaggcccggctgagccccccatgcccctcccctccccgtgtaaaaagcctccttgtgcaattgtcttttttttcctttgaacgtgcttctttgtaatgaccaaggtaccgatttctgctaagttctcccaacaacatgaaactgcctattcacgccgtaattctttctgtctcccttctctctctctctctcgctcgctcgctctcgctctcgctctctctcgctgcgtcctcatttcccctcccaatcctctctcccctctgcaaccccccagctcgctggctttctctctggcttctctcttttcctcctccacccaccccctttggtttgacaattttgtcttaagtgtttctcaaaagaggttactttagttagcatgcgcgctgtgggcaattgttacaagtgttcttaggtttactgtgaagagaatgtattctgtatccgtgaattgctttatgggggggagggagggctaattatatattttgttgttcctctatactttgttctgttgtctgcgcctgaaaagggcggaagagttacaataaagtttacaagcgagaacccgagactggcccggccagcgctcctcatttgctcccgggtgccttgcagagccggtggggagcctgtcaccgggctcctgcgcctgctgaggctaggctgcagagaggagggggcgggggctggaggcaggtggtgcgagtccctcggcccaggggcgctgggggtgagggaggcggctgagcctgattggaggagagaaaaacgagggaggggagccaagagaaaccccctcctctcgcgttccgaggctgcccggccagggaggccagggcgcccaggccacgctggagacctgcggctgggctggtggctgtgtcccccgccacctccctctttgttttgctgtgtgtcctcccaagatgtgtgtcgggaggtggggtggggggcaggcataaaggtggagtgcaggcctgctgagcatactttttttccctcggactgttgttgttgggggagcaggaggagaagggagaccgctcttccctgcctctccctctcagggacttggccaccttcgctctgttctgaggccatggctctctgccttccttccttcgctgcctctgcttctctggtagtcacgctccactgaggcatccgcctccgggaaccgggagagcagcgcgcccgggccaacctccacccttcctttctctccccaccctcccaaccccctttttcttttactttcaaacctttttttttctttttctttctttctttctttttttttttgccaccagaaacggcagcgtccaaggcccgtgggctggatcctgtgccctaggagcacctaggaagacttgctccatctccgcccgcatatctggggcaccaagagagacagagtcgtgagccaggctcgcctcattcctcgtcttgggagaaccggaccaacttccccaaaaggccttgccgtgcagaattggcctggtttaataaagaacagacctgccccaagcacccacccacccagttgcgtgcattcaatccctgcgtttgtctctcgctcggtaacgggctgaagaggatgggtggagggtgacacggatcgccccgaggttatttattttcccttccactcaatctcttcctccccaaatctcgcctgcaagcggcctccagcccgcgggagtcggcagcggcccttgagcccccagccccaatccacagggctcggctttcccattcattattgatcatattttataaatccaacgccacacaattttttccacattaccgggagccgtggggagacggcccggccattggcggaggggacgtcacgtgggcggggtcacgtggtccggagaggaaaaagggggtcctttttggtgtaaatctggactctaattctgtaatatatcaaggaatctcgtaaaaccgacactaaaacgtccctgcctacaaatcatccggccaaattatgagttcattgtattatgcgaatactttattttctaaatatccagcctcaagttcggttttcgctaccggagccttcccagaacaaacttcttgtgcgtttgcttccaacccccagcgcccgggctatggagcgggttcgggcgcttccttcgccgcctcgatgcagggcttgtaccccggcggggggggcatggcgggccagagcgcggccggcgtctacgcggccggctatgggctcgagccgagttccttcaacatgcactgcgcgccctttgagcagaacctctccggggtgtgtcccggcgactccgccaaggcggcgggcgccaaggagcagagggactcggacttggcggccgagagtaacttccggatctacccctggatgcgaagctcaggtaacgccgcgcaccgagctgtcctgagccccaggggccggggcacattaccctgaaggcgcctccttcccggctgggcgcccctttccgcgtccagagtgctcccagccggaggtcggccctggaaggctgcacccactgggccgcgacccagcaggccatccccgcccccatatttgctcggtgctctcaggctcgctctgcttcccggcggatctctcttcgccggcaccacggcgctgcgagcccccagcccgcccccacccttcctctcggccttttagctttaaatatttatcagcagcgccggcacgggctggagacgaggccgtttgtcttgcggaggaaggccggtgtttgcagagaatagccattagggtctcccccttctccccccttcccagctaaggatctcagccctgggtgtgtccccctgccccactcggataaggtatgggggagggggccatagcgctaagcaattctcccctcccccttcctctccagccaaccccgctcccccattattcccatcaggacaattagaggtgggctctagaggcctggcgggaggagaaaaggacccagccagggacacagagctagagaggcaggtggagggagggggctgaggccaaaggagatgatcctcctgatcccagtgaacctgggtgggggagtggaacaggagaactagaaaggggcagaggcttcatgggagtgcagctggcttcctgaggtgctcttcctagggctcctaggaacccctaaagaactggccaagtttggaggtgtcattccagataagtgacccttttcttgggggaggggctaggactctctggagccaattcaaaaattagagagtgcagttcacctagccagctgctgcagaaccccaagaggctgaggttccatggggtccctgccgagtctgacccagacatccttttctgcactgttccaaagcagacgaacttaggggctagccccaaagtccagaagacccaagactcatggtcagaggcacccaacccagcaatggtcaggggccagaagcagcccagctctcataccatcagtattagtggttataggtcccattacctgctccatagtttaactgcctttccagttgatttatcaaagccccattttttctgctcatcagcatttcagcttggcttttatctgacttgaaactagggcccctagcccctcctcccttgtctccttcccaggagggctgacatcagcacctctttaaagtctcctcaggttctggtcctaatgcagaagttcccctctacccttcagtccccaccacccagatactccatgttccatcctatcccaggctgctgtctctccttttcccctgtgcattcctggaggcccaaggattgctttagagagctgggctgtctaggcaagcaggcaagcaggacagcctggccctggctgaagcttagccactcactggaaaagaatcatcagagggtcactgctgtcagaccaactctttgctccaaggaaatctgcaaattcttaccttctcattccacaacatgctggggatgagttggggggactgggcctttgaggcccctttgtctccttttcttcttgggaaacgttcttaagctaggcctggcgccccactccagggtcacttgcatggtttctcttggtctctactggaaagaccatcagatcagcattcagaaaagggggtttagggtccttgaccccagagagtgaaaggaggattaacctcccctcatcccacttgcaccccttaggtgcagagcctttaagagccagcagattactttcctgggttcagaagctccaggctaaaaaagacttcttggatgaaaaatgggaatgtttgctttgagaagcctgtagaaagttcagcaattaggggagtttgcagctggagtaagggctggggtatgaaaagccagaatttggtttagtgggaaaatgggcttctttgcccatcgcccattgacttcaaatcacatacacggtataagagggaggtggccactctcttggcgtttccttttttttttttttttttttttttgagacggagtctcactttgtcgcccagactggagtgcagtggcgcaatctcggctcactgcaagctctgcctcccgggttcacgccattcttctgcctcagcctcctgagtagttgggactacaggcgcccgccaccacgcccagctaatttttttgtatttttagtagagacggggtttcactgtgttagccaggttggtctcgatctcctgacctcgtgatccgcccgcctcggtctcccaaagtgctgggattacaggtttgagcccaccgcgcccggccggcgttttctttactcactgattttcctctgaatactgtgtgcaggaactgaccgcaaacgaggccgccagacctacacccgctaccagaccctggagctggagaaagaatttcactacaatcgctacctgacgcggcggcggcgcatcgagatcgcgcacacgctctgcctcacggaaagacagatcaagatttggtttcagaaccggcgcatgaagtggaaaaaggagaacaagaccgcgggcccggggaccaccggccaagacagggctgaagcagaggaggaagaggaagagtgagggatggagaaagggcagaggaagagacatgagaaagggagaggaagagaagcccagctctgggaactgaatcaggaaactcaaatcgaatagggaagtaaaaaaacaaaacaaaaaacaaaaaaaacaaaaaaaaaaccctatttaaatgaaaggagtttaaaaacattttttaaggagggagaaaggagaaattttggtttttcaacactgaaaaaatactacctataggaaagtctgtcaggtttggtttttttgtacaatatgaaaaggatattatctacctgttctgtagctttctggaatttacctccccttttctatgttgctattgtaaggtctttgtaaaatcttgcagttttgtaagccctctttaatgctgtctttgtggactgtgggtctggactaaccctgtggttgcctgccctcctgagcctccgccttcccagcagcggcaccaaggggccttagggagccccaaaacctaccactcgcgtgttccccaagcgcctggctgctgcttcttgcttcccgtcccccagccccatgctcccttttacattctgtgtgtatctaaaggatggaaaaataaaacgcaattaaaaataaacagatgccctattttctgtgtcttcctaaagctgggaaggggttcagggttagagatgagtgggcatcccagagctccttggctctgacttctgatgcagcttcatttctgtgctgagtttgttctttttcttggtgcctcctgctctggggggctgccaagtagtgaaccccgatattgcactcatgcattccctttacacccttttacacccattgacatacatgatgcacacagtcacatgtgtttacaggctgacatcaaacatacacactgtcacagtcacaaagagacactcatacccatatgttaacaaacatacaggcattcacgtaataccagcttcacgcccagaacataggcattcatgttcacacacgctcacaagtaaacacacattcacactcacagacacattgataccaacgtacattcacacattggcttataaacacagattcacatttgcccccaagtaaacgcactcagaagcccacatgcttagtcacacaagctcacaaaacaacaaaacaaaaacctcacagtttcacaaacccgcgtcctcattcaggcctggaaaccaagctgcgggatctggatctgggctgcagcccaggcacaaagacggagctgaaatccaagctgctaggccccacatgaaggaagagcggaaggaaagggaaaatgaacacccaaattcactctggcttcttgggtggcgttgcgtagaggccaggcctgggagtagaggcctcttagtcggcgcagagcagcctccaactagggcgctcacggcttcctgctcgcacggcaaacattttcgccaagagctattcctatattttatttcgatttattttactttctttgtcttaatttatctcgttctaaattgatacagacgacccaaataaaactttaaaatagggggtggggaagggaatgagtccgggagcaagatcctaagaggtgcgagtttaccaggccggtgtggccgcatcccggccgctctcggagcctgaccacgccacgcccggggcttcctccgagcctctcttcccgctctctgcgccgccgccggcagcctggaaccttctccgctgcacagagagagaggggggaaaatgttgggggaggttatttcgtttccagaattcgggcattggtaggtcaacttgaaatacggggttatttcaggggacctgaaaaacctgggctgaatttttattttattttttgcttccaaacatccgctgattgcaggaccaaaacttggaggatggtgtctatgcggctagacccgctgaattgatttttagcatttattcgattataaactctggattgtttaaatttaaacagactttggatagaaagagggaagagggttggttttaggataatctgttgaatttgaatttgtatgtaaaatgcttttaaacctgcagtttcccccattaatgaccacgtaacgccctggagagcgcatggagctgtcataggaaacctggacttgcctgcatttgggcgggagaagccaggatccggctttaccctcccccagtttctgggttccggaggcgagaatcaggttgtcagactatctgccttggcccccatccaggccacttttcctcctggggcaaaaactaagccctagggaatctaaggcccccacgcctgcaatgctgcaagcctcacaggtgggggtcctgctgtctacagggctaggaatgagggggccagttcagagggggagaggggacactgaagctttcattttgcccttatgcaggtggcaactctagacaccgtttcctgctcctgcctcaccccaaaattgtctcagaacagtccctatgcagaggatttggggtagacctttactagaagagggagcagagctcctgtggagagtggggaggttcggaaaagaacccccttcccagctgtaccgttatggcttttgcactctgatttcctgcccccccaaatctcaccccttctcagattggggtttccccaaaaagagagaaggagaagaaaagaagatggcgactgagaaaagggttgctggtggagcagccatgaagaaatgcaataaattccttgttgttttatgaaaatttacaactttgtgatagaagtttatgagtggttgaatccagcgattggccggcgccggtcatgtggccgggcgatcgtgaacatgaactttttatcatttccctggtggttataatgcagcattcttttggacaccacacctaggtcggagcactgtcgtccttcagggctccagcctcttgatatttttgtacttcagtatcagctcgatagagcaaaagagagagaggacgagagaggggggtgaggagaaaagagagagagcgcgagagggagagggagagaaggaggggtgggaattacacaaagagagaaccaaaaataattttgattcctaagttaatttgctcactgatctgggattttagtcaccatggagggtaaatggacaatctgcccaggactgcagcccgatactatttttcaaagccagaacttactccattttctatgcaaatgtcagaaaaatgaaacaccctctctcccaagtcagagaaggggaagcaacggctctcacgttgggacaatattatctggaagctgaagaagaaactgaatactccttccttcctccccacccattcctttaaatccggagggggaaaaaatcccaaggtctgcaaaggtaagggagattctacaattttcttcttgttcttttgcatcgcttttgtagggtgggggtggggcttgggtttttctccctcctcccccgttccaagacggggctgaaccccacctctgggcgctgcagggagaagcttcccaggaaattcagtggtggagatatgggtggctgcttcctggagggggagccaaggcagggaaagcgggaagaggaatcaaaagagggccaggagaccagctctaagtcgcctttttaagcttggaggagagactcaagcaaggggggtgcgaaagagaggatggggggtatctgggcttcagtggcacccaaagaagccagtggttctggcctccgcgggcttgcccctccccctcctgccatccctcccttgtctcggcctctggctattgccccagcgcagttctcttgcctggtgcggatatcgctgggttcccggcagcactggcatgtgaggcggtggcgctaagggacgtcctggtttctatagggcctggaatctccgccgaggccggcgagggagaggaaacggctagagaaacacagaaaagacaatttacagagaaatgtttactatctcccttcggagacatttttgaaattaaagggctgtgggtggaaacaccaaaaatgagggagactcccccctcaccaggaagcctgcccgagaatgcccaagtatctcgccactcccgcaggagggagcctcgctctacagggagacagttttgtggttttaatgcggtaggttacagctgttggtttctgcgtgatactgattctattacttgcgttgtattggtatgggatgtgtggatttcggtggaggaaaaaattgccatgtgtgtgtctgatatgataacatttcaaactttcctgggtccagacatggtgattgtgaagaagctgttaagtgcctttttgttttaggcttgtaaataaaaataaaagagaaagaaatgaaagaagaaaataaaaagaaaatccaattatgggacctagcggcgtctaaactgaaaagctaactggcactgagctcagacagtcccgtccctcgggtgtccaattttatccctcagtcaggccttctagggggtggggagggcggagaacattgggcaggtgacagagattcctaaagtagctcgtggggtggaagtaggtgccagccttgaggcaaggacttaaaaatggggtaagggagcttctggggaagcttccagccaagagataagtgatgttggctgtggagggcaggagaaattgtgatttttagtctggtttgcacgaacatgtgattgcttttctctttcttaagaccagatgcaggacattcagcctcgggcctctggttgccccggagttacagggtctggggcgttttggaagtggggatatatttattatctcagtcctaagctaggagagggacgacgctgccacttgtggcgcggaagaggcggctctgtggccccaggtagatgccctaggttcaggcccggcctgggcgcctggagggaccgctgggcttcgtagctagagttctccgccagcacccacggcactcggggactattctcaagggaaaaatttcccaaacccacccatactaaaggtctttttctcctgtagtcttggagggttataaatcctcccttagacagttcgctgtgacccaaattatgcggtctgctgccatctaccgtccgttcggagacacgcggcttcggcgccgcaagccccgcgacactgtccagaggtgcccgacgcctggagccccggcctcgcagggtccacgggattcgggggatttcgggcccacaccgacgctctcagctagatcttggttccccggtgtgagttagagaacagaagtctctcctccacccatcatccccaatttcccactgcccccgtccccgcccatcctagccccaaacctggcggctggcaagggaagcggcttcctctagggcatatataaaaaggtctaattctgcttccagcgggcaggggccctgaatcaaagggtggagggatcagagccgacacccccaccgccatccccacccccaccccaccaaggcgcgggagaggatgaggccgcttgagacatccgaagccaaggctgttcaaggtttatttggttttcttctcagccaagggaggggacccgcagggcaggcgccggccccgtcagttccactcggttgtcaaaagacaaaccgggtctgtgttctcctggttggttagtgggttttgccagctccttggttggtgggtccgtggtgaaggaattgaaccgaattttctggaaactgttgatgtctgcaagtgagtgccgatcccctcctccattctcgatcttttcaagcgaagtctacctaaatatgatttgggaaaaatttggtagtgggactggggccaaatccttaaggaaccacaccgtcgtaatttccgttcctgttggaccctccacaccggcttaactcgacctccttcccaagagggggtggccagggctaggctatgcgcctctgctgcagcgtttgaatattggcccctgtctcacgggttactgattagcttgggctttcaagccgtaggaggaagctctggcagttcctttaaaggtgctgtggtccccgttcctgggtgggggtggggttccaggaaattgcctgcggtgccaggcaaaccaaggtgttgccagagtctggccgagggctagaggagctgacgaggttaaggggcctggtggtgctggggacaaacactgtggctgcagccctcaccctctttcggcgcctctggagcagctctttatagctttcctgcggcgaggtgactttctggtggctataaggcccgactcaaggagctgctctataggaggccctgagggagccagccctagaaggtccttggcccctctgagattttgcttttgggcaatccaaaggacatgtagagaagtcaagctggtacatggtattgaaacacttcagggccctcaggttgtcccctggacctgcgggtaggaaaccgggagagtgggttcagcactactgctcactcccctaaagatcaaagaggatgccgctcctttgcataatgaaaatgaagtctttgtactttgatttggaggggccgattttagggcaaagtgtctcatctaaacagcctccctcaacctatgggagtgatcactcagtacccctgggaacatttatttatgttccccaaacccagagaaacagagtccaggacgagaattgagttgaaatattttcatcccaccccaccccagccaaagttgggggtggtgggagaaggtgctcatcacctcaaagagctgagggagagggctttatagcttagaggaaattggaagcctggacaatgtctcagcaccctcccacacacaccacaccacaccacacacacacacacacacacacacacacgcaaatatccctcctgaggttacctatcaagaattttactcccgaactgaacacaacttaggaaacattttcctgggagctggaatgtgttagcttgcccacaggactgcagactcacagcatagaaaattacaattataaatcctgcctgtggggtatctgtacaatccctctgttatgtactcaagaattggtacacacttctatccatctctctgaacacacacttcctcattgaggcagggagagacaccccagactggcggatggctgagcccgctgtgtatttacatattcccccaaggagacagacagagggcggtggaccgaaccacagacagattcgtagggatctggctccagaaaggagtcggtctctggcctgccctgcccgcctgctctttttcccaaacaaacggatcagacgaataaacgctcataaatacctctgggcttagataagagcgatgaggcgctattttctttcatgcccgactccaggcgcccaggcccgcctgtagtggctccatctccagacaagcaacctgcagaggtgaggttaatttgggggctgtgactctaaagataaggcaattatttccctgcttctgacacagggaaatgctcccttcctcaccagatcttattttgttcagacttcactgagaaaaccacactatttagtgctaggatggagacattgtgggcagggaggaggcagggaaggctgaggcccagggctcagcctcagcagtaggcagggaggtgcatgcaggtactctctcccacttttctccccctgttcaaatggcccctagtcctctctagaagcaagcccagccatacctagatatggaatatttatccttcttcattatcagggggtttaaatttgttttcttaaatgcttatcaaacactcccacagagtcaggttaggaagtaattggaggccatctagggatggctattttgccattaaggtacagccaagaagttgccctgagtttagagagccttggagaccacgttgcaaccaaataagttcccacccttggtgatccaagctcagtcccctgccaccttccctagtgtcttgtaccatcttcagtgggcagaacttggccagaaaaaggagcccaaaggaaggacaaggcagaggagggtcagcctggcctgacatctgactttgttccatgccctggccccttcttgtccccaggtgtgaaggttgtcacccttcactacttggcctgtgtatgtatattagaatgttgggaatgcactgtggccctgtctcccagcctgggctcaatgcttattttccttggatgaaagagccagagacatacattctctgacacacctaaatttgtaaggcggcaaagctgatgatacaaacacggggtgtgggagggaattgtagcgatgctgagatacagacagaagggagaggggatgctggctgatggctggaagcagcctgctgagtccccaagagaacgcaaacgaccttctctccctatcaaactaaagcaaaaaccaagtcttgggaaagaattaattttaaaaagaactggcagctcctacagagacttagaagaggagtgaggatgcatttcttcccagtggtctctgactgcctcaactatcaggagggttcaaagcccacaactggaagaagaatgatttcttccttgtgcccagatttactgggacatccctgattcctgaaaatcctatagcccaggctattcttaagtcttttgggattgtagagggtactggagtgagggttgcaggcaggatagggatcagacaaataaagccacctaggctgagggatacccctcactccttcactccatatcaccaagtgaggagagggctagtccctttccccagtgccccttcccctgccaagggtgagcagctgcatactagaaccaggcagaatgttttgggcagccaccctcgtcgccgccttccaagaagctcctagtctagccacagagtcagaaggggaagcttgggctcagtccctcctgccagctcctcctcttctgggtcttctaggcagtgggatctggcctgccccctcagaccagaagggttgtggagaagcaggaacaataagccgaggcttggaggagacagagcagatctgataaacaggaaaaacgatgttcaaaacctggggaggagggtgtttcttctttgcttatcttagcggagaactcttctcaccttctaccgacacaaaaccctagaaacaaaccttctttagttctctctcaaggcgattcggagacatttacccaaccctccccggagagaaggggtcgaagcaacgcaggggttaacttttctgaaaacacaattaactttttccaatcctgcgtggggtgggggagagacatatttatttaatcacccgggagtggggtggtctcaatctaaacgttccctcctccctcaaaggcactgagcctgtttcacagatcctacgtaggtggaacaggacgcgttgtgttgttggggggagagaggagaaaggcgaaggagaaggaggaaaaaaaaaaaggttgataggtttgtgcgcgggtccctcgtgcgggctgcgctcctcctgggtgctatttgacaattcctgcctctgccattggtcagtgttggatcagatggttgtatttccttctggccctcactggcacctcgccatcccccctcagctaaaacccaatctcggatatactactaataggcgcggcgctcggactataaaacacaacaaatcataaacccggcggagcagcagcggccgcgcgcgcctcccctcccaatgagttcctatttcgtgaactccaccttccccgtcactctggccagcgggcaggagtccttcctgggccagctaccgctctattcgtcgggctatgcggacccgctgagacattaccccgcgccctacgggccagggccgggccaggacaagggctttgccacttcctcctattacccgccggcgggcggtggctacggccgagcggcgccctgcgactacgggccggcgccggccttctaccgcgagaaagagtcggcctgcgcactctccggcgccgacgagcagcccccgttccaccccgagccgcggaagtcggactgcgcgcaggacaagagcgtgttcggcgagacagaagagcagaagtgctccactccggtctacccgtggatgcagcggatgaattcgtgcaacagtgagtgagacttcccgtcgccgtcgccccggctcccctgggcgcccaccccgggacacagaactagtgagcgccccctgccccaatctcccacagggtgctgggtgggcatctcagttaggagatagaagaagattgggcgccggccgggggtctctcgctgtgtcccctattaggcaggagttacaaagtttgcaaagtcccagccgcactgggagccatggggagcaagtgtgctctcctggggcgcctggccagagccggggttccaggacagggaagggagcaggagcctgcagtcactggcttggctttactttgagcccccaacccccctctcccagccctggtagggttccccaaccaaagacggctccattaaaaacggagtgcgtcatgcaagggggtagggggtgacgctgaagagaaagagttgagtctgtctgggactgtgtttccctgtgggtggggagctggggcaagatgaggcaccaggaaaggggtggtagtcagaggagggaggaggaataaggggaaggaagagagagggagcaggcggagcgagagagggagaaacaggcgcggggtctcaggttggattatttgttggccttaagtcccaactgatgtccattagccggactcgaaagtgaggagccgttaatgtggactatggatcgatctacgtcattacggattaacggcctggatttatcattgggttggggggatgacggggggtgggaacaagatggatggaaagggagggaaagacaagatgcaactaggaagagacacacctgaccagcccctccccccaggctcaggtgggagttcaaactgctcctcccctcccccatctagagtctagacagacggcacaggcctaggagactaggagggaatctggagggggcgctggaggagtgcgaaacgggggaagggagccggcagaatagagggcatcccggtactggctggagtctgtgttcgagggtcgactaggggagggggtcctgggcccggtgaccgcaggcctcagcatctccactctgcgtaacaggttcctcctttgggcccagcggccggcgaggccgccagacatacacacgttaccagacgctggagctggagaaggagtttcactacaatcgctacctgacgcggcggcggcgcatcgagatcgcgcacgccctgtgcctgacggagaggcagatcaagatatggttccagaaccgacgcatgaagtggaaaaaggagagcaaactgctcagcgcgtctcagctcagtgccgaggaggaggaagaaaaacaggccgagtgaaggtgctggaaagggagggaggacgcgaggggaaaggcctgtggggagccgagggcgtcagagagacccgggaaggaaggctctcgggtgggggagccaggagacctgctctccggcgcagacaggcggggcccagcgctctcctggacgcccccgcccgcacagctcccggcgggtgctctgaggcctcactactcgagcccacccagcatcccgcgcgcccttccttcccgaggaactcgcctcagcctgatcaggcttcctggtgagaactgaggagcggactcacttgatgtttcctggaagcagagcaaaatgctcttgtccctgtcgcgtctcattttgtccatgtcccccgtgcacggttcaatggtagattcgctgtcccctcagcgggggccttgaagactccctgatcccagacctgtcgtctctcccaccccctccccaaagccactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgataataataataataataacaacaacaacaacaataataaagatgtgaaaactcgacgctcggtcacctccaatcctcccctgccattttttcctctctcctcaacccccagcctctccatctttcctgagccagaattcttcagcaaaggcgagagccctggcccgccgaagcgagccctgttcgactgggaagttacagctgagataaaggctggagcgatcagtcctgcccaggccccagcgctgcgtttccctggtgctgaggctcacagccgcttctccccgtgcagacttgggggatggagaggtgctgtgtccctctcattctctagcctttcctcgtgtatacacagcactaagggagccactgaggcccctaaagctctctggcggagacggagccatagtctgggggcctctgcagcgcttttctgtcctcaccttcgcagcgacccctggtctttggcccgtccacatggccaggttttttcgccagccttggccctccgctcctggcctgtggctctggagactgaaaaatggggccactgggtatctctcaccctgcagctgaaggctccaggtgccccttcccacctcaagtagcagatcagcctcaagtaggagatcagcctcaagtaggggaatgtaaagccaccagccaggcacaggccgaaggccacaactttcccttgctccttggagaccccagggcaggaggccaggtgatggggcttttagtgtcatcctctcaacccagaatggctcattctctctctgcttgcaccggcacccagaaggcaagctgcggtcactgttttcctttattcctccgccctctcgcttcctttcttatttttaaagaaaatagtcccctcctaataggagaccagctgcggcggtctctggccgcccagcgtgctcagcaaagcatgcgggtccttggaaccccttttccgggaaggcggctgccaccaggcaaattctcaaactgcctagctgcgagtgagggacctgtagtggggcctccgaatgcaatagccgaggaggaggggaagggatcccgctttacaaactctcagacacatgttactactcaaactaagcagcagacgcggtggccgctgcagtcttttcggcaactaggccgcttagccccagctgtgctcggtttctggggtccctgtcctgctctgtcactccccacgcctgggctaaggaccaccaaggaggtccggaaggggatttcgaacttccaagtggcccaggagaagtgaacgcttctccttctttttcaagcctcccgcccagccctgccggctcggcctgggcgctgtggaccggtaacagcagttccaccaggatgcaggccggactaagctcctggggaaaacccgttgcaataattgtttttcacacacaacttccaacccttcccccatttccgcctccaattcggagacttgcaaagcccaagaaagggaaaagcaactctatctttgatcttctcatccaaagttaaaataataacgacaatgatgatgtagggagaaagaaccaaatagagaggctaaccccacccacaagaaagtgggtaaaaagcccaacccctgctctaaaaggctcaaccctgtggctgagccttggccgggtttctttctctcccggcgactgcagggagcctgcagggagccagcagggaggcagccgcccgccgccatggcggtctcacgcccgcgctcccgtcggtcgccgggaggtggcgcgctctgctcagaggccaaagccaaccttctctctgtttctcccccttctccttttttccccctctctcggaggctcgcattgaatcggccctaacgattctcggatcgtcattatttgtaaccatagagcatgaattacctcttgaggtcatcagcgagaatttacgactggtcaacaaaagcacgtgattccctaacgccccccaccccccttccaaccccccccccatatttggccgcatacatagcaaaacgaagtacagtgcatcgctataattcattaatacatcataaatcgtgaagcacagggttataacgaccacgatccacaaatcaagccctccaaaatcacccaaatgagctcgtactttgtaaactccttctcggggcgttatccaaatggcccggactatcagttgctaaattatggcagtggcagctctctgagcggctcttacagggatcccgctgccatgcacaccggctcttacggctacaattacaatgggatggacctcagcgtcaaccgctcctcggcctcctccagccactttggggcggtgggcgagagctcgcgcgccttccccgcgcccgcccaggagccccgcttcaggcaagcggcttcgagctgctccctgtcctcgcccgagtccctgccctgcaccaacggcgacagccacggcgccaagccctctgcttcgtccccctccgaccaggcgacctcagccagctccagcgccaatttcaccgaaatagacgaggccagcgcgtcctcggagcctgaggaagcggcaagccagctaagcagccccagcctagctcgggcgcagccagagcccatggccacctccacagccgcgcccgaggggcagactccgcaaatattcccctggatgaggaagcttcacatcagccatggtaattctctctctcttttttgtcttctcggctttccttctctgcgttttggggtgggatcggggggacaaggagagcttggctttaccctaaatatagattcatttttctaagggggagaagtatctaagaggggcctcatagcttcgtagacagagccaaaaagggtctctctgttaagaggggggtatttttaataatttgtttccagcttcggcttaggtttttattagcgcagctgaaccagctttaggataaaggatggggttcatataatgtggggaagggtcctgcttacccctgaaattttgagactgtcgctagcaaagaaggggtgaacagtaaaaggagctttccggggcaaaagtgcaaccgctctcctccctcccggggcgagcggccgcctgagcccagccaagggtgaggcactaggagcgagcaagagacaaagccgggcgcactggctgcctgcagaagtgggggatgcagtagaaaggggtgcagaaatcgagcttgaatgtgggcatctggagtagagaggattggagctgtggtgagctgggtgccgggacgcctgggtcctgctcccccgccccctcccacccagtgccccctcccttaaccggaataatgttgccttgcggctttcctctatctgctccagatatgaccgggccggacgggaaaagggcccggaccgcgtatacccgctaccagaccctggagctggaaaaggagttccacttcaaccgctacctgacccggcgacggcgcatcgagatcgcccacgcactctgcctgtccgagcgccagatcaagatctggttccagaaccggcgcatgaagtggaagaaggacaacaaattgaaaagtatgagcctggctacagctggcagcgccttccagccctgagcccgcccagaggagcccagcggcccaagagcccgtgccacccccagccctggcccctccaatcctccccgctctgccgccgcccgctggggaccggttcccacaagcctgcctcgccttgtgttacgatatttcgtttggtcttaggtcttcctgtggctccctctctcctggactggttatcttgttattattgttaataataattattattattattttccttccatgctcccaactcccttctgcttgtcccaaatccgccagtgtttctgaatgtttgtgtctgtggttgcagtctttcccccaggaaaaaaaaaaaaagaaattcgcatgtttaatgtgaactctcccctccccatctgtgttctaacttatttataaaaagatgatcgctgtattttgagtttcagctggaaacttctgtaaggggcagcagttgaggtggggtagtgccgcagtggggtcaagctgagctggcttcggagatggagtcccttttcattctcctcctcctccctcctcactccctaggcccaagtctcctaggggcttggtcctagggtgggaaggggctagggaggaccaaagggatggtattgagaagagagaaagaagatagtgagatttaagttcctgctgcctgggtaggccccacaaggcctggtctgggagtatacggaaacaaaaatgatcctcagtgcaaaatgtcttgtgtatttctctgtgaatccatgggtctggctagagggcccaaagcttgtaaatatggggatagtctgggtcagacccatctctcccttacccatcttgcttccaagaccatttgtagtgagcgagtggatgctgtgctacgtgtgaaatctgtctttgcggggcctgtctcagtgattcgcttttggtatttgtttgtagctttcctggaagtcaaataaatgtttcccccactccattgcccttccacttgtcttttctccgaggggtctgcctctcccatcccgggcacaccctgcaccattctcaatagatctggggtgcagggaagaaaaagtaggctgctccccaacaactcttctcagccatgtaagtcactggcttggtcaacagtgcttgggccagggaacagaccttcatgcctgggggactccaaggcccagaaaccccatgtggggctggggcagaggaaaggctgagctagacttcatcctggtcttccactagctggccaaggaagcctctggaaaactcttctgggaaagtaatttgggcctaagtcctcagcaggaggctcctggccttttgggagtggtagaggcctgcccagccccctgtctcctactccaagtcccaattcagctctgccaccaactaaagcaaaaaaaaaaaaaaaaaaaattcagctggatttcaaaggatttctctcaccctcagccttccctacccttatcaagggctccttctctccaagggcccaactgatcttccctcttgattaggagttagggtcctttcagaaagacccctggttccctttcagcctggcccagggctagggcccagtctacctccatccaagtcagcctccaccctgagcacaagagtcaagtctggacacttacccggtcaatcccttccagcttggcccaacttcttactggacttggagggagggggagctggtgaggaggaagccgagggtcgtggaggctctacttggccctcctttcccttcaccccttgactttgtctccctttgtcgatagcaaactatcccaaaagtcgctatgacatttagatgtcaaatggataggggttttatctcgaagttagatcgtaaaaatcgccgagaagtcagacagatacccctcactggctcgagaaagtcacgtgaggtccataaagttagttttatggttttggggagttgacaccgcgcagtatatttcacattctccagaatgttaagtgacactttaactgctcgctgtggtggggaagggggcagaggtaggtgagcactctcccagcctggagcagccggaccagcccagaaggcagcggcggcccaggccagcattcccgcagtaagtcgctttcagctttcgcttttaccccttgcaattctggggcctgggactgggggaagaaaacttgtttccacctggggctgtggggtgatgtaggggaaatttagcctgttttatgcacccagttctaagggactgggtgcctgaaatgagtgctctcagtttcttaaggcctcatcggtcgggggtgcctgatttttaccaacaggagtgtctgactttgtggggaaaagggtttgtgtgggggatccatgctccctcagtgccagcggaaatttagggaccaggaaggaggggtgtatattgctgaaagaaggggccattggtgggggccacttcactgctggatatcttcagacaactatccccccatcctccggaaagaaactttatgacattcatttgtcggaggtgtgtgggggtgcaccgctgggcacttttatctggatacatctgagctgagaaaaagcaccgggtaggcggctgctgtgggctaccttgccctggggtgatctctggctttccgatctttgaagcccataaaaagaggtccctccggttatctttggcttcatcaggcttctctgggatggggagcacagcgctgcttttgcctccaccttcagcctgttggtctcaagctaatctttctccttggctcgaagtaggatcctgaagtcagactagggagcagacagagagggcaattcccccaattcaaaacctaattcctgaaccaggagtgggggaagggaagagcttcttctcttgcctagaggtgttaggtgtttaagtagaactctggcaagccctcctcaaataaaatcagctcaagaatacaaatccctcaactgtcgggaggaaatagattcaggagctggaagagaaaataggaaaggtgctcttttttcctctctttttccctcttcttttctgggcacaccctcaaagtcccctttgttttgtagaaccataaaccagagagacttcaggatttgatccccaggggttctgttattttctagggaaaagtcacccttctaaaagtcagaggcttcttccccaccaaattgacccccctccaatttaacacccgtggggctaactaccctgtcactcctactttcaccagcctgccatcccttgattcagctcaccaactgccataggtagtttctgggattggatatgtggcacctcgaggggcttctgatctttgggacaaggatggggtcataagactccctttttctcattaagggacattggagttctccccctgtcctctttctcctgaagccactttctattccctgagctctctatccactgcccaagcctgacttacaggaaatccttaacaggctttaagagcagagtcaccctggtttgaagacatatcatcccaagaatgatgagggcatttgtatcccttagaaaggagacacaggtcatctcccaaaggatccccagcaccactgaaaatataaagaagtgctggaggcacagcttccacagtcttccactctacaaggcaacggagttgacagacatgcagacaaagagctctgcaagggagagtctgacctgggtctccaggggaaccccattcctattgtgcccctggcctcactctaatatacttccctttctgaaagcccttctggaagctagaaccccagatagtaaggcctgctcctgaaaaattgtttctttgccccctctcatgtcagttctgtaggctctaacatctactaggcatatctggtcggattttccaggatggcaaagagcaaattggggtgcccacttccacctcagtgaacaaactcttgaagggtctcctccagctctaagcaggtcctggagaagatgccctaggctgggctttcctcttctccacttcaggctccctgagctgaaccccagtcctgtctgaaccccagtcaggacaagctgcgggaggcaatgagaggtgtgaagggatttctgatgccaagaactctctcctctgccccagacctctgtcctctcctcctgccctcccaggctgtctccctctaagagagctgctctactctctccagggctttgctctccctcctctcccacctgctttctctccctgccagtccaggcttcaacctcttgagctataagccaagccggtaccctctggccaaatcttcaacctggggcaggccccaggaggtgacagctggagattaaggctgcagtttctcttttccctctgaggccagcctggccaccactcggtggacaattcaattttgattttttttgttttgttttatttggttatttgttttgttttgtttctctgaggccaatgggtgggaggaagtataaagaagtgtaaacaggaaagccagctgggcctggagttccaagtgcccatatttcatcagcttcctctccataactgtggcagggacacttaacccttccctggctgtgagaagttattctctgagggctggtgagcagaatgggaagatctaagaggcagctcctttccttgcctggttcctttatccctgggaattgcaggccaaggattctgagcaatggagaagacagaagctcagcacaacccccccaaactcagtcccttcccagggctagtctccccagcatggacttctcagcttgggggaccaacctggtcaatctcggaagacagggctagcaagaatgagctcccctcttttaagggaggggatactggtaaccctccccatttttggagtttttcagagtaatcggattttgaggctgagatctgcccacagtgagacttattgattgctgcagcgctgttacacatccatattaattaacaccgcctggaaacggagctgtttggggaggggaagggaaaaacgggggccccttaagcagaatggatatttctccctaagggactctgaggttgagattggagggccctctgcacatgaatcctgtggccctccccaggcttgaagcccctggagttctcagcaagggcaaaaatgacttagtctctacagtcaactccacacacaagtctcatggtggtaatggttggcggggtgggggattaaatacccctcaggtcgttcctgcaggccccaccccactcttccttgtctctggtgggtttccccagccctctaatgctctgtctccagcagaggttagtgagcatcctttctagaggggttaacctcccccctcaccttcctttcgacttctcaaaggtagaggcttatgacggttttcgaatttggtttgttttattttgctttagcgtcccgttgttgttggtagtgatggtcttatggccttctcctttctcctatccctccctccaaaaagtgattaaaatctgttaaaggatttaattaagagagttaaatgaaaaggaaggaggcgcaaatgagttgggggaaaaaacccacaccaaagctattctcaacgattaaatcgccattttaacaatataatggagtttgcatcctgaaaggggaaatcaacgctcatatctcatcaataattcatagagtccgggatcatgcagaggtcagcagacgggggcagcagcgccggcctacgtggggctccgagccgctgcagcatacattacgcgccgccggccacaccgccgcagccacctccgcctctgtagaccgggggtgggggcacgccggcaggtttaggcggatctttcgttctttcttttggcgaatttactgattgcaggctccaagaggaagaggggaaatttgggagcctggagagtattggacttcgggcaattcgggaacctgtcggatcccaaaaagcaccttgtccccaagttttaacgtttctcttccctctcttcttattccttttctcagtgatttaggcgtctcctctcttgtctcttctccccctaaagttcctcttggagagaaaaatgcactctctgcagtatcctctagcttctcctccccggaaacagttcccagtctgcgaggccgccctctggactgcctctcccctagtggatccgggctgagccttgcggcttcggagcacagcggctggttttggtcgcaacgatccctggatccctgacctcggagcccggtggggtagggctgaatgcatctagggaggaaaggtacctcgcaggccccagaccattttgccttaccaaaagatgacccaggccagttggaaaggtggggagtcaggacggaaaggcacacctaggggagaagtggagggaaagtgccagcctgtgtggggcgtcgcctcttgagggatttggaggcatgatagaggataccctatttcggggctcctgcaggcttgtccttaggtgcatgcatctctctaattcgttttcttttctgttttctgaatcccaagggatcccaaggagggagaaaggaaatccttcccagggagaggtgggggtctgggaggcgatatttgggcggaagggaaaccgaaagcgcacgggttgtccgcaccgccgctgctctggaccagaggcagaggctgtaacatcccggagctgccagtagagtccgccttagaccaagttcacagccaggctggggcctctgaggcgtcagcgagcggccgcgcaaggtggccccgggcccccccgcatcgttgggacactgaactctccctctagccctgtgagcacagcggccccttctgctcccgaggagcccctgctccaagctctctccacccttcaccccagaaatgcccttctccaggtcagcccattctactgctcgccataggtctcctcatccggcaacctcggccccactcgggtgtcaaaaatgaagaagggtgggtggtcaaaagcccttccaggcatcccaatagaagagaccgctgaaaatgcgggaggtgggttccgcgtctttttccaaggagttatttaatagtcaaaagactcctcttgcccaggtctaaggctctggggtagtagggacattggcgaaggggggaggggtaaggaaagcgttttgccctggggtttctgcggccggcgcgtagcagaatgagaccctgggtggtgaggccagtgttattgccggaggggtcgcaaagttggagggtcaaaagtttacaccatgcgtgagtgggagcggcggaggcgactagcggcgggggcggggtggggcggtgggggagggggctgtatgtgtgtgaagacggacgagggagcctgggatgctggaggtaaggaagacttgtgggttgcagaagtgggggagcagaaatgggcagcgaagaggcagatatctggggaagggaaactgaggaaggaaaaatcccttctccaaaaagggcgagactggtggtggtggtggtgagttgtagaaaagacagcgcttaagggtgtggtgaaccctctgagcaattttctcttccaaagataatctttgagtcaccatattaaatttaattaaaaccttcctagccacacacattttagaaattcaattaaattacccccacgtctttgtaggacttctggcagggccaaagaatacttccaatgtgaaggtttgattttcaccaacatcaactcactctgcttgccctaaaggggtcaaactactggctctttcaatcctccacccctgggagaggcaggcctgttttcaagaacccttaacccccaggctgtgtcaggaaggtggggtccatgagcatgggccaacactggagcctttccaaactctcattcctctctccaaattgctccagtttaagaacttgcctactgaaagattagcttgttaattctctcactctctcccaagcctccatttgtgtgttcatcttgactccttctcttcctatttggatgagggaggagaaatgcaaaggaaaaataccaaatggcctcacggagatcttttttacgggagttgaaacagacaacctgaaatgaactttgaatccatacattaaacttagctcatgagcaaatgcctagagagactcagtaattataacactggggcatatgtctattttgggtctttaaatgactgttgtattatgagatgtcattatctgctcttccaagcatttactataggaggtacactgtgggcgtttttccttccaggatggagataacctgagagtttctgtaaagatgccttttgaaacatggccagaagagacaaaggtttaatatcaaatttcaaatagatttaacccagggttttgactaaaccaattgggtgaaggtccctatttctgcttagtccttaggtgagtttctctgcagtgtcaggccaggaaggaattcctggagtcctgaagagacagatgtcaaagcctgaactgaagaatccatctccttctgttccagcacagaacgttagcaaatttaggtatagactggagcagcccaaggtcctgggctagaaggaccaggatggggaagaagtggcctctgccattctggaccaagctgggtgccttggggagttctttcttgacctctccgtactaggaggataccaccctaccaactaggctggagccctgtttcagtctgtagacttgaattgggaggaaagggagtcacctgacccacctctgcaggaccctaggaagctggagaaagggagaagtgtgttgtaggcaatccaccagattctaatcctggagagacaaacccaagaaaatctcactattttaaatgccttcttgatctgctcctgaacctccttgtgtgggtgatgggggtaggcaaaagtgttactgtattgatgagaacgattcttcggggggagggggaagctattgttttgtatttaaaggacagttaaagctctgaaagttatgtcgccggctttgaccagcccagcccagcacctctctcagggttctatcttccccaaacctgctgggttgtgtggaccaaaatcttggccccaagaggtggagtggtcatttctaggccctggagcttccaaagcttttgtagaaatgaggatatctctgacacttgggggagcaaataaagcagatggagtgtgcaatggggtggggatccgggccctggccatacaggcatttaggggtaaggttcagggaaggggcctcttgctcaggcctgctctctggggcccaggtgcccaaagccatgctttcagttttccccgtgccagcctcattctcaggcctcaaaaggatcccacatgaaaccccacactctctctggaacccgagctgacaaaatatgggaatgatggaaaatcaaaacaggggcgtggccgactgactcctatccgaatgggacttttttcgggtgggggttggatgaagagaagagaaggctctggcgaaaagtcgagctggagaggatgagctgaatcaaatttctgctctgtcatttttttcccaagtaatgacctacgcaaaattcaatatgacccagcgaactgcgcgagcatattatagtaactgcctgctcgtgggggaggctgggagagaggtgaaccgcaggtcacggcgtctaaaaattattaaaatgtttgagagcctcgtgacgcgcctagctgtttaacaaagactgccaaagtatgagattaacacgaaaacttgcgcttccaaaacaaaaacacaccaaaaaaaaaagtcacgttccggcttctgagggagcccgtggctgtgtccgccgccgcggtccggttttccggacacacaatagtggacaggagagagctcagctgttgcccggcgcgtccgcgggcggctcggcggccggcggggctggggagcctcccggtgagtaccctcgcccgcgccccctctgggcctttctctcctccgcgccgccgccgccggtgcgcaggccggctggggactcgcctccgctcgggccttcggtttcgctccctcgctgagtcccttctccccgccaacaaaaggtgatgattcctagcggactgggcacgcctggacggcggagggtggctgggaggggcgaggtcacgctagcaacctgtggctgccaggagaaggcggctgggaagccacggaaagacccgggagcgcaggggaggtggctcagctcgcgcgcagcccctgctcttattttactattatgcgtgttgctgttcgtatccttctgggcggtgaaggggagaggcagcctcccgctccggtgaaacccgtcctgggagtcgcccataaaccctgttctccatctcaggcggctggaggggtgaggggggtgcggcgccttggtgggattggcaggtggtgacttccagggcgcagaggagaaaaatctctgctcttgggcgccaggatcaaggatacccaaacccgcggtggctctgccgcctgttcctctctcttggggtgctggggcacctgggccgcatcccttgtgaagtgtagagcagcagagaggcccggccgccggcccagcggccctcccaaacttccgaaatgccgacgggttggacgggtttccgagagctggcgagttgagaaggacaggaggtatggggtgggggaggggcctggaccgttggagtgggtcctggagaccctaagtggcctatgacaagatttggaaaggtccctggttgacgctagggagctggtggggatcctagcagcgcattttgtctgtgggccctgggccagactctagtctccctgagtgcccagatgggggtctgagattacctattggaccctctcttggcaaagacaaccatagtgtgatagtttgcttttttctcccaaatatgtgtgagttcagcctgtctgggagaatgttgatgttagaaatcaggcccagaggccaacattggcaattcctagatttaagattaaaagaaaatcagagggtctctggacctagttgtgggcaggtgggaactctcctcctacccacctgcaaggtcccaggactgggcataggcagagatctctggagtgttgcagttagagggttgtttttgtgttgttcctgtatttgttaatgaaattgatattattttgacttcctcactaaagatgcaagtatttctcagacctagggagttgagtagggagtctgggtggggtggaggctttttctatgcacattttcccttactctgtcacagctttcacagtctcagttccctccagcccaatccccagactctcagcttagtaaattcacggcttctgggagcttcagaaagttggttcgtaaaccccagatgcccattttggccctaccaccagcaacccaagcaggtggctaggcgagttcatatgtgtttagaaggaaaggacccgtctggggctaggaaggtggggaaatggggttcctccccacacctccccgggatagaccctctctcctggctcccaggatgtgtgagaggctgggaggggccctatatcatctggctgcatcttttatggttcctcattgcccttcattcggaaatgaaacgcctttgatcttttctcaggttgtaaacggaattgcccgtcattaaatatccggggccccatctgcttggtctcccagcatttttctttacagctgtttctctctctttttaccactgaatttttccaaaaggacttttattacaccaccttcacacccagccgcctcttcctcctcccttcgctgagaggcgctttggaaaatatctagatattcgtttgatcacaaactaaaggcttggaggggcacggaggagccgattggggttttgttttttctaaaaaaaaaaaaaaaaaaaaagtcctggggggaggggaggggcgcgaaggcacccagaaaggcctgaatctgacttcgtggcagcctcagaatgacccttcctccttttgtgcttagctaatgtttacatctcataattcatgcgccaccgagagttgcgcggcggcggcggaggcaaggttctcgtccctttgcgaactggctacttgaaattctaatagaagaggagaattgaaaaccttgtaatcccaagaacagactcgcactgcctttttctgttcccagagctcaaaactagaacaaaacgaaataaaaccaaagcactcaaaccacaccccaaacgaagaaggcgcggaaagtaggagaactggaaaatttctgggccaagaagatctgtctgtcttctgtatataccctgtagatccgaatttgtgtaaggaattttgtggtcacaaattcgtatctaggggaatatgtagttgacataaacactccgctcttatttttccagaagaaaaaaatatatatatatgtatatgtagtatttttctgaatgaggacagtctggtgactggccacacgaagactccttcctctttattcctctatcttttcctccttcaactggttagagatggagaaatcatctacctgaactctccccacgcctgcccctgggagccttggtcccttttcacatctctttaagaggttaatgttattgttgttgaagttttaaatttatcttctcgtcccaaacgcacccattttctattctgggctcagggaggctttattggaaattgcgaaaaaaaatgacttgtcttcagtgtgcgaagaaggcaaaggaaatttgtttaacaaacggatgctgaggccgcctttccgtttcagttcagaacaagatgacctggaaatactcgattaccaaggagtgttattgtctgtgtgggtcacctctatggctgtatccccagtatcaaagggatgtgagatttctattcgccgcggaggcggcgacaattagaacgtctcggacccatggttagtattgctcgggtggttatggaattagcaaattgctaatcaattttgctctcaaaagttgcaggtttttttaccccagcgctctgtctatagtgtgggaaaccaagtcgtttctccaggcttgggccgtgtgggttaaagggaggagtggataggagaagggggacagacggactgacggacacagtctagctaaccgtgcagctaaatgagatttggaaggcgaagtctccccgaattagtgcatgaatttcctatcgatccgcccgcggttccattcatctctgacaagtccctctgcgcacccgccctctagctctggacgcctcctctctcacccctacccttccccatccagctgcagagaaaagccccaagctctgtgctctggcccccgtatgggttcccctttcgagacggagcccccaacccgccagtaacctaactccccatagagacgcagggtgctagcgctccctcccgccgaggggaggagactggggcctttggaaggtacagaatgctgggcagaggtgaggcagaacaggagggctacaccgggagccccaacttcttaagggatctagggtttgcgctctgcctagcgccccaacaggccctccagtcgcaacctgcgcgcgctctctctctcgctctctctctgatcccggagagagcgaggcaaggagggggtcgccccgcaggagccctatgtaaatcctggtgttgggtgggtgggtggggagggggaagggaagaaggggaaataaacctctttggctggagtggggtccgggtgagcagatttccttatccgggaatcgcaggcggggcggccattggctcggaggatcacgtgggcgcctaactttgttcacttgacagtaagtaggagggctttcggaaacaggaaaacgagtcaggggtcggaataaattttagtatattttgtgggcaattcccagaaattaatggctatgagttcttttttgatcaactcaaactatgtcgaccccaagttccctccatgcgaggaatattcacagagcgattacctacccagcgaccactcgcccgggtactacgccggcggccagaggcgagagagcagcttccagccggaggcgggcttcgggcggcgcgcggcgtgcaccgtgcagcgctacgcggcctgccgggaccctgggcccccgccgcctccgccaccacccccgccgcccccgccaccgcccggtctgtcccctcgggctcctgcgccgccacccgccggggccctcctcccggagcccggccagcgctgcgaggcggtcagcagcagccccccgccgcctccctgcgcccagaaccccctgcaccccagcccgtcccactccgcgtgcaaagagcccgtcgtctacccctggatgcgcaaagttcacgtgagcacgggtgagtgcgtgggcaccccttccccctcccacccctggagctttacaccaaagggacttcggaggcatgggttgggggggggttgagctggggaagccaattgtccccgctataaactcgccattgccggagatttacggtcgcctgttttcagagccacataattacatcccccataaatttttatggcctggtgggccctgcgcctttgaagtaggttccccatcctcttcaccattctcaccagcgactttttcgccagggagatacagtcttaatgaagttggaagttggggaggggtggaggaggtggaggaggagaaggaggaggaggtaatccgtatttaagcagagagttgagtcaactcccagtatttattttttcctttcttccagtctgactccttggctggagaagtgagcaaaagttttcagtaggggtaggcactgcttggaatctgagcagcaagggtgggaactaaacagaggaaaggtttagggaaacctcccctccctcttccaccccctcattctcccattctgggggccccaagctgagggggagagaggagcaattaaaaccttgggggagtcctcacacgccccccttccccaccacacacccaaacaaggacacagcacagccctccaaaacttggaggtctctttctcattcttgggtcttgcattcttcccttttcgtttttccccgctctccctcagaaggaagaagaggtggcgggagagggagggagggaaacgctgtgttccctggaagaaaggactctctctttcgggggcaataaaactttctctttctccctctctccgtgtgtgtccagtaaaccccaattacgccggcggggagcccaagcgctctcggaccgcctacacgcgccagcaggtcttggagctggagaaggaatttcactacaaccgctacctgacacggcgccggagggtggagatcgcccacgcgctctgcctctccgagcgccagatcaagatctggttccagaaccggcgcatgaagtggaaaaaagaccacaagttgcccaacaccaagatccgctcgggtggtgcggcaggctcagccggagggccccctggccggcccaatggaggcccccgcgcgctctagtgcccccgcacgcgggagccacgaacctcggggtgggggtgggcagtgagtgcaggggatggggtggggggacaggagggggccctggggcctgggccccggaaaaatctatctgccctcccccacactttatatacgaataaacgcagaagagggggaggggaagctttatttatagaaatgacaatagagggccacggggaggcccccccagaagcaagattcaaatctcttgctttctttcttaaaaaaaagaaaaagaaaaagcaagaagaaggaagaaagaaaaagacagaaagagaaataggaggaggctgcagctcctcgttttcagctttggcgaagatggatccacgtttcatctttaatcacgccaggtccaggcccatctgtcttgtttcctctgccgaggagaagacgggcctcggtggcgaccattacctcgacacccgctaacaaatgaggcccggctcggccgcctccgcctctgctactgccgctgctggaagacagcctggatttcctttctttgtcccccactcccgatacccagcgaaagcaccctctgactgccagatagtgcagtgttttggtcacggtaacacacacacactctccctcatctttcgtgcccattcactgagggccagaatgactgctcacccacttccaccgtggggttgggggtgggcaacagaggaggggagcaagtagggaagggggtggccttgacaactcaggagtgagcaggaaaattgagtccaaggaaaaagagagactcagagacccgggagggccttcctctgaaaggccaagccaagccatgcttggcagggtgaggggccagttgagttctgggagctgggcactactctgccagtccagagttgtacagcagaagcctctctcctagactgaaaatgaatgtgaaactaggaaataaaatgtgcccctcccagtctgggaggaggatgttgcagagccctctcccatagtttattatgttgcatcgtttattattattattgataatattattattactatttttttgtgtcatgtgagtcctctctccttttctctttctgacattccaaaaccaggccccttcctacctctggggctgcttgagtctagaacccttcgtatgtgtgaatatctgtgtgctgtacagagtgacaatagaaataaatgtttggtttcttgtgaccagcacagcgtgtttttgttgaaacattggcgtaaagatatggacaaatgccacccagtgtatattttaagcaccctactgggttcagccccacattgtgtgtggttgaagatttttttcaaagagtctgatgggaatttttatctcagaggactccaaattgtggtggctggtttgttttccttttagggtgggtgtgttttgttttggggcttttaattttttcccttcagtccaaaaatggattgaaaggactgggaaggctgattccagtccctaatgggggaaaatgtttcattgtaggacacaagaggcttaagtacggcaaagcctttcatatcgtgatttatttgtcataagcaaataaaatgcggttaagctgtctccttttagacagaaggctctttggttattaaagttccgagagaggattccatgaggctggcctctttcctcgcagcataagaaggtatcgctttcctctgaggtgtttaaggctttaatgagtataattttttgcacagatgtttctgggtgtttgcaggttttcagagtatttttatattacaaagaagctagccagtgccatagctcaaactctgacaagcaaatagataatcaagaagacaaatggcctcttttgtgaagccttgctccagtattaattttcattttctttctcatagaaagtatcgaaagtatgactggggaccaaatagctttctgtctctgaggtcccagtcacccctagaatggagtgggggtaggggaaaggggtgcaggtgaccctcagaagctctgtcaggctcagattgcttttgtgcagcactgcttggaagttctaaggtctgggggctccagcctcagggtctctggtctattggtcatccagggtgcagccaccacatctccaaaaagctcggggctcgggagagcatatgcaattaaaagtcgttttttcagtcccatctcctttcagaaaataaaaagaaccaatcccacccgcgcgttttattgttatttattttgcattcctccagcttgcagctccggtagttggaggctgggtagggcagggggaaccgacaggccggtgtccccagccgcaaaagagctgctgaactgtccgtttaaatgctgctgggagactcgtaaaaaaatcatcgtggacctggaggatgagaggggcgagctttatttcggtcggattgcggtgtggtggtttagctgcaaggggatgccgcagccccagttgagggggaaaatagttcttaaaaagcatatgcccccctaaggaatgtctctaaagaaccaaatcaaagctgctctttggaaggtatgaatagaatttaaaaaaaaaagatttctatggagcttaaagttcacagccattctgtgtagacaagagctaagaaaaatgtgagaattatacagaaaaccattaatcacttcttttctttaaatacgtatcctctctcctttgttattattcaacagcaaatctccttggaccggctgttgggggaaaaaagtgttagccgtctctcccggatctgcaagggggaaaaaatttggaaccataaagttgaaaacttttttctctcagtttggaagaagcccttcgtcatgaatgggatctgcagagttcgggcgagaggaggcgagaggcgcaaaggtaacaaagcccgggcccgggctggcgtgttttgatcgttttatgagctcttttcacaactgaaagaagaaacactctctcgcctcttcctttttcttttttaactttcttggctgggtttttatggtggatgcttcagcaggtttgctcccttttatgatgactgatgcttgggtcagagggagagaaagaggggcctcgacacctggagagtgtttgaactggttgggactgaggtgtcagggcccatgaaaaaccccagagaagacggttgttttgtgaggcagttcagaagcgcttttctggttttggaaaatgcaggcaggcacagcgagccccagcatgtgtgcatgggtgtgtctagtgaggtccacatgtggtcggtgtgttcctgtgactctgcttgtctacactgggtactggtgtcccctatgcctgtttaccagtgagacgttgtcactgctgcctcttggaaaaatcaaatccagtgcttggatggaatgttccagctttggagcgggtataagtggatatgttcttttttttcttcttgtgtctagcttgggattctagacaaatatgtgctactctctggagcaggaaactgctcagttcacagacaaggtggactgatgcagaaatatttctcttctgctctgtccccccagccttcttcctggaggagcaatgttggtttggtttggtttggtttccctttgctctcctaatttgaggtctctgttctctcctctgcagccctgtttcttaggctgagggagtcagtgggctctgcagccgacctgaatgtgttggccctttttccctgaggcctcacttagggtttggaggcgggaggctggcaggagagagagttcatggagaggccacgttttctaggcgattagctcagtattagaaccacaaaatgacctcggaagccccttgacctcgctgagactggacattgtgttggcatttgcctcctgcccaggagggagagtcacacctctgcagggaggggtccttggcccatcatatgtcccatcttctccatccccctctaggccccaaacccatctttgctattttggaaattttggattatttttctattactgcccactgggggaaaaaaacgtaaagatttttagcccaagggtccagttgggggacgaaagtagggtgctaatctgtctctctgtacacagcaccttcagcagtccaggctccagccatcctccccgcaaccactcccaggtccagttcatctctttactatttcacctggagggaactgagggaagaaagacaaagggagaagatatgagaggttggaggggcctaatccacaaggcttcagagggccaggggaataaactcctgggctgcgaggagagaaagggcttatccgccctgaacattgcttcagaggctgtcatctccctgagggctgacatccaaatccacagcctgtcaacccattttctgaagttcatttgttgaggaagctatttctataactacctttacctctttcccctaattctcaatctcctcaataatgaaaaaagcccttggagtgcctcacccaccagaggagcaagggaaatgggaggaggatcagtgcaggctattctgagtactttccagggcctgctgtcccaggttagccaaagtttccagaaacttttaagaaataggtgaaggatttgccaaacagtgagccctgaacatagagcctttccaaaaactgtattctgtttgctgtatcttaaaaatccacaccagcagccaccctcttagggagagacagagacaaagagaaagagaaagagagacagatacagacagacgctggctgggaagatgaaatgttacccttcagttaagactaggagagacagaaccttgctgggatatgtgggttgttggtttgcattttgtaaattgtttcttgacatttggggactctatctcaggcaagaaataactggagtggttgatactctctcctttgtccctgggtggcataagtagaggggctggaggcctcaggaaagacagaggatgagcacaaagctagctaggctgctcctggactaaaaatatatggggctcagggagatgtgtattcattacctgtaagggcagatagccagttgtgggccttctacaggctcaagtgacaaagacctagtcgccgaggactttacaaactgctttctgcaatgtgaggattagggcccaccaaagggaaaaggagagagaccatagtcagggaagcctggggttcactaaggggaactgccagatctcccatttccttcactccagacaatcctagtgccactccagtcctcccaaccttttgacttctttccctctttctccccagttccctcggccctccccattctccctcctacttccacccgcctgtcctgggcagagggggttgcccagttctgccagagcccttgaaggcggccccagcgctggcagtgggtctccctgggaagcggcagctggggagggggtctggttggaaaacggagttgggaagtttctcagcgtgagttgagcgctgacggatttgtgatcagccataaaactggcgcgttcagattcgtaaatcaatctcgcctttctcacagtgtaaacgttcgctttatcggcagcaagaaagtgctcggctcgcgatcaggcgcttgtttatttgaacgtggacattcccaggatccgaaaagagtatggtcattttaacagaacctgctggcgtgccttcgtgtcattttgctgttctttttcttgtccttaaaaattatttctccgttttagagattgctgtcttcccacatccagcatttctctctcctctctctgctctctctctattttcattttagactttagcagagtgtttttctctggaggaccatttttaatggatttgtggccagaacgtttcagggagttgccctcgctggagccgggagcagggcccacatcgggatcaggctgaattcaataccagtctgtgttttgtatctggacaatcaaagctgaccacctcccctacagagtccaggcctggccggcgcccccaccccatgaggccagagcagattccagtgctcttagctggggcagaagctgtgcagctgccactgtagctggaacctccgaggccgacaccggggtggctgtttctttggggcttgttaagacaaccgggtcctcaaccttctctccactgagttgcttttggtttagaccccttcgaacaagccgggggaggcccctcagacccctgctcccgtaccctgaagctcattcttcctggattccctgcctgccccggaggctgtggtcctggctgcctccagagctgctgaggacagataaggctgcgacttcttcaggaatgtcttttctgcttccctttgcatccccaccccccatcccatgccccggccgagaactctgattctagttgcacgtaactggtcaagtttggatggggggttgtttttgttttattttgtttatatttgagttgaaggggtctgtgtgtgtctctctctttaggcctggggaatagatagtccctggtatttaaccctttaacaggcatagccatcccccatctttttcccactgatcagcctccattgtttgttgattggaagctcggggtgctaacacctgggaaatagggatcctggggctgccaggctgacttcaaagcttttcttttcttttccctcctctcctgttcaaatctccagctgtcttcactggtgggtttgggaagggggggaaatgagacagggtgtgacataggtagagagaggctgacagtccgattcttttgtgtagaaaccttagtcccagtctttgtctctagaatctattttcaaacggtcagtcgcatttgatttcctatagtagtaacaacacaacagggaaaaaagtcccccttgcggttattctcaactctggaagctccagagtaatctcttcaccctgtcccttttttgccccttcaaaaggtaccagaaaagatcaaaacgagaataaagccagaagccccattatttatccacttataccatggacttatgaagtgtttattttcaaagtggctccttcagaaattttgtccattatttaggaagagagggagtgggtctcactcaagtaaatatccccaggagttggggaaaaaatggagttggggagggaaccttaatcctaaaggatgcagagagaagaactggaagctgagaaatccaggggcttggagaagggctctgagcccaccccacccccaccccctagacgcccctgcagactatttctgcacctccacgaactaagcagaagcaggaggagaagggagagaggagaggtgggctgtgggtaagtgtgtgtccatgggggttagggagctgcagatgtagtaggtatggatgtgagtgtgggagacagacggagacctcactactgttccattggtgggttgagggggaacttattttgcaggaaaatttctcctcctgaaggggaaggtcatagtggtcctttgagcctgaaatcgaaagacccccttccccctcccggtcacgtgattcattaaataattaatgccgaggttgcagaatagatatgtattcgtcaggaaaatcgcaggctcggtctccctgtttctgacgtgcaattcaactgtcctttgaaaaacaagcctgtaccccgagaaaaaaaaagagaggggggagagagagagggagagagagagagagaaagaaagggagacagcaataaaacagccccgcagccggagccacaccgcgggctggggtattgtaagtagaagggatttctcactacctaccgcgtcttatatgtccatgtaaatttattgtttgttattaatgttattgtcgtaaaatgtgacaaatagccatcttcatttcctgccatttctcttcacacggtgctctgtgtgtttatgcccattgaggcattgcatagagattttaggaatattcttcttttctctctctctctttctccctccctccctctccctctctccctctgtcctccaacctttttcttgatttatagcaatatgggtgtcagcttctcagccggcatgccagccattgtgtgtgtgtgtgtccgcgcgtgtgtgtgcgtgcgcgtctgcgtgtgtttgtgagcgagttgtgttgtttatggccatgtcttcgataaatcatttttcacggaaaatgatgtggaagctgggctgtttctgcggccggccgggagagagtcgctctcggaggcacttcctccctctctgctctgctcccaggagttggttatttcagacgatttacagtaatatatcagcagttaatatgaaagctctatagctggaggtcttaaattacagcatctgtgattatcaattaaagcgagattttcataaatttggtaaaccagaaatgcctcattggcatataaacccagtcaatgaccatggtctaatataaaaattatatttgtgagcctgatagagccaacattcctgcagcagcagacagagctccattttttagcagctcccctccaggagtttggcttctccaactccagccctggatgaacaaacccaactctgaaggcagaaggagccttagagtaagagaggtggaagtggagaaagaaattactggagttgaaggcaaatatttttgtgatcaatggagaccaaatcaaagttctgtgcaattggaaagggatgggaggggttccgttacattattaaagcttaatttataggactgatgtgtctggggggtggtcaaaggtggaaaaggaatcacccaaattgggggagacaatggaggcaagcagagggtgaagggcagggagagaagctgaaagctttggctccccaccctcctggctaacaaaacaaggaaatgaattcacaccccaggagccttcctttgacctgctgaaacaaagaaaagtttcctcagcagtgagggactctgtgtttggggctaaagtggggagaagttctccgaagtttttctagaaaagaaatgttctaggaatcaggtggtcccagaaagttgggagtgttggaggatgttgggtgtgttcttttaactaagtccccatccaaaaagggagcaaacggggtgcagattggagagggaggggaagagctgttaactttctcctatagtttcatgtggaggtcacagttccttcctactaggggagaggctgctggtcaagagcaaagccagaggtggctttggggaatgttctgcactgtgccccaaagttgtgatggatgaggtgcagagggccagagccttcaccaactccagtcccagctgttggcccctcattccctgactggagccaggccaactgactttatagccacgattatctgtgatatttaactctgcctgctagtgtaaacctttgagcagggaagttagagcaacgccgcgcccaggtgttaattattcatggcatccactacgtggagtggcagcttaggccccagtccctgcagcatccaggagctcgctcccacactctgctccaagtgaacactgagtctcatccatgttaacaagggattctcagtgggtagtgggtgaagcctcccaattcaggagtctcagttgaaaagggtttggggagaaagagaaggccaggacccaaggctgggatgggtagaggcactgtctgacctggataaaaagaactagggaaaagtctggatacaggggcagctttgacagcactggagattgtgaggaggtgggaagggctggcagaggcagcaaagagacctggggcataggggctccaaacctttcagtctcattccccacccactccttgagtgttggagaatcccacacacattcagtgtgagaggcaagcagttctacttctccctcatctggaaagtgttggggggtatgactgtgaagagggtgcgttctccctcaaaccggtggtccagagttagggcaaagtcttggagtttttgagagagcagggaaggatcacttcttccatggggaggaggagggacatgacagagaaggaagagggtagaatcatttgtattagcttctgaattcagcatgctttgaaagatgggaaagaaaaggatctgctctttgggccagcccatagctagcatggagagccagtcccacaggccccttccccctgcgtttgcaactcctcctccccaacccttttccatctcccctcctgctgctacctttgcctgtgacgtggaagtctgaccaaccacccccacccccactccaccagcttttcctctttattctttcagccctcttcaggtctttgtctcctctggcccagaggagaggaggtgacactgataccccctccccttccctttccccaacacgcacagactcttccccaggagacaaagcaaggggaccatcccttgccaccattatctggtaaatcccccatgtgatgcctaatgccttccatccaggcatctaggcctaccccaaatcagcaagtttgaaaggactttgttgtttatatatacatttgcttcatttagctatgaagcaccctgtctcttaccagtcctgcaccctccaccccactgatttgcttttgtgttgttcaggggttgggatagaatgcatctggtagacagagctctaagaaagctgctgactctgtcttctcccctaactctctgctggtatcctctctatataattgcagtgtttatctctgtgcctttaaggaggcaggctgctaacgctttagtgaccagaggaattggatagaaagatgaagagtgagatgaggaagagagggacccagagagagaacaagcagcaggatccctttctgggatgggaagtcaaggctgagcccaaggaggtgatgacagggagagtggaaacaaaggccagtcagaggggaagggaggctgtcctggaggaaggagccccacaattcacaaggggacacacacacagagttaagtgagaacaagggcagtgggaaggaaactaccccttttgtccccttctctctagaagagaatttctctggatagagggtgggttcccccacagaggaaagggaagaagagactcaacctaatgggtgagcccagaagtgatttctggagacactcctaaatcctttgcaaggctcaattcaaattcactgaagacactgagagacgcagaattggaaaaagacaaaggggctgtgagaaaggaacggagacaacagagatggttagaaaagacagagagacccaacacagaaaaaaagcccaaaccctttggggagcaggcacagagggaagcccctccaggctccctgctccctagcagccttctttacaggaagctgcccaaagcccaggccatctcagaaacaactgcctctagagtaggcccttgggggtgctaaatcaggtgtgaggcagctgtggcaggagctgaagtgccagggaatggccaagatgtccaggacacttcagcctccaccacaatcaccagcatcagtaacttaatcattgggacctccccaaacagaatttcatcatgggggtggggggagttgggactttcacacctggaccctggaatcctttcttggcttttcttcccccttgtgggtttggtctctttttttctctagggacctggggaagttgttgatcttccagccgcctaagaactttcacctccattccacatctcctccctcaaactcccagccttaacaagcggatgcttcccctactaatctccttcctcccccatcttacaggaaagaacaagaaaaggaaaaagagaaagcaagttcctaccagcctaagcagctttagaaaactcgagggaaaaggggagatgcaaatctttctcgcccgtctgatccttcctattgccccctcgccattgctctgttccctccattgccgccctccctgtccccactcctgtcctgcccagaactctctcccttcccctcccttctctgccgggtcggacatatggaacccatttcgctggtgacattgaagagtcgccggtgtgcccgccttccgccatggcgcccccggcgctccctacgcctcgccgtgcccctgtcagttgccgctcctctcgcctggcaacttggcccgctctcaaagcccgagttcagctcggtgccagacgagcccggggttcccgcagccctgcgcggcccggacggagtgggagcttctcaggaaactggcgtctgccgcgcccggagtgccagatccgcgcgctcctggggccctggaggccgaacaaagccgggggcgggggcgggggcggggtgggggcgagcgcatccgggcctctcccccagctcggcgggacgctcgggggttgctgggggttgctgcgggttgagcgactaggatgcggctggctgcggcggcggagccccagcctgggccgagggtccggggcctggcagtcggcccccgcgcgcacccagcgcccggccgcccgccgttgcccgcgccctagcggaagaccgcacaggtaagtgtggggtgcggagccggggcgctcggggcctggcgggggtgcagaggtgggtggctgagacccccgcccccaggcctctctcctgggacaggccgggatccgaattgaagacgaagatgagagcaactttgaaaggcagggtgggggcttcaagggggtaaagggacctgggggtggaggacgagtgtggaggaatgtggagctgtttgggtgggcgtgtggacatgatcttgttaggggatgggagagccctcccgctcagaaagggcgttgaggcccaggagggttttccagggcagttgggggctgtgggtactgagggaaatgtgaggggcatctgttaggggcagtggggttggggggcgaccgctgggtcagcttccacaacccagctgccaccattgcccaaccctttagcacctagcgggttatttgaaggcaaaactacaagggattgcactgaggctgagtgttaagcccagaaggtaggaaagggggtgatttatggcttcagagaagctgtgtttactcctgcctgctctggaaaccaaaaaccaaacagagcagaggccagagaagcccctctccttggagtgggaagcgatgccagcctgacgcactgggatttattttcccagatgagggagaatagtgggaactgtccctttgcaggcgcacagtgtggtgggtgtatgcaaagggagcatgtaagcaggcacatgtgtaggtatgtttgtgtattgtgtgagtgcatctgcacatcgggagctgtatgtactccaggtggggctttgcggatgggtttgcagaatcactttgtgagctgggagattgggagtcaggagagagaccccatgttctctggttctggaactctgggatgaggtagctctagacacactgccccttgtcctgtccacgaagtagtgctctttcctgcttttttcttcccgcagccacatgcagcagagcccacttggcctggcctcctggcccctgcccctctaccctttccctgtgtgcctcctgtgccttctgcccacccagcctcatcttcactttgaatttttaactttgtggtgggaagccaaggaattagtgagtatggttggttgaggaggggaggccaaaaggagaaaaggcttggtgtggtagggaagatcggggagatccgtggtttgaggctggaccttggcagccttgtgtcccaccattactgctcgaattcccccaaaatctctgtttgggagtggggagcaagtgaataatacaaagacgagcagagtaagggagccatgcaggaggatggcggtggggagaaaaacattttgacccccagatagtaatttccgcaggccaactagtggctcttgcatttctgtccagacacccagctttgcctggaaattgttttgcattaaattttctcagccgcagaattatctttcctcgcctccagctaaacttgcatttttccaccagacacttgggccccgcaccaatgaaatctgagaggaagcggctgggccctaagtggccgtaatttaattgattttatcataaatcatcaacttgatgaagaacccgaggtttcagtgaagtaaattgatattaatgggagtttcttgaaatgcaaactcgctgcattgttggggcatcttgagctggggaggtagattacacatttcccaagagcagagagcagagacctggagcccagcacagctttgggggtagggaaagcaagctttgaggtgcagctgccggcagacctatttctatggggaagcacagcagagcgtggaactttgtcatgagggacacagtctggccctgtggaccctgctggccatctgggggaatgcttgtctccaactgagggggaggcaactgggaaggctggtaggtgtatgggcagggagggggtcgggtgagagggctcggctggtacaatgggtgcattgatgcctggttaaaaattgccaggttgaaaccttcctcctttaattagactaattaattatttactgctcaagttgcagtgtctaaatatagcacttttggtttggtaatgagggtagaaaacaacccaccctacacacagaagagcagtaaaacgcagtgcatgagcctctatggggcaagggagggccaggcatcgggttggtgctcagtggtggtaagcatttaaacctcaagaggaaatactctgaatctggtgacgatggtgcccgttattgtctgaactcagtttattacttcttgtcactcacttttacatcagcacatggagaatcactaacattcagtccaaaaagagaccttagagatcatttagctaaaccccttccctccatacacatgcccaggctttacagaaggggacactcaggcccaaggagtgccctgcctcatgtcacatagccaagctggaacatctgaaattcaggccttccaactcccaagcctatcccaagtatgactctagacaaatcacttccttgctctgggcctcagtttcctgatctgtaacaatggcaagagttggactggacacttcctgatttctctcctgttctgaaattgggcacctctgtgtgtacccatcctcagcaggacagtgcatgggaggcactcccttgtgtgtcctggagctctgtgggcatctgggtatagaagttactgcatgtttatttgcaatattcagagtttacatacacccagagcagtggatgcttactcagtctggctctaggaaatccactggaatctggactattcctctttctgaaggtgcccttattctcagctgaggagtagccctgaggagagcagtggaactagaaggaagtggtgaggggccagctagctgggttgggttgagattggcatttggagaagggctaagtaaagaagggctgggccttactgagcaagagtctttccctgccaggcactgggctaaggctgtcattgttcagtgtgtgtgtgtgtgtgtgtgtgtgtgtgtgtgtgtgtgtgtgttttgagacggagtttcgctcttgttgcccaggctggagtgcaatggtgcaatctccactcaccacaacctctgcctcctgggttcaagcgattctcctgcctcagcctcccgagtagctgggactacaggcatgcgccaccacacctggctaattttgtatttttagtggagacacggtttcgccatgttggtcaggctggtctcgaactcccaacctcaggtgatcgcctgcctcggcctcccaacagagtgtggtttttaaggtgccccctaccccagcccagggactgaacagtggtttcagagtttagattctgtgatagcaggtgcctcccttctcagcctcaccccaaccctgggcctctgagccctggcttcttgggaggaagcacacacagggtgccacagcactctaccgggtctcctctagggtagccaggacagaaggcctgcatggtggaagactcccactctatacttgcttttattttccagctcctcccccagttccaaaggagtggtggcttctcaattgcatggttgtgagcaaggaaatttcttgcaggatcagggatgtgaagaggctagcaggggaggggaggtttccaggctgccttgggaagtgtggtttggaatatgaattccggggaaggagggaagaagaagatgggaagagatgggaaacaacctcatctttggggctctggaaatctgagacactgggcagataatccacttcctaaagcctagccccaaacactaatttgagagagaaaaaaaaaacaaaagagctggcaggcccagactctggctctgtcccattctgacttcggagttttatatttggaggcaattcggaaggcctttcgctgattggtcattaatccactgagttattgtctgctaaacagaggtcactgggagagaaacatccagtctgtcaggagaggcccgctgaacctcagggactgggcccgttcctcttttcctgcttctccctccctttcccagcaccccctgcagcccccaagctgcccaggatttgcagcctcccttcctctgccttctctgctctgcccacctttgtctcaacacttgctgggggtggggtttgccaggctaaggctgagcttctaggtgaggcgggagccctgattcagattgggatctatcaccaccaaggagcccacctgcctgaggctcccaactcgctggcagcaccgccatcccctcattagcatgttcaggcggcctccgtggtcatcgagtggacttcgcagacccttgtggctgccctttttgtcctgccaccccttcacaggctcagctggggagagggcagcgcccccacacgtggggtggggaaaaagtacagcttggatttttcttcttccactgcagcgacctttttcttcttttgatccccactattgctgagcagtgtctatgcgagtctcctcttctcccttccgggtgcccctttgttccctcctgctctggcttattggagagctggagatggggatccaaatgccaagagccttcttcattagcaattcccactttacaactcccagctttgaaatcttcgttaatacttaggggaaaatggagattcgggtgagtgtgtgacctttacaccacttttctagggctacaaagttgggcagtgaagctggaaaacagtgtgggactgggaacccagacagggccaggaagaaacacatcgccaaacatctcgccccaggcttacaggtcctagctcccaagctagcctttgggccaggcaaattttgtgtggattgagccaggggcaggatccttgactgccccaagtctgagatcagaaattggttttaaaagagccaaccagtatgcccttattgagagaatttttgtttgctagttgatgcatttttgggggaggagagaaacaggcacgatcccgccgccgaggtctagaagggcgggtagcccttgattgttccagagggtttaaagtgctcccgtcgcctgatactgggtacccagtggggtgggggagagaagtgccagagcgagtgctctggctctgaagaaacggaatggaagaggaaaagatgtctgtgaagaagggcattttctctaatctttacccttattatttttttacttcattagtttatgctagtgtctctgtctcttactcaattttcctctttttcaatttctctttctcctcctttctctctctctctctctcacacacacacacaccctacacacatgggcacacacacacagttttccaggtttccctcccaaatccaagaagaaattgttccctcttctgtatctccagtctgttccgaaatcatggcttcactctcagggatgataagcccttctcctgcttctcttttcccagaccccaaagtcttccctcagcctgctctggcgtcccccaccccaagttccctgctcaaactcctcactaccagcctttatcccctgaagtttgaaaatcccctggctagcagcaacacctcagtccaaacaggggcccttaggggtgcctgttccaccctccgtcctccagcctcccagccctaatcagagggcagcccgcctgctcgccagagacctctgagaatggaagaaaaaaggcaagacagaaactaaactgggatctaattgcctcccaagtattccaaatgggctctgtactccagaattaagaagcccccactccatctcctaccgcatttgggggtatatgtcctctgagattttctccaggttcattttcttgcttctcggtcctctttttcactcccaccccactatgccccactgccttctgtagcccgagggaccacaaagagttgaggaggcttggggaagggaggggtctgctgttgtctctggaacactcctccactcccagctcagctccaggcccgcttctcctgcagccggcccgaggctgcctgggtgccttctggactctcgtgttattcctagaggcaaagctgcgcagtcccaaaagcgatcaggttctcctcttctctcagttttacaatgaccttctctaacccaatgatagtaacagctaggacagcagaggttttgaggtacattcttggctttttttttatttgggggagtgatagaaaaaaaaaccccaaaggtactggtttctttaagcctctggaagcctccctggcctgagtccctgacccaccaagctcaaagttacatggggtctgaccctgtaggtctctaaccagagtgtagagatctcaggacagactttttgcagccacatgctcaggcacccctaacaggtctctttggggttccaggctggcttgagccccaagtctaggtctgacttggatgttttattttcttgatactactaataaacacagaaaaatactaataaacacagaataatagctaataaacacagaaaaatagctcccaccctccatccccatgtcccccaacccgtgcttccccccagctgtcaactttctaggtgggaggtggggtcctcaggacattacattctgaggctctgcaagtggcttctgttgctggagggcaggaaggccataggtacccccagtttatcagggcccctggaaaccggctgctccaaatcacctggcctgacttagccttgcctggaagaagtaggggctggaggccaggggccactccctatctcatcccaaagtagagcctgtgagtggggagagagagggaatgagggaagctttgccagacacctccaacctatgctggagggaacacaaaagctggaaatcaactctcacctttgttgtccccagtcccgttccctcttctggtgcatccagatgggagaaggcaaaagccaagtattctaaccaggaaatcacagggtagtgccttacatgaagttaagaggaccagttttccaagctgcctttagagaaaagagtcagctttctatttcatcccctagctccgagtcagcagttaggcagagttgcaaacactcctgctttgggaaatgtcctggtgctctttttgtcttttccttcctcccggaatgactattccccaccccctgtcccaaatctgcagacacctacatttttggctcctgtcttcctcctacaggcctcctccttgccttttcctgccctgctcaaacacaccctaagaaaactttagcttttgtggccttcctcacttgtgccaagagtcataaatcttgcagggcagagagaaacaaacagggttgttctgaataataataataaccatcttccatctcttctgccagtgcatttaaaattaagcgaccctgctagttcttctcttcttagaagtacaaatgtccttatcacctcttagccccttctgcctattcggaggtgagaatcataacagaaacttatccatgaagttctttcagcccgtctactgccagccagtctggagctcaaactaaaacacagagtcctccttttgtcacccttttctcaaccctcctccccctgcaagatgttcagagtttttaaaatcatcactcaccgcttgttgtctgttctcaaaaagaaaaagggggaggggtgttttttttttttttttttttttaagttctggtctttccctctcccttggttagagactgggcctggagactggagggagatttgggaggaatagagagggtgtagtggagggaagaagccggggctggagactcagaaggagggagccagagtgtgagggttggagacccagaactactttctaaaaaagtcctggtgttccaattgcgaatgagtgcagaggggcacccggcaccctcacccccgggccaggcctgcctttgactcagcctccaaatactacttctcatattagcataatagttcactagtggggtatggggggagctgtgaacttcaccgcccttccttgcctttgctcacctcttcctccctgtccctccaatctagatttaaatttttacctgttctttaaggaaaaaaaaaaaaccctccttcttttcttcttactctttttttggggaggcgggtattttaaaatttccccccttccccatcaccaccatcaccttccctccttatcaggcatctaagcttgctaaagggggagaggtgggggggtgtgagcttgtgtgtgagtgagtgtgtgtgtgtgtctgtgtggttttttttccctgtgcaaaagcagaggccattgttacggagagtagggcgtaccagtcttatagggcaaccacactgtggcggcttagccctgctggagcccggagctggattctggcgagctgagccgcccggcacctttcggtcttctattttttttcccgctcccccaccccctccctcctgcgcacccctgctcctaagccgagtgaattgaagcggacgccgcgcggctcctctggccggtctgcccctcgggctccccagccggggtggctttgcggggcgggggcgggggggcggggggcgacgcagctttaaacagtggtctttttttcctttgccttcaaggaggggagatttgtcgcctgccgctcgctctggggctcgatgtgaatatatattatgtctgcctgttctcccctcgtcggtggctaaggtaagctggactgaaataggctatcagtttgtgaatggcggagagtatgtctcaatgatttatggcccatatgactccaatctcggttcaagaagagttcacaagctttaagcttccttccacgcagcgactctctctctccctccctccctccctccctccctccctctctctctctctctctctctctctctccctctctctctcccctctctcttcctgcttctctcctcttttctcctctctctcttttctttcagcagccagatccagggctgaattttctccgcggctgctaagaaagtctcaacctttctctgtcttcctttcttgttatttttctttctcccattaatttttttaagtcctggaagatggcctatcccctctctcggggcttccccagctattgttactctcctggctctccctggggtgtgcttggcaaggtggggttcttgcggggggctcatctcccttctccagcgagaccctggggggaagccggcagccaccgtctccctccctccctcccgaggagccatatggaacctgaatttttccaacatggaggcaagggaaatagatctgtttggcttggtagagttgttccccaccccctcttgttctggatcccagatcttgggtccccttagcacctttctctcttcccactgtcccgtccgccaggcctcggcgccctccaacccggagccctgctgagcaaagtcccgaagcggagtttctaaggcgccttttaattcggttacctccagctcccaaaacttgctgccgcccgcggggctcggccctcggccggctggtgtgctgggaacctgcctccgataaccgttttggtgtcctgatcgcttgctcttcttcgcctccttgggccatcgtaggtggctggtagcttgtcgccagtcgccgcggcagcagcgaccggctgaggcagcctggcagcagcagccagggactacccgggtgcacaaaccttcccagccctgtctgcaccaccggcggagtctccattctttcctatcgcgtctctggctccttcgctttccacactcgcctggcctccgtcccgcgatggtttggggtttattgcaaggggagcggcaggaatttcggccccaggcatctagttaaattattgttttattattattactatcatcatcatcgtcatcattattattgctgtaacaatcagactaaataaagccagggcctagccagccaaccccctccaacgtttttatttcattctcttctctattaataacaaccacaactaatgcctgttaattaattcccccttcagccagggctgcttggaagctaattttggttaaatcagcagaggctaatggtaataataataaagggattgggtcagcctggtcaattgaactctggttctccctggaaggacctgctgctttgcagacccatgtgtatttccagaaaccaatcggaactcagggttacactgattcccttttgagtataaatctgtgccatgaagaaggggatttatgtgagggagggacttttcttcacctgcactccttttattttattttcctatgtttagttttctttggagttgaacagctaggctgaatgagattaaagttttccaaacacacatggcagtatggaggttttatgaaaagtgatggtgaagagttgggagagatggagggaaaaaaatgcagtcagaagtttcagaacaaatacacaaaatcctatgttagtttgaatctttatttttctggcacacttttaaaaggctgtattaaaatagtgattttttttttttgcctcagggaacctcagtcaacaggaatacctctgtttctaacctagagaataatattgttaaaattgctttgttaatttttttttcctcaggaataattttctcttttggaaagcactttccccgtctcagtagaaaagtctagcagttgtaacttcttgtttcttatttgctttgggggaaatcaaagaaaacagacggtgaaggaaagggtgggaaaaattaagtctcatgaaaaaaaaaaaaagaggtccggggagagacctgggccaaatggtcacagcaccaactggcgtggcccaggaaattgaaacaatcctgctccatgtgggggccccacagggccactggctgcccgatcccaggtttggctgagcaaagacaagggctggaggtggtggtacctgcagcagggccatggacagatgagtctcggttcagctggctcttgaggttaaaaatcatcaggaagtttctaggtcaggctgttgttgtcttcctggtgggagagtggtgggaagtggagaggatacctcacaagagaagcttctctgctgaacttgcttctcctgcctgttcttttaggagatcctttggttttccttcaggctagactttgcttgggcaagagacctaaaccgacttggaaggaggcaaaggctggaagcatagaagcctctgggctcagaggagggtgttgatgatgcttttattttggagtctcctagtgtcccctcccttgagccatcctatcccagagttggggaggagagatagggagagagggactaggggaggtcaggggctagtgcacaggcaggagagaagcaatggcctttgccatagattctacatctaggcagtcttgaaaggcatatagtctttatttatttttttattttttagtggaaatgaaaactggtgggcttttttttctcagcatctgctttggagatgttggggaggggaaaagaaaaaaccctattgatgtcagttcccttttcagttcctaagatggattcgagccccagtcctcttctcccccttgtgtctcttctctcgcctcgcaggtcagccgcttggaacagaccccggaggaggggggcagagaggggaggtggggggggggggtccggcgtgtcacgtgacccccagggttgccaatgtccggtcctgagggtatcaggcctttccaagttgccacccactgcccaggcctcacccagcgatgcagaaagccacctactacgacaacgccgcggctgctctcttcggaggctattcctcgtaccctggcagcaatggcttcggcttcgatgtccccccccaacccccatttcaggccgccacgcacctggagggcgactaccagcgctcagcttgctcgctgcagtccctgggcaacgctgccccacatgccaagagcaaggagctcaacggcagctgcatgaggccgggtctggcccccgagcccctgtcggccccgcctggctcacccccgcccagtgccgcacctaccagtgccactagcaacagcagtaatgggggcgggcccagcaaaagtggtcccccaaagtgcggtcccggcaccaactccaccctcaccaaacagatattcccctggatgaaagagtcgaggcaaacgtccaagctgaaaaacaactcccccggcacaggtaccagttctctgccttccttgtcctcagcttttgtcggagccaggaatgtcactgttattctagcacccagcccctaggcgcccgcgaggctgcctgggaacaatattaggtggccagcgggtacatttttgatacccctaccccctaatgacccctgaccccgccaacaccctcctccctctagctgccctccaccggagcttctgaaagctccagaaggcccagtgcgtggcctcaaagcccttcccaaggccacagagccaagacgaggcgctgccgggaggatgcagagtcgtcaacgattgattattattaagtatgattactgtgggtattaatcacaatcgcttggacggcccggggtcccggcctccagaaacggcagcctcttcgtgccacacttcctgcccacgagtgtccagattaccccgaggattctcctcagtctcccatcctgtcctcaggacggggtgggcggggaggggaaatgtcttccctgacctggaattggggataagggggagaaagcacgcacgcgaaaatccagccctaaataaatggccatgcggctctgtctgcgtgacatgatcaaattttcataagctggggcagcgaaaggagaacaggtctcttaataaatgccactattatagagtgtccgctaatgcgacgggcggtggggtgggggagtgaggaggcggcggggacccgaaggggagggcggcgggggctctgagtccaggcctggatttattaagaaacgatgcattcaatttcggcgtgttcagtaattatcttttatttcattttctccccttcccacccctccccctcggatccagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtgatgggaaagggcgaacgaggattaggggatggggaggaagagagagactgtggagctctggggggcaacctggaggtctgaaaagaggagccagagaaggtggtacccaggcttcctggtcagaaccggcctggagctccttcccttccccctggcctgagaggttgcttttaagtcttccaccccttgttccatctgcctgccaacccatcggaaaggaatccacatcatattggagatgaccccatcaaccccagggctccagcactaccaagttggaattccacgcccgggagtggggtagaggaagacgagacaggacgaggcagaaaagcacattttaaaaaccagacaagatggctaggccatcaccaaccaacggacttaccttacatctttgtaggtaattccccccaaatcttgatttttttttttcctcaattatcctttaaaaaataagaaaacacatttcaaacccaaaaggcacaaaacacgttcccttccaactttcccaaaacctcaaatttgttcccatttgaggtttattgaggtacacttctagcccccggtttttctgctctagaacattcatatctatacatcccacccccatcaattacagtttttagagggctcagggatggtgagagatcctgaaagagctgcctatattataaattatatacatttttttttaaggaaaagtgtggaggctagggcaggcaggttgttaggactgaaggtttgcccattctgctgcctccatctcagctccagctccatccccctctccacagaaagcagttggtgacacgaggttctatacttttcttctgttgctctcttgacttaacgtgaaaacagggtatatttgaacaaactgtcccaggcaggggctgggcagggcctgtgtgccttgctcagcctcctgacaggacacttttgttgcacttagaatttacattttaatggatgtaaaaacaactgtgagagatgtctgggcctgcagaagtccagcattgctcaaaaaagcgtgtgttctagtgaacattttcatatatatttattggttatagcctgttaaaatattttcttttttgtattatttatccccctacattatgtatttatatgagggaaaaaaaggaaaaaattgtacttttttagtatttacctgttacaaaggacattgtgtttcctgtcatgtaaaaccagctattttagttactattgtactctagaaaagagctgtagatttatgttaaactcgtacttacgaacaattgtaattagttctaaaaggcatgaactcagctcctaatcgtcactgtatagtcctgaatttgtagaactagagttaattccctcttggaactttctttgttcttcagtagttacttttttccttacctaaaagggttgtctgtcaaacaattcttgaataaactttctgttatcaattttatcttgtcctggtggtccaatttagatagcagagcaaggctgctgactgccaaatttcccccaagggaagaaggacaaggacaaggacactgaagacccttccctggcctttttgtccactgcccaggttcctgtctcccccttgatatgtcttaagtttaaataccattttctcactcataagagcctgtaacattttgccaacttcttcagctgtggtttaagtagcaagttgggaggtaacgggggactcttggatgctctctgtaggtttttctgtttggcctgtatgcctctaggtttttcattcattgacctttcgtctgttagctcctttggccacagcgtccatgcaccccccaccccccaccccttcccaccaccaccaagaaaatctggccgattacggtttcttccacgaaacctaaacttcacaatcctcttccggagccacaaagaaggtgtcacgtgacccgaagcccaaccaccattgggtctaaaatgaaaacaaagaaaaatgattaatctaaaaaaaaaaaaaaaacaaaactgaggcctagacttctcaggtcaaactttaaaactaagtaaaattaaatcactaaataaaactcgaggcggagggaggggaagcacgttcgatttcccctgccagagaaaggggagaggagggtgggagaagctgttggatccaagcgtaaataaaacggtccccaggctaatgtgcggctctgtttccatcatccttgggaaaacttcatttcttagttgtggttccataaaagttttatcacattggagtgaaaatagagaaggtctgtcaaagatgaaatgtcaccgccgagtcgctggagccgataagagcgagaagacagggcggctgaaatatggagctaattcgttgaaagagaagcgatggctgcttgctgaagagctgcataattctaattgtaagcgatgtgcccgcattgcttaattaggagcatatatttggtggtagtgatgttgggggagtgagaatcgttccaggccctgccttaaagagagggctgattttcatttttatgttgcatcctggcagtccaaggttagtaattatagtctttatgcaacaataaataacaataaaaaagcaacctgaactctacgccctcccccttccccaccaccaagtaggattttaactggactcatccaagcagcaagcaatttagcattgggtcaggctataatttaaaggcataagagcgtgcaaagtttgattgggatcaaataacgctcaagggtttttctttctttctctttctctcttcttccttgaataacattttctgaatgatataactagatgaagcaccatgtttggctctggggctgggttgggttgttatttatctagcaggaaagaggccaagaaagagaatttagcttaagtttgaaaaacagagctttggctcgaagctggaattgcaaacaagaaaaataagaaccaacttggcttggtgttccctatccttctctttggaagattccaggcgctcagctaaagcagccaaagacgtgggtaaaatatccgtgctgttaaattcacagcaggacaggggggcgggggagggatgtctctgaaaaggagggttctctgggccccttttaacacccaagttttccgctgtttgctaatctggccataaaatctgtcagtgagggttagagagagctgtatttcctgcagggacagtctgcccgagttgcctgagataagctctggatccttcagccagctacagaagctgttgctaaactttcagaggtgttcaagggggtggccagagggagaacccactctcaggcctccctgcatgacttccagacagctactatttggattattctatgcccacccccatccacacctctaaatggcaaaaattgttttctttggagcctagttgcacactactgtcgctggccactttgcccaggtcagagcagctctctctgttctgagccctccagagcatgcctcctcggtccctgcagcccccacctccaactcccctttctccatcctcctctcccccaccctcatgcttctactcagacttctctgtccttctttttaagtactcacgcagatgttacactgacagaaagtttctagttccagctccgggctcagttgccatttctctgctaaccagccttctcctcctggctgggcagcagagagagaggagggggaggggaggccaaagccatgggagttctccaggcaaactttccacccaacttagcgctttccctctgtccccatttcccatctgtttcccagctctcccagaatcacccttctcttttgcacccccacccccacccccaggcctttttaagggatgtgaaattttggctgttcgctctgctttcccaaagagccaaattctttgatgcaatcggagggagctgtcagggggctaagattgatcgcctcatctcctctccatccgtctgacccacttatttaaaaatcttcccccagatcgacttttcattttctgctttgaggcctagtttcccaccaattgcttggggctcagagtcttgtgccctctccccatagtaaattacaacactctaaacttcagactatcttggtctcctcaaaataaaataaattttaaaaacattttcccccagcagccagaaatggaatatcatctcagtggtcattatttccacccctaccatcttcagggaattcttccttgtcagggattcttttttttttttttttcttttttcttttttaactagcacaatggcaaaaatgggagggaaagtctctttgtcctaggggaaaatctccccaccacactcatgcacacacataacgctgatctgaactttgagagtgctctaagttaaaccaatggctacctcagttcttgttcatgtccctggatatggatacagatacaagcttgaggcttgagtgggtacatgcacatcttagactctgcctgtttttgggggatgtcacagagaagcatggaagcctgaaagtgaggaaagcaggggtacataaggggcagaggcagtgctgcaaacactgggcagagaagagaacccagaccatacagcgatggaggccagaggcccaaaaatgccccttatgctccatctcactcctatgtgtctgcctgggagttcctgtccatttcccaagatttaactgttgtttttggagggtaacagggatagtggtgtgatgattgtaaatctctttcttattttcaccttaatactgacctttttcaaagagtggaagcctctttcgactccctcttcctccaacgcggagatcctcactcatcttttcctggggaaggggagaagggaaggggatgctgctggccacgtaaagaaggccttaatttactctattaaaatacttggaaaagaggaaggtttctcccttagagtctcttcttttccaggcttctgaaaccttctaaccttcgaaggggatgaggaaaaggttcctctagcttttctggagaaacggaggcattggggagagagcatgtgaggcactggtgtaggaatgggggctcatggtgtcctggtcgtggtcctctggtgtttttgaatcaattaaaccaaataatgctctctgttttccaccaggcccagacgagcgattggcggaggccggtcccgtgaccacgaattccctgtaatttcgctggagtcctgggtttaatagagagagtccccatacgcttgtatttatcagcaatatacaattataaaggcccaaaattaaaaaaaagagagaccgaaatctccccctcccaaaatcgctccattacataaatcggggggggtgcaggaggggggtcccttccgatcctccctcctgacgccccccccagcagccccctcccccaccattgaaagccatgaattttgaatttgagagggagattgggtttataaacagccagccgtcgctcgccgagtgtctgacttccttccccgctgtcttggagacatttcaaacttcatcaatcaaggagtcgacattaattcctcctcctcctcctttcgagcaaaccttccccagcctccagcccggcgcctccacccttcagagacccaggagccaaaagcgagccgaagatgggcctgctctgccgccgccaccgccgccgccactccccgctgcccccccggcccccgagttcccttggatgaaagagaagaaatccgccaagaaacccagccaatccgccacgtctccttctccggccgcctccgccgttccggcctccggggtcggatcgcctgcaggtcggtaagcgtggtgggggtggggtgaggggcagctagaagagggggagaaaaagcagtggaaggaggtttaaaaaaaatggtggcgagcctgttggggttccttaccccctccattcctgggatggggaagtagaatatcccactggggttcaggcctggccgctaacagcgtctttttttttttctgtctctctctctctttctctccctatggctgattttggaagctggttggggaaacgcctttttttctgctagaagaaaatgatttgattgaggttttcacccgtatctgtgtaggggaatgagtatgttgttgctgggatagaccctagaagcagaaaagattcggtcctttctgccccaactctaggagaagaggaagaattcagagctagggaggaagaggggtgaagaacaatctttctgaccctcgctccggttgagttggaaagttccgaattgaggggtccactgggagggcttgggagggggatctgaggttccggcgccgaagggagccgctctccgccccctgcgtggcccgtgggcggctctgaatgctttgccctgacccgggccggggctgtagactagagagggagagaagaaaacccaaaagcagtaaagcgagcggctttggggtgggggcgggggtggggtggcgaggaaggggagaggtgatactggttttggaggatggggtagtccgaactgaggttgggctgagtacacggcccgctatgacgccgagcctgttttccctgcagatggcctgggactgccggaggctggtggcggcggggcgcgcaggctgcgcacggcttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggcccctccgcctcgcgggcggcgtgggaagcctgctgtcacccgccggaggtggtgccgggggccttaagcgcggacccccggcctttagccgttcgcttagagggcgcaggcgcgtcgagtcccggctgcgcgctgcgcggggccggcgggctggagcccgggccattgccagaagacgtcttctcggggcgccaggattcacctttccttcccgacctcaacttcttcgcggccgactcctgtctccagctatccggaggcctctcccctagcctacagggttctctcgacagcccggtccctttttccgaggaagagctggattttttcaccagtacgctctgtgccatcgacctgcagtttccctaacctgtttcctcctcccggtcctttcgacccccgcgctccttggccgtctactggaaaaatcgagcctctcccaccctcagtcgcatagacttatgtgttttgctaaaattcaggtattactgaattagcgtttaatccactccctttcttcttcttctaaaatattgggcactcggttatcttttaaaattcacacagaaaaattccgtttggtagactccttccaatgaaatctcaggaataattaaactctagggggactttcttaaaaataactagagggacctattttcctcttttttatgttttagactgtagattatttattaaaattctttaataataggaaaaggggaaagtatttattgtacattattttcatagattaaataaatgtctttataataccaaaacgagtgtttgtgttgggacctaaactctttccccgcggccccaaggccggtcctcacccctccaggacctgtgcgaagttgattaggttcagcggcccatatggcagcaaagcctccagggccggcgaagtccgggtggtacaaaggtgacccgattgatggccgcttcgcccacggctccggcaaaagtcgggagtttgcaggaagctgggtcacctccccgcccctcagcagagggtctttggtcctgagcgggtggttctggggcctctgcttggaaatagagatgggcaggtcgagggagagagtgtacagcgaacagaggagggtgaaaggagaggaagcctgtggacagtcttcagggtcgtggcgggggcagaagtttactggaattgggaacaatccaagggcttcctaggcttttgcttcttatgaccgaagccggtgtaggacctttttccgaactcaagaagcctagggacgcgaggcctggggcttgagccgggcctctttgggagctgtaggtggctctccaaggagtggagtggggtcggggattttctcgggaagcagggtcccgcacccagggatggtaactggcttcccagtgggcaagaaaagaggccagctgagaaatgtggcgctgccgggacacccatggactcgggctgctggggtttgggagaccatccaagcagcagccgggcgagaagcccagggtggcccggcagcgtcgcgaggcgctggacctgcggggagagaaggaggagcgaggagagcgggagggagacagggaagcaaagacgatgctcaaaatggcgctggggccgggcggcgggccggggggggggcgagggaagaagctgtggccgccatgacagccgctgcaggaggcgccggcccagccgggatctgcccccgcccctgcgtcctcccagctggattttccagaggccagggaagaaggggagcctggggggtcccaccttcgttttagttagtttgatttttttatttttaaagtggagcccaacggacgctgaggacgcgagatggaaggagagtccgggtggatgtgggaagggaaggagagcggcgggtctgcgggcctgggtgtgcctcatccagtctgacttttgattcttcgctgtgggatttgaagccaggccagagctttctctgaatgcagacccaccagtcttgaccaacaacttcatttcacgtatcaacaccatgtcctgtctatcccccaccacaccctgcctggttccttgtaaacctggtaagcgggaagcaaggatcgatctcccccatctgcctcctggtttgttctgggaaggtggaggtttaaaggtccccggaaagccatccatcctccttaggtttctttaatatttctcccgctcagaaacagacactacggggctatctccccggcagatgctgcccttctcaaaaagcagtttatttcctgggcctccagactttcccctggaccaacaggaccgggatttagagtaccagtcacccagaggcagcaattgtcaggataagccaggagccaacataggttgtgacacagaggactagacaggccctttgcatattttaaaatgggtccctcagtgtgggaagtacacacctcttagttagctggaacttaatcccttaaactgtcttaatatagaattcatctcgtgcattaatcttacatcatgttaaattgcacttatttctctcataaataaatatagaacaattagatgtgttataataatgtcatgtatcttattttccctcataaaatatataggtatgaaataaattcaatatattaaagtagtaatacacagcttattggcttatgtgtttattttccccataaataagggaatatacaatatattaaaactacgctatacatctcattgggctgtgtgtttatttctccataaaatatgcccacaggcagtgtttaacatcttaaaaatcacagcacacaagccatctctacactagcaaaatgaacagatatttcagctggggctttgatttctatggacagtcaaactagataatttggtctaattaaaaatgctcttgcagctagctatagcaggttgttacaaagatcaagaatatcacaaggatcttgctaatgtcctaccttccagtttctttggtcaaaatgagagcacccttcctcaatgccaaaaaaatgcagagttggctctgcaggagagaattcctatcccccatcatggtctgcagcactcaagggcctccgatgcaccagttctctgcagcctggctgctccatggaccagcagcatcagcactacctatgagctacttagaaatacagaatcttaggcccctgaatcagacctactgaatcagaatttgcagtttagcagctccccaagtgatttatgtacacttaaaagtttgagaagtactgctagatcacagtgccaccttgctttctgccttcctccatgcttcagaatttttgactcactttacctggcccctgccttccaattctcccaacccaaaccagtagctcaaatggcagggaatctttgttcctgcctgggcctgcatcagtcctgattccttcctgccaaagtagtggtgagccaaccaaaggctcaatgtacctgtttagattcaggtactttggatatcctaggggtgagaggtcttagtccaggtgttgtctttggctgattattggagaggagttgaaactctttttacaggaaacacaaaagcgttgctggctgtcttctttccaaatttatgaaactcaccgtctctgatgataccacggcagcacaaagaggcaatgaatttgcagaaggaagtgactcccatcttcaatttccctacccaattcagattcaagggaatgcctggcaatttgggattcataaaggattgcaattcaggatccctgtgttccgaattaacttcttttccttctttcatctcttgggtcatcctttttagcttgagttttcccagttggccatggaggagtaaggggaagagggggtggttcccagatagggcagcagaccccagtggtggtggcagattagagggcagctccaagtggccgcactcacttattccatcctgattggggcagggttcctcttgggtcaggaccaattgtgagtggtctgtagcacagagtggttataaattccctgtggttggagtgggaaggtttcagtgcagcccggaaagctgctcgtcagtctgccctgctcttagtgaatcattcttttaagaggcatgtcccattaatattacagtgaaagcaaaggaccattagactgaggaattactcgcaatcatggtaaccctgagtcattaaaaaaaaaaaaagttaacttatgcctgagcaagtctattcccctttctggacctcagtttctctatctgtgaaataaatgtaagaattaaatgcctctaatgtactctacattaatatatgcatattctttagtatatattatttagtcttcacaaacaatgtattaactgtttattatggccgatgtcttgtgctgttaagtaactcttggtgtttgacagtgacctacctcacgtgaatctggtggggccattttaacaaattttcttttattttttgagatagggtctcactttgtcacccaggctggaatggagtggtgcagtcacagctcaccacagcctcaacctcctgggctcaagtggtcctcccatgtcagccatccgagtaactaggagtacaggtgcgagccactaagtttggctaatttttttttttttttttttttttttttttttacagagtctcgctcttgtcgcccaggctggagtgcaatggcgtgatctcggctcacttcaacctctgccttctgggttaaagcaattctcctgcttcagcttcctgagtagcttggattacaggcgcccgccatcatgcccggttaatttttgtagttttagtagagacagggtttcgccatgttggccaggctggcctcaaactgctgacctcaggtgatctgcccgccttggccttccaaagtgctgggattacaggcatgagctaccgcagctggctggctatttatttatttatttatttatttttgagacggaggcttactctgttgtccaggctgaagtgcagtggcaggatctcggctcacttcaacctccaccttctgggttcaagtgattctcctgtctcagcctcccaagtagctgggacctcaggtacctgccaccacgcctggctaatttttatatttttagtaaagatgaggtttcaccatgttggccaggctggcctcgaactcctgacctcaagtgatccgtccgcctcggcctcccaaagtgctgggattacaggtgtgagccacctcccctggccttttatttattttatttatttattttttacggctagttttaaaatattctgtggagatgatatctcactgtattgcccaggttggtcttgaactcctgagctcaagtgatcctcctgcctcagcctcccaaagtgctaggattacaggcgtgagccactgtgcctggtcaatacattttaattagtatctttacaccaataatcatgcatttatctttatttaaatgagtagagagcaaaatcttttcaacaagcaggtaatcgggtgcagcattgtctgccaggtgcctggtattcaataaatatgagtattaaaaagtatcctagccaagttttcctttgactttcatcctctgccacctcccccaacatttggttatgtttactctttttcttttgttttttgtttgtttgtttttttaagtaggccatttcatataaaaagagccaccaaacttcttttttgacatgatgttctagactttaacagtcccttttagttatgtttaatctggttgctggggcatcagagcataggcacaatttctgagactccctaaacagcactgctgaattcacctacccatctttacccaagtctctgacaagcacttgctggccccactgcagatcttcttgggatgtactctcagtcctcactttgcagaaggtggcctgtagggcctcaattcatcttctgcctgctgaggctgattatagcccagatcctccactgatctctccagcccagctctgcctacccctcttctctcctccagccatccctctgtccacattcagggtaaggtagatatttagtgccggaaagagatcttcctcttcagaggagagaatgaatagtaaaggagccctcttaaaactttctctctctccggggccgggcgcggtggctcacgcctgtaatcccagcactttgggaggctgaggcgggcggatcacgaggtcaggagatcgagaccatcctggctaacacagtgaaaccctgtctctactaaaaatacgaaaaaattagccgggcgtggtgacaggcgcctgtggtcccagctatttgggaggctgagtcaggagaatggcgtgcacccaggaggcggagcttgcagtaagccgagatcacgccactgcactccagcctgggtgacagagcaagactccgtctcaaaaaaaaaaaaaaaactttctctctcccccaacaactgcagaaaaatcacaatctgtatagtcattcagacccaaattcagcttgatcactgtttggctaagatttccaaagcagatattttggccaaaaaaaaactattgcatttagataaactcgattaagtagaaaattattttaattcttcatgtcacgctaacctttccttttagaaagatctcagtcattatttaatcatgcccccaattattgactccagatggaagtttacatcttgctgatctgtctagatccagaagtcaggtcacctctaggatggacagtttccaagcgaaattccttaaggaagaagagacaacatcctccctagaaaacttttccccaatgtttggaaaatcaagaagttctttctaatatccaaccacaaacctttctgttgcaattttaataatttggattctttataggcataaaatattaggctttggttttcaagaaacccttcaggttagaagaaaatcctttgcctaaacagagccaatcttctcaattctcaatgaaatttgcatatgataaagtacatattatattgtataatatatggtgctatgttacatgaaaatatagcctaaatgctattctcctcctatcacacacacacacacacatagatagatagatagatagatagatagatagatagatagatagataagtttttgttcgtttttcgttttttgttttttgagacagaatctcactgtgtcacccaggctggagttcaatggcgtgatctcggctcactgtagcctccacctcccaggttcaagcaattctcctgcctcagcctcctgagtaactgagaccacaggtgtgtgccaccacgcccggctaatttttgtatttttaatagacacagggtttcaccatgttggccagactggtctcgaacccctgacctctggtgatctgcctgcctcagcctcccatagtgctgggattacaggcatgagtcaccgcacccagcctacttatttccatattttaatatgctagttatattaaaaagcagaagactgactcatagcatttcagaatgtgatttaaagttaatatcatacatttagagagttccctgtggtttgtattttcttgtttgctttaatcctactaacaaggcagcaagataagtagtattaaacccattctttttctccgaggctgagactaatagaaatcaagaaacttgtccagggccacaatgctaagaagtggccaagcaaaggccaggcacagtgactcccgcctgtaatcccacactttgggaggctgaggcgggtgaattgcccaagcttgggagttcgagaccagcctgtgccacatggtaaaaccccatctctaccaaaaatacaaaaaattagctgggtatgttggcacacacctgtgatcccagctacttgggaggttgaggtgggaggattgcttgggcctgggaggcagaggttgcagcgggccgagattgcgccactgcactccagcctgggtgacaaagtgagaccctgtattaaaaaaaaaaaaaaaaaatggccaagcaagggcttgaacccaactattctggcccacatagctagcactaatcccattacaatatgtactacatacagtctaaggttctcaaccagatttatgacagtttaattagcttgcattaaaagaaatatcctttctctaacagcaacaaaaacaattcatctcatagtgaaaaacttgtggtggtgcatgcttgtagtcctacctactcaggaggctgaggtgggaggatcgcttgagcccaggaggtcaaagctgtagggagccgtgattacaccattgcactctagcctggggcaacagagcgaaaccctgcctgaaaaaaaaagaaagaaagaaggaaaaaattatgaatattctttacttcctaagccccaactttttttttttttttttgagtcttgctctgtcgcccaggctggagtgcaatggtgcgatctcagctcactgcaacctccgcctcccgggttcaagcgattctcctgcttcagcctcttgagtagctgggattataggtgcctgccaccacacccggctaatttttgtattttttagtagagatgggggtttcaccatgttggtcaggctggtcttgaactcccgacctcaggtgatctgccctccttggcctcccaaagtgctgggattacaggcatgagccacctcactggcctagccccaacctttgatcttgggtttggcctccctagatttgggctggggagagcagatagagacatttaaggtctaatgagagaatttagattgctcctgccaagcccccagctgaagcagcttccttcacagaaaggaccagaatctgaggttaaacttctaatatatccccattctggttagatagtttccttgcctgcattctcagtgtgataaggagtgaaaactgtcaaagataacttcagttccaaacatgtctatgttctccttgctctcttttatgtacaagcagatcatacaaactaggacatcaactttatttcattttggtgttgggtccacccagaccctctctggtgagtttaatttggtccaccaaaaatcctatgggccataggttattccagtcagcgaagcttcttttagggaggaggaggagattgggaacctagggagcaaagttgcttggttctcccagtcttttctgctggggctgggagagccagcaggaatttgggcaagttttaatgtccctgctaacacaagagaaggtggcatgactcagggatgaattggggagcatagtgaatttggaaagctgaggcaatcactgcaattgacagtataacttgaggcactttttttttttttttaaatagagacaggttctctgtcacccaggctagagtgcagtggtgtggtcatagctcattgcagccttgaactcctgggctcaagccatcctcccttctgagcagctgggacttcagggaggcaccaccacacccagctaatttttgtatttatttatttttgtagagatgtggtctcaccatcttgcccaggctggtctcgaagtcctgggctcaagtgatcctcttgccttggccttccaaagtgctgggactgcacccagccaacttagggcacttttgcctcagtctttgcttgctgtcatgaataatagattgttggtgacttcagctgttataaagggaatgcattcctcaattcccagatttgtgctgttttattaaactgatttgaaattcacttcttcctttagacctcaaattgttcccttaattatgaaggcaaaggatggggtgagaagattctccccgggatgaggaaaaggtggaaggtgaacaagtctcaagtctctcagaagcagggctgccagatcagatacaggccttgttcaaatttggggttagaagacaagccctagattcctccagacaagttattcttagcgtctgtggaagacatcttaaaatgaaaggatgaagcatctgcaaatcttctccccgaaaaagtaaaatagaaagaaataagcttgctcttacctcaataatttctttctcttcaattcctctgcaggtcacctcctcccatctcaattttcctttctcttgtctgccctcattcccttggcaagtgaacattctctctcacccccattgcatctattaaagaagttaccagcttgtgcccctccccctcagcttgaagcagggtctgaagcagagtacacatgatcgggaaaaggaggcaggggttctgtgaaatgctttgagctctttcagagttgggggtgatggccaggtgtggcagctcaggcctgcaatcctagcactttgggaggccgaagcaggcagatcgttgaggccaggggttcgagaccagcctggccaacatggtgaaaccctgtctctactaaaaatacaaaaaaaattagccaggcccagtggtgcctgactgtggtcccagctactcaggaggctgaggtgagaggattgcttgaacctgggaggcagaggttgcagtgagctgagatcatgccaccgcactccaatctggatgacagagtaagaccctatctcaaaaaacaaaaacaaaacaaaaccctccccctcaaaaaaacagagttgggctaggcccacaattattagagaagagaaaggcagtgtgatgctggtggtatagagcagaaagcaggagaggcagctacggtaaggccaagcaaaacaagagggaatgggagacaaagatggaggggcaagacacagactgcaggggacaactttggggtcccttgcagaggaaggagtattcgccctgccctttttggggtgtggaaacctgagaagttttgagggtcctccttaaacctgtcccacctgcttccctttcctctcctgagctccgttgtttacagagatcactccctgaactcttgccctcctggacttgccctagcttcggccccaggcctccggccaggcagacaccctgacaggttacaaatgagcgtgggtgttggattgccccaagctcttgccctcaagttgtccggaggaggagagtcaatgggctctacctaagggcttctcttctagtcccatctgggtttggagtctgagagagtgaagaagacacatcctgtgtccctccgcaacagccacacagaacaaaaaggggcgagactccactcctcactctggagtcttagaattcagagcctcagggcctccaccccgattctcccactctctgaccaaactccctttatcaatcctagaaaaattactgaaatctggaggaatctttaagatttaactggtattaaatttatgcatttgaggtttggaaattttttttttttggaaggagatggagggtggtgaaggagagacaggtaggagggaaccaggagaatgcaggtctccactagttttaaacacttcaagaagagaataaaaaattcccctcctcttcaccccgctgtaaacatcacctggctgtgctcattgtggctctctagagagatatagggagttatttaagtctgagtgagtgagccagctacagctatggatggctagagagaggataaatacatctagagagatgagaggtagggaacgaatataaatatggagaaagatggacgaacagagagatggattgagacagagagaatataaagagaggctgagggagagaaatggatgtgtgaatgaggagagaacatttatgcaaagagagagagagggaagatggggcatttctcatccttttctccacatttctgtagtcctgccttgctccctgaaatgccaatttcccacccctggcttcatgaattcttcctctagattctagatcctgccccacacccttaggtgtttttgcaccaccttcccccacctccccaccacacagtcatccatttggcccaagataacatacctcacccggctgtcctagcccaccaccctaagacaaattggaagaaaggaacatggtttgggagttctgggcaaagtatggaagctggattccccacctccaggtccacagacttagggggaaggtttctctgaggggtgggaagagtgaggggcagctggcttgaatttgtccaaatctaataacccaggagcctattgaaggccttgggggttgggagggaaggaaagtcttgaatattctcctaactttttccccctctccctctggtcccttctttccaaaagtctttgaagaaagatgtttttgacgcttccatgtcgctctcagatggatgggctgcgggtgattgaagtgtctttgtcatgctaatgcttggggggtgatggatgggcgctggggctgccaaactctggcccgcttagcccattggcctgggagagatcacatgtgccccctcacccccactccctacccccttcctagggaagcgcttgcccaggcgagcgggtcaggccatggattcgagccccagcgctgtgacatactgccgaaaggttgtagggcaagagggtgtctcccccaaacgggccgaccctcctgcggccttgacgcatggactataataggatgaactccttcttagagtacccactctgtaaccggggacccagcgcctacagcgcccacagcgccccaacctcctttcccccaagctcggctcaggcggttgacagctatgcaagcgagggccgctacggtggggggctgtccagccctgcgtttcagcagaactccggctatcccgcccagcagccgccttcgaccctgggggtgcccttccccagctccgcgccctcggggtatgctcctgccgcctgcagccccagctacgggccttctcagtactaccctctgggtcaatcagaaggagacggaggctattttcatccctcgagctacggggcccagctagggggcttgtccgatggctacggagcaggtggagccggtccggggccatatcctccgcagcatcccccttatgggaacgagcagaccgcgagctttgcaccggcctatgctgatctcctctccgaggacaaggaaacaccctgcccttcagaacctaacacccccacggcccggaccttcgactggatgaaggttaagagaaacccacccaagacaggtagggctcagatgtggccaccccttctccggggcccaaagcatctctgcttcccctgcagtgacatgtcctgggtctgggctgggttcttctctttcagcggctctggtagacacaggtaagagcacaacctacgtctcaggtcaggtgaggtctccccacccagtatgtaaccggtcaccccaggagtaagtttccatacacaccccacttcctgatctgtgcacccagcacagacccaggacctggtgtgcatgggggatggaagtatggggaaggctgctccagacttggtgatcaccatgggggtacctggtggtccctgggaactttgacaactgtacttgggcagaatggcaaatggaggtccagagccagccccgggaggagggaagcggaaggagaaagaggtgagagaattgacctggcctttctccctgccccgcccctagcgaaggtgtcagagccaggcctgggctcgcccagtggcctccgcaccaacttcaccacaaggcagctgacagaactggaaaaggagttccatttcaacaagtacctgagccgggcccggagggtggagattgccgccaccctggagctcaatgaaacacaggtcaagatttggttccagaaccgacgaatgaagcagaagaagcgcgagcgagaggaaggtcgggtccccccagccccaccaggctgccccaaggaggcagctggagatgcctcagaccagtcgacatgcacctccccggaagcctcacccagctctgtcacctcctgaactgaacctagccaccaatggggcttccaggcactggagcgccccagtccagccctatcccaggctctccccaaccccaggcctgggcttcactggcctggggatcctctctagggctgaaatgccagtttagagctgcctgggggtgggaggggggatggggaaacatttttctcagacctgggtggctgggggccctacaggaccagaggcctgggaggcatggaacctgtcaaatgtagagggaagggcttctgcctttgatctggggatcagctcagtgtcaacatgtggtgggggtgggggccagcctcatcctcctggattcatcctcctttcccttccaacttgggtttattcggttcagtgccttcgagctttgaggagtctcctcacgcactcttatcctaactcccccttctaggcctgacacagaaccttaaattttcttgtgtgggaggtgtttgggtgcagccatattattatcaatgcttaatccagtcaccacagaccttacaatagcaccagctgccttgtgacagaccaaaaagccccccgcccccatctaaccccattagccctctcctggcatatttatattgcactaatgcagccttcagaggttgttttctgagacctgcctcctcacaccagcgacctcatcactatgtcaccaaagtgttttggaacttggtattccagagacttctggaacgccgtgcaaggcctgcccccagcaagccacaaccaggaaggtgcaggcacgcccccactagctcctcccctatttattgcctcctggaaaacccaggaccctcttccccatctccacccctacccctgggggcagcccagggagagccaggcacaatgagggctcccaacagctgcaaggatttatctgaacctttgagaaagaggaggagccatctaagtttctggaaacctgagccccaagtgagcccgggttctctctgtacctgcaactacctcatttcaataaagtctgtgttttcccttcttcctgcctgcttctgtttctccattcaggggtagaagaggcctcatactccgtgcaccgtggagaagaggtgaagaaagagtggccattggctggttgggctggaatgaactgagctttaagatctcagctggataaagagaaggacttactgggtgtggcctaagcaggattgggtcccaggcattcaggcttgacagttgtcagtcccttggttattgggagaatccagaaaagcatggaagaagtctgtggaatgaatgcaattcccagagatttttctttttcttttctttttttctttctttcttgctttctttctttctttttctttttctttttttttttttttttttttttttgagacagggtctggctctgtcgctcaggctggagtgcagttttttggtttgtgttttgttttttggttttgtgttttggtttttgtttgtttgtttgtttgagacagggtctcgctctgttgctcaggctggagtacagtggcataatctccgttcactgcaacctctgcctctcaggttcaagcgattctccacctcagtctccagagtagctgggaccacaggcgcacaccaccactcccggctgatttttgtatttttgtagagacagggttttgccatttcgcccaggatggtctccaactcccgggctcaagtgatctgcccgcctccgctttccaaagtgctgggattacaggcgtgagcccccgcgccgggtcagcccagagggtcttgagaggaagacgggaaagaagagaaacatctgtttggagaggacaaaaagagggtgttaaaaagaggaggaagtgtgggggaaggcgacgtgaactctaccccttcccttccccctcacctgcctccctcccgcccagagccaggcctggcttagactccagaggggtcgctgacaaactccaaattggcacacagcttaacacccccactcccaccccagcccagcgcccttccacccagccactcctcggggacgtcaggagtggctgcctgagtccggccgcagccggccagcctccgcaaggcctttccgcctgggctcaaggtgaaagccctgggtctccgggcactggacggcaggaaggaggtggccgcgaaggggcctagtggggggcagtgtgccgggcgggggaggggagaccgaggtctggagagggaggaagacgtcaggggcggggggagtccgaggatggtcgggggcctgacggcgggcggaggaggccgaggtaacctgggatcccgggctgacctttttacctcgaagcgcctctgggctttccaaacaagccgacagcgcgcccgcgggggcagctattgtctccgggccggtcccactggcaaacctttggtcggcggaggcggggggccggggctcaggaagctccgcggcgggcaacaaacctcgatcgctctctggccccgccgagccgtcgagatgccgcgggcctcggggatcgggccctggtttattgattccggttaccccgggagcccagatgcccaggggccaggatggaggcgggccagaccaaggcggggtgtcttctccacaccctctgatctatttaattcttggtctttcgagggaggcagccaaaaggactagaagcgtacgtgagaaacgctgagcatttgattcctaatgaaattggtgccattatatgagaggcaacgttatcaataattgtatagcccagctggagaggaagagaagtctgttgcaataagcagcctagctttctcagaggctgatgtcttgccctttgtcaaaacaaaaaaaaaaggaaagaaagaaaaagaaaaaattctattaactgcttttctgcatttaattgaaattgccaccaagcttgattccccaaagaggtcaccttgacagaagggagagagtgagtgtcggtggaaacaaaactccccttccttggagacattcagtgtgagccagtggagccttctgggttggggtatttgtggatcctccaaattttggacaagtgggcaagaaagcagggaggaggaggaaggtgcggtggtgagagcaaagcagaaccatgagtatggtggagcagggcctcagaggggccgacaagtccttggggaggattgatgaaagggccaggaggaaagaagaaggctgctggcccatttgatttttgatcatagcagagggagccaccagattcccccagggaagggtgagggacaaatcaattctctgttcacacaggggcaggctcaaaataatatccagtgaatgtaagccttccatctccttagatgcagagatcctgaccccttcctctctcctacttgcactctcctacttgaattccacttccaatctgaggccctagacaggcctacatgggagacattaggacaaaggagagaatggtaaactaacaaaaacattttgcccccattgagataaattgatagtcttcattgttttttgttttgttttgttttgtttttttgagacagggtatccctctgtcgcccaggctggagtgcagtggcctgatctcagcttgctgcagcttcgacctcttgggctcaagtgatcctcccacctcagcctcccaagtagctgggactacaggcgcatgccaccatgcctggctaatttttgtatctttttgttgtagagatggggtttcaccatgttgcctaggctggtcttgaactcctgagctcaagcaatctgcccgccttggcctcctaaagtgctgggagcctccgtgcccagcccttcattgttaaactttccagaatagatgccaaattgcttcactcatagacttcttcatgtctttcagattgctgtttttttcatagctctgggaaggagggtattatatttactaggaggtctgaaagtaatttttttttttttttttttgcaaaatttgaaagctgtccacccacacctccatttcccaaatgtcaaaaaatatctccagtttgaaaacaaaaagcttgagttttttgagtcttgactgtcttttttaaaaatttaatttaagagatggggtctcgctgtgttgttcaggctgctcttgaactcctgggtttaagggatcttcccaccttggccttccaaagtattaatactggaattacagacatgagccaccatgcctgcctagtcttcattcttcacaggagggagaattctctaggctggttgaaagtttgtcaagatttctgaggagccccccactccccacaaacccgggcatcaggtagggagccagtcaagtcttcactccacccaatcctctgcaccatctgtttctcagccagagtgtgaacttttcctctttcctttgccttttccctcagcgtttgttctcccattgtgaggccctttgatctcctgaacaagagagaaagaaaaagattttgaagaccctgaagctcttcttcttcttttttttttacggagtttcgctcttgttgcccaggctagtgtacaatggtgcgatctcggctcaccgcaacctctgcctcccaggttcaagcaattctcctgcctcagccttcctgagtagctgggattacaggaatgcgccatcatgcccggctaatttttgtatttttagtagagacggggtttctccatgttggtcaggctggtcttgaactcccgacctcaggtgatccacccgcctcagcctcccaaagtgctgggattacaggcgtgagccaccatgcctggccagccctgaagctcttctaactgttaatgcaagtttcttttttttcttttcctttttctttttttttgagatggagtttgcctcttatggcccaggctatgtgatctcggctcactgcaacctccacctcccaggttcaagtgattctcctgcctcagcctcccaagtaggagtagctgggattacaggcatgggccatcccgcccggctaattttgtatttttagtagagatggggtttctccatgttggtcaggctggtctcgaactcctgacctcaggtgatctgccggcctcagcctcccaaagtgctgggattacaggcgtgagccaacacgcctgcccggccaatgcaggtttctttgttgtgagcattccttgtgcagatagcaccgggctcctgggaaggagttggtgggatgatgtttagaagagagtgtggatggcaggcttggaggaatctctccagatgacagacaagggagatcaaaatgagccagagagcagcaccaaggagttgggggacatgtctaggatatctgggttcaaatccaagccctgcctctcactagccctgtggccttgggcaagttgcctaattccctgtgcccagtttcattatctacaaaatagggataacgacagtacctatttcatggggttgatgttgggattaaatgagttaatatgtgtaaaatgcttggaatggtcccacataaacaaagtgagcaataacaaattattatcattattaaaagggactgtgatcttcccttctatagtccccaatctcttccagggagtatcttgactatgcccacttctcacactcatagcttatttgatccctgataggtgtatggagctagagacaaatggaagggattgccctcttagcagctgagaacactgaaggttcatttggctgagaaacctttttgttctgttctcagcgtacccacctgtcgaagaggaaagttatcctggcctctcacactcattccctctcttctccattatagaagatggataagaagtctggaaggcagaaacttcaattccctgacttagggtggtggagagcaagggttctggagtataacttagtgttcagaatggtccccttttattagctggatgagctcatgtgagttgtttagtttccctgtgcttcagtttcttcagatatacaatgaaggatattgaataatacatgatatatatgagagatgcttagaacactgcctggtgtatggtgagtgttgagcagaggcttcctattttacatagttacataggacattttcctattactttcttacattgagttattcttggtcttggcatgatgaaagcagatgttgtccagccttggcccccctgcgctgtaccagcagacccagccagcaccataagcatgggacttgctgctagacagtaaaataattatgaatgaaaggtttcagaggagtccacagaatacaggctttacaggcttacagttaagtacagtattataatgagggatgtccttgacaagacagactcattgcgtaactcgggagggtattctcgttgtagtccacgaaattggcgccccctgcagttgtaccagattttttcccctgtgcctcagtcctggctctgaattccttgcatgactcaaccagagtattccagaggcttcagcttttgctatttctgtggctctcaaaatgcttcctataatcagagtgtatcctgggtgggacaaaagttggagatgtaaaatacttaatgtccattcctgggagaacatggaggctcaagtagctgcaggattcagctccaaggctgacctcctggccctcatccactgttattctcttcatcagaaaagaaatggatcagatgcttcagagaagaaataattttgtaggaagtcaggagacctaagtttagtctactaagacccttccttgtgtccttgggtaagtcacttaacctctctgggcctattttcccagtctttaatataagttaaattatcccactgcagctggactcattctttcctttgagggtagatgaagacttaggtaagaaagagtgtaaacttggtgggagatggaaatagttgggtggagaagcatcctgttggatgtattttactggcctagttagagctaattaaaatcacccctttccttcatcctctccagatcactggcctgagtccagagaattctgagccctgcagccctttctgcctggaggggaaccgagcagggagggagctgcaccaaacatgcgccctctgctccttagaggcctgatgctcccttcagtttactctggcttgacagctccatttcaacccccaccttggagatgaggcagctcaatatttactcagccagagaggtttgtccagaagcctgcctccccagcctcctcctgttggctctgctctgttgcccccacccccttccttcccggttcatagagagttcagccctgcaatggcttgcagccccctccactccccagccctgacagagccgcctgtcgggggactgctgaggccagaagagcgggggaagggcaccagtcagtcgtggggtcatgtcctggtctctccacccttactggaccagcagcctaggcctctagaagaagagaagactcagcaaatgattgtcttttgggggaagagtgcgtggagattggctaaaatggaactgtggggttggggacatgatccaggactgtaaaagcttcacatagctgtgtgcaatattataaaccatggtttatggtagagaaacttggtaaatttgtaacagtctgaactctttccaaagacacgaaaagagctaatacaataaataagtgacacttgggttttcagcaacacatctgaaaactgatctcttatctcctaacattctagaatgtaagatccatgaagacaggacttttttttttttttttccttagagacaaagtctcgctatgttgtccaggctagacttgaactcctgggctcaagccatcctctggccttagcctgctgagtagctgggactgtacaggtgtatgcctactgcacccggctaagcagggatttttgtttgttttgttccttgttccatttccagtgcctataacaatgcctggaacatagtagatgctcagtaaatatctgttaaataaacgaatattgaagcaaaattcttctgcctagaagacaagcaccccaaaaatggtgttctgaaatgatgttaggctgggcacagtggctcacgcctgtaatcccagcactttgggaggccaaggcgggcaaattgcctgaggtcaggagttcgagaccagtctagccaacatggtaaaacccactctctactaaaaatacaaaaaaaaaaaaaaaaaattagccgggcatggtggcatgcgcctgtaatcccagctactcaagaggctgaggcagaggagttgcttgaaccagcaaggtggaggttgcagtgagccgagatcacgccactgcactccagcctgggcgacagagtgagactctgtctcaaaaaaaaaaaaaaaaaaaagaaagaaatgaagaaacgatgttagctttagatgtttgattagtctaatagtgctatcataatgaatatgttaatatgaagatatttcagacagggttagagatggatgaggacttgggaggcattttctttctccctcccttctgttagaggaatttatctcaggcaaatgacaaagcattcactggatagctttagggcgagtctgatctaagggttctcccacagagtttttgtttgttcttttgttttgtttggcttcctttactttagcaagtgtaaacccaagaaaagactcaactttggaaatgtaaaggatttgaaggaccagctggatgtttctattggcagaaaatggacagagaagacctcctgcagggacacccaagagaagtgagcctgtctcaacccttcctttccatcttcccacttcccacagaagctagtgtcagattcccttctccaccactataccagggtttggtttcatcttttccaaaaacatctgggttgtcttcccccttctaaggtgagtaaggtgaattcacacagggctatgggtttagattttttgggatcagaaaggggacaacattactggaactcaagggcaaggatggccacctgttggaagcttcacagagcccttgggaagatcagtctggcatggtcggttaccatcagtggaaattgttgagaattgatgacatcttcttgcttccttcttccgcacatggatctacacacatgcatcctgatgccacagaaacaggacctggaacctgacttgagtcaggcagagggaaggagaaaactggcaaggaaaaggaaaaggagaaaaaagagggtcacctgcctgggcatggtggttcacgcctgtaatcccaacactttgggaggtcgaggcagatggaccacctgaggtcgggagttcaagaccagcctgaccaacatggagaaaccctgcctctaataaaaatacaaaatcagccagatgtggtggcgcatgcctgtaatcccagctactcgggaggctgaggcaggagaatcacttgaacgtgggaggcggaggttgtggtgagccaagattgagcctgggcaacaagagcgaaactccgtctcaaaaaaaaaaaaaagaaaaaaaagatcacctgcctgttccaccctggggttagatttctacattaggacccccctcctagggagaatgaagctaggagagagaattcctcacttgaaggaaaatgaaggttcaagagtccagggcaaggatctaataattttggccagagttctctgattcctcatttcagaccagctcaaagcttctgccaggagctgtcacttttcaagctggaaagtctgaagaggcaaaatgtgtacaacaagctgtgcagggggatgcctttgaggtgtatcttcctggaagcacagcaggaagatagatggcaggaagagctacctcatgttcttctcaggcccagaacttcctctcttccgtcacctccagttactccactatctctcctattcacactcagtcttcttccaaaactcaatttttttttttttgagacagagacctgctctcctaggctggagtgcagtgacgcgatatcagctcagtgcaacctccaacctcctggattcaagtgattctctgcctcagcctcctgagtagctgggattacaggcgcctgccaccacagccaactaatttttgtatttttagtagagatggggtttcgccatcttggccaggctggtcttgaactcctggccttgtgatccacctgcctcggccttccaacatgctgggattacaggtgtgagccaccacgcctggctttttttttgtttgtttgtttttgagacagtcttgctctgtttcccaggctggagtgcagtggcaccatctcagctcaatgcaacctctgcctcctgggttcaagtgattctcatgcctcaacctcctgagtagctgggaccacgggtgtgagccatcatacctggcaaatttttgtaattttttagtagagacagggtttcaccatgatgtccaggctagtcttgagctcctggcctcaagtgatccacctgcctcagcctcccaaagtgctgggattataggcatgagccactgtgcccagccccaaaactcaattttcaatccccacacttgagtagggcaggagagacgctggactagaaagagtctgagcaaagcaggaaggcgtccctggaggataggtgggctgggatggggcaaggcctgaatccagcatggggtctccattcagaacactcaaatccagtaatctggatgttggaaatgggaattacaaaaaatgactttgaaagactctgagtgcttgcaggttcccacccacagttcgcacgttttacacccattgaaaacccattgaaatccacacctggacacattgctgcagacttgctggcctcccttacacatttgcagacctatctgtaagcaagcattgttgccaggcatggtggctgatgcttgtaatcccagtactttgggaggccgatgtgggtggatcacctgaagtcaggagttcgagaccaacctggccaacatggcgaaaccctgtctctactaaaaatacaaaaattagctgggtgtggtggtgcacacctgtaatcctagctacttgggaggctgaggcagggagaattgcttgaacctgggaggcggaggttgccatgagctgagatcacaccactgcaccccagcctgggcaacagagcaagactccatctcaaaatcaaacaaacaagcaaacaaatgaaaacacaagcattgttccttgtgttctcagtcagaaaacaaactgaccttgtacacagttttgcagacctggtttctgcataaccagagaaagctggcgagggagacaagtattgttaattatgagaaaacagtctctttctcttccaccctctggagtttctatttgagcctcaacctcaacctcgacctcctgggctcaagctaatcctcctgcctcagcctcccaagttgctgggactacaggcatgcaccaccacacccgagtaatttttttctactttttgtggatatgggctctcactatgttgcttaggctggtcttgaactcctgggctcaagtgatcctcctgccttggcctcccaaagcattgggattacaggcatgagccacatctgacctctttatttttttcaaaatcaaaggaatatgggagactggaaaaaaattcaatgcagattttgctttattctttttcttcctctagtcctcttgtacacaaatctccagacaaaaacaatgccttaggtttccatttaatttaatagataccataaacctctttttcagtattacctctgcattgggcaggcgctgagttgctctcaaagtcggattcctcccttagtaaacaagaaaatacccacttccctctttttatccttcccagaacctttaagtttaattctcagttttgtttttggtgacgagtgtaaatgtttgcccagtccctgagaaataactcagattcttctcttgggtcatgtggaaacctagaggagccctcttccatcctctcctttcaattgaggcaggctttaaatctcagctggaggctggttgcagtggctcacacctgtaaacccaacacttttggaagccaaggtgggaggaccccttgaacccaggagctcaagaccagcctgagcaacatagggagactgtctctataaaaaaatgaacaaaattagccaggcatggtagtgcatacctgtagctactcaggaggctgatgtggaagatcgcttgagcccaggaggcagtctgcagtgagccaagatagcgccactgcactccagcctgggcaacagagtgagaccctgtctcaaaaaacaagaagactgagatggtgggtttttggttttttgtttgttttcttttttttttttttttttgagacggagtctcgctctgtcactcaggctggagtgcagtggtacaatctcagctcactgcaacctccacctcctggattcaagcaattctccctgcctcagcctcccaagtagctgagattacaggcacccgccaccatgcctggctaatttttgtatttcttagtagagacggggtttcttcatgttggccaggctggtctcgaactcctgacctcaagtgatctgccttcctcagcctcccaaagtgctgggattataagcatgagccactgtgcctggcagagatcactatttataaggaagactcccataatgttaggctgctgtaaatgatagaatggttctttatatggaatgggagtttgccttcttggcacttacacccattgattctacttctttgttgccctctggagccaacacaataactcttaactccttttccctacgctacctctccaaatatttgaagacagctgtcctgtgtgcccataggtctttccctctgttgagcaatatacattctcaatttcttcatttgttcctcctgagacctgatttccagatctttcctcactctgttcttccttccttagttaatatattctataaaatgaggtatccagaactgaatagaaaatattgtataatcagataaattctaatacagtgagaatactatatcccttgagctagcactgtgtttctattgacataagcaggatagccggggcagggaaggactatggggcaggctgggagtgagaaatgagaggaattctctttctcttgcaaattgtgtccatctacttgagctctggggctgcatcagtcactgataccttaatccatacaaatctccaagctcagaaagggagctgccacatcagcagccatttgtggcaagcaaacatttgccgagtagaatctgtaatttatgagaagggaaaggagcattagtgcagagaaacaatgtggacaggtgagaaggagaggccctgttatctcaagggaaggaagtgcagatgacctaggctagggaagctaactatttccactcctcttttccattgctgttcaggtaattccttcattcctccctccctcccttcctccctccttctctctcttcctccctccctcctttcctccctccttctctctcttcctccctccctcctttcctccctccttctctctcttcctccctcccttccttctttccttccttccttcctccctcccttttccttccttccttccttcctttttccttccttcttcctctctttctttctttcctctctctctcttttcttttcttttcttttttagaaacagggtctagctctgttgcccgtgctggggtatagtgatgccatcatagctcactgcagcctcaaactcctgggctcaagagatctcaagggatcctcacaagttagcctcccaagtagctgggactacaggtgtgtgtcaccacgcttgacgaatttatttcattttttttagagacagagcctcactaagttgcccaggctggtctggaactcctcggctcaagcaatcctccagccacagcctcctgagtcactgggattacagacatgagctacgatgcctgactatctatttctttcatgaaactgtatccccaccttcctccttggtggcagctgttactagctttgttgtcgttattgttattgacatttatctagcactttgctattagcgcttatttctcactacatctctgggaggttagtatgatcattattctcactttacatatgaagagcccaaggcttggagaaaataagtaatgtattccagatcatatatctgaaaagcaacatataattttctttttctgcctctggtcctcaagaatttatatacatttacatatgttgaatatgcagtacatttaggatgatggcctctctttctccctactcctcaacactacccctaggtatcagatcatcaagcattgtttagcgtcttaggtcactccctcctctttttccttttggaaaagaaaaatcaagcagactgcccaaatagccaagatcatcaggttcagcaagagaatacccctctctgtgtaaccctttaagatgagaatcactgcaaatagagtccaagtcagacactgactcagattttgcgaaaacctctaatagtccatggcttggtggtgatgggtagttttgctttagggatcttccgcttggggtggtcttctccatgtttggaaagatattgtttgaacgtgactgatcttgcagttgaaggttccagtttctataccacagcaagcctgggaaaatgagaagggggttattaaaatgaatttgagaagcgttttctttgaggacatctctttctaaatccttccaatgggcatggaatgctatgactatccagatagtgggagtcatgatacagggaggagtaagaagtgggggctttcagtcccagagttagagaccacagcattgcccagtttcctgccctcacatgaatcagcctccctgcacatcgcttcctcccccaccttgttaaaaaccccatcatggtagatatatgggtcagagctttgaagactttggggaataagcagatcaaaagtccaaatgtccaactcctttcacctgtgaatctcccatcattggactgcagagccagctgcaaggcagatggaaggcagaaacctggaggctacaagcagcttcccatcctataactcagcccaggtcctggggaacctgtagagggtcctgacagcagaattaacatgatggggagaggcaggcagaggagaggaaagggacacagagccagattaggggcagtagataacttgggtctggcatctgctcttctgctttatgcaaatgttgctttaaccccaaagaagccacattctgagactagcttgttgtttatttaaaaatatgcagactttgcagcccatctggaaagctctgaggggctcctgatacaggcatctcgtcatatcccagcagcagggcagtaaatcgagaacatgcagaaacatcaaaaaagcccttccttgatcagatgttgtaaagaatttgccaagtctgcagataaggagatcactggagtgcctgtgtgagatcctcagagaaagcccatttattttctccttcccattaccttctgctctctagatgagcaaggcatgcacaagaagggggaggtgggtgagccactggtagcgaggccacgcggtccacatcacatatggcccatcctcaccaagtgctctgagggaacagtgtgggaggatcttgcctttccttatcagttttgaaatacaaggcacagagcctcagtggctgccaaggtaaaaggctatcacagagcaaatacctgaataggagagacatatttgagaaagaacagataacattttcaacatatttagagatcctagctctcgtctagcttcagtatgtctttacctgagcttttaccagcaagaggtgtcaaacagattaaatagtttatgggaaggcaggatccaggcaccttacaagttcttttttcatatgttggagccggcctggagacaaccagctgaaataatgggtcttggtaattttcacaagctaagggactccaaatctgcaatatttcacttactttgcagatagtcactcagccccctgaccaaggggaatatcaatttttgccgagaatcagtaaaaatcattaaacgacagtgagagtataagggggtggggtgggatttacagcttctttttataagaccaagttaaagcctcatgagtctcctgcactttcactttcacctctcccatcatcagccctgattggtagctacagaaatggaggcccacggaatttcaataagctggaggcgatatcagaggaaaccgagagctctccacacatgacaagctttcagggagtgtcatggcgagagagccaagataagcccattaaagggcagagtgggcaggtaggacgtactgtgtggggtcaaaaaatctgaaatctacaatgaggaagagaccaattccaggttgtatctgcaaatcttaaaatgcaaggatacctgggaggagagaaaattctaagaacgaaaagatattgggttttaggagacaggctctgaaaatgggaagaagaagataaacagaaggttggtgcttaagtaactctctcctttaagaactgtgacccatgttcctaatgtttctggcttttcatatttccttgagattcagtcttacttggttacttgtccctctaaaacatggcactcttggccaggcgtggtggctcacacctgtaatctttgggaggctgaggcaggtgtatcccctgaggtcaggagttcaagaccagcctggtcaacatggtgaactcctgtctctactaaaaatacaaaaattagcccggtgtggtggcatgcgcctgtaatcccagctacttgggaggctaaggcaggagaatcacttgaacctgggaggcagaagatgcagtgagtcgagattgtgccacagcaccccagcctgggagacagagactctgtctcaaaacaaaaacaaaacagaacaacaacaaaagtggcactctttctatcttgatttttaataagtcctttctgttcttttctttttttttttgagttggagtttcactctgttgcccaggctggagtgcagtggcgcgatctcggctcactgcaagctccgcctcccgagttcacgccaatctcctgcctcagcctcccgagtagctgggactacaggcgcccgccaccacgcccggctcattttttgtatttttagtagagacggggtttcaccgtgttagccaggatggtctcgatctccgacctcctgatcagtccgactcagcctcccagagtgttaggattacaggcgtgagccaccgctccaagcccaataagtcctttcatttgtctgaatgatcttctactcattctctgtctagaaaatctttatcatcccagatgcagttcaaatgtcactttcttgcagaagccttccctgccattccaaacagcatgaaactctctccttgtttgctctctctgtgccatggtcagcccactgctgggcacatagcacattgctgttttcacctgttaatacgtctattcatttttgtatccttagtatctaggaaaatatgtatcttgtaagtatatatgaactgttgaaaagataaatgaatgaatacgacggtaaagatgagacagattggacagttcgcatagatggtataatattatagctgacagatacagcaaatctattcacttttttggttttctctcttcagataaagtaaagatcttcaagatttaaatgacaaggctaaccatatttactttttgccataactccaagaagcaaagtattatcataattctcatttacatccaatagaattgacacttacagaggataagtaacctgtccatgctcatactaaaatattatatctctagcagtcaggcgcagtggctcacgcctgtcattccagcactttgggaggccgaggtgggtggatcacttgagggcaggagttcgagcccagcctggccaacatgatgaaaccccatctttactaaaaatacaaaaattagccgggtgctgtggcacgcacctgtaatcccagctactcaggaagctgaggcatgagaatcatttgaacctaggaggcacaggttacagtgagccaagattgcaccactacactccagctgaggcaacagagtgagtctctgtctcaaaaaaaatttttttaaataaaaactaaaatatatttctagtaatacagctcatggttactttcatgttttgttttgctgactttttttgcggggagcagacacccggagttgactcatactgaaacatcttttttttttttttttttggcacatatggtggcttggttttattttctcaatattgaaagaatagtacaatgaatgctatacatccactgcctgaaatccattgttgccattttgccagtttggctgtatgttattatgcaagcactcattcttccatccaagcatttcaaaataacttgtacctcaaccttgactttcagcacacatctcctaagaataagggcattgctcaatataaccacagtgccattgtcatacctaaaaaattagcaataaaacccagtccatatcaaatttctctaatgttctccgaatgttttttaaaattgtgattaaatacacaaaacataaaatttaccatcttaatcatttttaatgtacagttcagtggtgtcaagtatattgacattattgtgcaaccaatctccagagttcttttcatcctgaaaaactggagctctatacccattacacaacaactgcccattcaccggtccccctggtccctgtaaaccaccatgctactttctgtctctgtgaatttgattattctaggtgccttatataagtggaatcacacagtttttgtcttttgtgcctggcttattttacttagcataatgtccagattcatccatattgtagtatgtgtcagaatttccttcctttttagggctgaataatattccattgtatggctataccacattttgtttttccatttatccactgatggacacttggattgcttccatcttttggtattgtgaatgctgttactatgaacatgagactcagctttcagttatttggggtatacacgcagaagtggaatttctagattatatagaaatgctatttttaattttttgaggaactgtcatagtgttttccataatggctataaccatcttacattctcactaagacttcacaaggattccactttctccacatctatgccatctattaattattattattattatttatttattttttttgagatggagtctcactcttgtccaggctggtgtgcagtggcatgatctcggctcactgcaaccttggcttcccgggttcaagcaattctcctgtctcggcctcccgagtagctgggactacaggcacatgccaccatgcccagctaatttttgtatgtttagtagagacagagtttcaccatactggtcaggctggtctcaaactcctgacctcaggtgatccacccaccttggccttccaaagtgctggaattacaggcatgagccacagcacctcgccttgtttttgttgttgttgttgttgttgttgttttgttttttttgttgttgttgtttttgatacagagttttgctcttgttgctcaggctggagtgcaatggcgcgatctcagctcactgcaacctccgcctcccaggttcaagtgattctcctacctcagcctcccaagtagctgggactgcaggcgcctgccaccacgcacagctaattttttgtatttttagtagagacgggttttcaccatgttggccaggctggtctcgaactcctgacctcaggcaatccacccgccttggcctcccaaagtgctgggattacaggcctgagccaccatgcctggcctttttttttttttttttttttaatggtagccaccctaattggtgtgaggtgatattgtggttttgatttggatctccctaatgattagtgatgttgaccatcttttcatgtgcttatcggtcatttgtatatcttctttggagaaatgtctattcaagtcctttactcatttttaattgaattgtttggggcttttgttgttgttgaattgtaggacttctttatatattctggacattaaccccttatcagatatgtaatttgcaaatattttcttccattctgcagattgcctttttaccctgttgactgtgtcctttgatggagcaatgactttttttttttttttttttttgagacggagtctcactctgtcgccaggctggagtgcagtgaggccatctcagctcgctgcaacctctgcctcatgggttgaagcgattctcctgcctcagcctcttaagtagctggggctacaggtgcccaccaccatgcccagctaatttttgtatttttagtagatatggggtttcaccatgttggccaggatggtcttgatctcttgacctcgtgatctgcccgctttggcctcccaaagcggcatgagccatcgcgcccggccaacaatgactttttgaactcaaaatagcttatctttatcccaactaaacttcatggctttgcatgttttcatccctgcctacaatgccctcttaccttcctctggtttatttagataacttctatgcattctctaagacccattccaagtgttgcttccttccgccctgagttaggagcccttcccctgtattctaatagtgctccacatgcacacctgtaccatggcttttacaccagtgcatttataatcccctggttaccttgaagacagggatcatcttgttagtccttgttttccccagtgcctagtacagtgtttggctcatagatgcctattgaactaacaactgctatttttagctgaacactatgaactagagagatccagaggaggtcagccagaacagaggagagtatgatggtgattacaaagcatatgtataatgttttataataatcaaataatgtaggcatatatcatctcatttaatcctttcaaccataggtaagttatatacatgtggtctccacattatggagaaagaaagtaagcctcggggaagttaaatgactgggtgaaaaggtcacccagctgaaaactgatggaattagaacttgaatccaaggccgggtgcagtggcttactcctgtaatcccagcactttgggaggccaaagcaagccgatcacctgaggtcgggagtttgagaccagcctgaccaacatggagaaaccccatctttactaaaaatacaaaattagcaggacatagtggcgcacacctgtaatcccagctacttggaaggctgaggcaggagaattgcttgaacccgggaggtggacattgtggtgagccaagatcgcgccattgcactccagcctgggcaacaagagcaaaacaccatctcaaaaaaaaaaaaaaaaagaacctgaatccaggtcttttcagtcccagttaattgttatttccctgcataaggtgttgttgaagtaacctgaaatgcttactttagaggagaaaagactcagtgcagacattataaatattttcatagatttgaagggatgtcacatgaggttcttgagagggcttccattcatcccattttgcttctttgagtgaaattagaaaatgaatagaaaaaaaagttttgtttgtttttgttttgttttcttaaataaaaactgtccaaaattgagctgggcttccaaatgaggtccctaccacttgagctgttaaagcatcagtgtatgaccatccatcagtgatatagtaggggagagtcttgggtggaagcttggaccagatgccctgagatctctcagtgactctaggattccttttgggttttccctataccttgtcatgtgaacatctacatgcctggcttaaccacaactaccaccaaaaatgggcatcgcctttttgcagagaagtggatagtgccaggcgttgtggcttatgcctatactcccagctttttgggagactgaggcaggtgggttgcttgagtccaggagtttgagaccagcctgggcaatggggcaagaccccgtctctaaacaaattacaaaaattagctgggtgtggtggtgtgcaactatagtcccagctactcaagaggctgaggtggaaggatcacttgagcccaggaggttgagtttgcaataagccaaatcatgccactgcactcaagcctgggtgacagagtgagaccctctttcaaaaaaaaagagggagagaagtggatagtatcttctcctagaagccgataaagaaaacaactctgaagtggaagaaataaagactgcttcccaccagcaaacgtattctttccagtgatggaaccaggaagtcaagatctctgaaattcaaaggcatgaccaaatgaaaatacggggaacagctgaattaagcagaggccagaatagacctctgagtaagacttcccttctgcaggccacatctttctcctggagccactttggagacttggttatggattctttctggggaaaaggagaagtcagaaacctggagagtcagagtgggaatcaaattcttaggacataacccagttgtcaaatgtccttcatactcctttgacagcatgaagtcaaaggcttccaggagatcaggagccctgactgctcagggcaacactgaacccctgagaggaatgggtattgaggaacagtgatgtctgcacagtgaggatttaataatccagacgcatattgtgcttactcttctgtgaactctgaccttcctttcaggtccctggactccatgttcattaaaaactggaatcaccagtgacctggaccctagtgcactgacactgccttggtcctttcatttctgctctcgccctcatgtgctccacggatgcaaaacagctggggctcagtagtgagaaaatcactggctgagaaatccatctacagcggggacctcagtgtggagctacgggatgggtaaaggacagctggaaataggaggctttgccctgctgagcaggacaatattgttttcatgggccaccaggaggcagaggttagggcaaagatgaaattctaaaattctcttctctgtaagggaagaaaaataaggaagaaatagcatctctctggctgtagtcaaaatagttttcggaccaacctttgggtcaggcattcacctatagtctcctcttgcagctttaaattctgtatctgagacttacctccaaattctttttgaaagggtgatttggcttgtgttcacaacagctgctttttcaaaatataattttcaggtcttgcccactggctctgcagttctcactctgaaccttcacggagatataggactggagacttttgacatgatttgacattttccaggccttgacattgaacaaggacatgtggtatgagaagtgactctcctggaccaacaggatgtgcatactaggttggagcaggatgagtcatccattctgtctggcccagttgccttagtgaccacatttgcaatgtgacaagagaagctcaatggtgcaacctaaaattgaagagttgggttttctcttttttttttggcatgacctaatacttaacaataacctcaataaatgtttgttgagccacacctggtgctgtacacagtggcaggtgtttacatagtgcttcctttttgagcctctttcacagacatctcactgcctgtacactttttgtatgtgtagccagtgttatcaattttattttacagatgaaagatcttcattttactgaggatcaaaagaattaagtgacctgcccaaggtcatacatttaatcaaaggtgaaacacattttcagactctaaatcccgaattccctctcctataagaaaatacctacccttgtgaccaaaataactagattaaaatggactagatccatctagagcagtttgcatgatataaaagtggccttgattgataattgttgaagctgggtgttgttgggtatatggaagttcattatattcttttatttatgtatatgtttgaatttttctgtaataaacttttttcaaaaaagaataaatctgttttctgtgctgaaatctgcccctttgaaactttcttccataaatcctgtctccaagttttattttaatggttgagtctcattactgacaatgatggccattaactgagagtttagtgtatcaggtgctctgataagtgctttcttcacatgtcttagtgtttaaccctcacaaccagcctgtgacttaggtactagtatccttgttctacagataaggaaactgaagctcagaggggtcacataacatgcccaagatcacacccttagtaaatatcagagctgagacttgaactcaggtgtgtccagtcccaaagcatcctccgccccttttttttttttgtgagacagagtcttgctctgtcacccagactggagtgtagtggtgtgatcttggctcactgcaacctctgcctcctgggttcacgtgattctcatgtctcagcctcccaagtagctgggattataggcatgtgtcaccatgcctggataatttttgtattttgggtagagacggggttttgccatattggccaggtttgtctcgaactgctggcctcaagtgatccaccccctcttggcctcccaaagtgctgggattacaggtgtgagccaccgtgcccaacccaaagtctcatctttaactatttccactgcttcacttccttacaaccagaggggaacatctttctcttggaggcaatactgtttgaaatgtgctttcatttgcctatcttacaagaaacttgaaacacggaattggagacattttcatcccccctgctggaaaaataagaattgtaaacagaatagctctttcattcagccaggcttgtctgtccccagctccctgaggggattcaagcacttaactttgttttgtaatctcaggttgaggaacctggcatccatctaccacctgagcacaggggtcatggtaattttttcagctcctgcaagcgaaacctctgtcaaaggagtaggggaggcaggtggagtggggtggggagaagagaactacctttgaaagggatttaggttccatttctcttcatggatttatagagcactaacttttggtgggcaacctctttgcccttaattggccctaacctggccaaggtgaaaggacaccaaaaatttgaggtgggagctaggatgcccccaccttaagtcctgcatgattgcagccaagcccagcactggctaggtctctcccttctgtagcagcagccttctcaaactagtgggaagagctttgggctgttatctgatgcagtatcaaatatttagctggagaactttcagagtgcttcagggacgcagggaactgtttagatatcagattctctcctgccaggtcaggcaaaccccctggtgacgaatggctgtgtttcctcaagcatccttcccagcagtgagctatcttgtgcgccctttaactctctgtccagctgagaggccccaggcctgcagaagctgttcttctaatcctcatctcaggctcaagctgctgcagtgggcgatggaagattgtttacagaagatgaaggctcactgcctcgcacctggtttctgtctggcccacactgatggggatgaaggatacttcatttatctcagcctctcttctcaggcagctcctgctgtcatggcaagcttgggccagtgtttcattccctgataagcagctttctaaagagccggggagagccacttacgggctttacatacctctcttgagcccccatcccagttaccaggggcagcagggctggatggggtgagggctgctgaggttttatatcaaggggtcaagtgagacttgctttccagctatctggtgtgcagggtgtttcgctctttctctatttacagattttggaaacaggtagtcaaataattcatctgtccttcttgcctttggagaattaagagagaaggggtgtctgcttggcagagggcatcagagacaaaccttgttttatgatggagggggacggatagacgaagagaaaggcccactgggacagaagtagcattctagaaggatgcacttggaagtggagagtgaggaagccccctccctaaaagcctctaaagataaagttaatgataacaacatttatggggtgcttaccatgcacccaagccctgtgctaagaacttgatctcatttaatcccaagaaataaatactcttattatatccatttaacagatgaggaaatagaggcttagagggattaagtatacagcttgtaagatgacaagctgaaatgtaaacgtggaatagcctggctccagggccccaaacccttaacaactgtgctctagtagagagacataccatgggcagctgagtctgagggtacagagttctgtggactccggtttgagtttagagttgctcagcggaccgagtgtcaaactgtccctagccctttccttatgcagtctcacaacatcaaatcctgctacttacagaggtccaggatcctgacacatccactcctcccctttctaccccttgagaggcaagcagttatgaacttgaggcaaggaacaattgccctctgagggaggcttcttcagtttcttctaaaatttccttgttgagttagcaacaataaatgttttccacatgtccagccacgctgggcatggtggctcatgcctgtaatcccagcactttgggaggccaaggtgagaggattgcttgagcccaggagttctagaccagcctgggcaacatagtgagatctcgtttctacaaaataaacaaacaaaacccaaacacttccagccaagaaactcaaaaagtggcacagcgacccccttcacagtcttactcttcctaggtctttgccagtgcaggctttgagcccagccaccttctggccaaactgttcactctccctcagccacaagtctaccctccaatgtaggcatgcactgtggctggtttctctcctgggggaaaagagggctgtgggggcttacagaccagtgtgagatctctacctgcttttgcttgatgacatcctgggtgcttgaacctggagtgaggcagcaactctaaggggtcatggatcaagcagatagcaaagggtaagtgtgaattggaccctcagagaagctgaatttggagatgggctttgagggtttggggctgacagcttttggagttttgaagaggcagatttccattaaaaaaacatttctcctttacttggctaaatccacttgctgtctcccaccttcctgggaaaagtcaataaccctttggaaatgaattc

SEQ ID NO: 137 - protein, 933 aa, Homo sapiens [sequence omitted]

SEQ ID NO: 138 - DNA, 179199 bp, Homo sapiens
gaattcagtggagctggatagtctaataaattgcatcacacacctttaaggatgtttgcagcttgacttcttactgctccattgagctgtatgtaatctcgtgttccattgtaccaaccccaggtcgtagtctctggatggccaagaaacacctgtctccttcaccttaacaaaacacatggccatagaactggacttttatccctttggccagaagattacaaagaataatttttttttctgaattggaatttttttttcaataccgcacttgaggtatcaggcacttgtgcttgggaaaaagagattgtatagactcttagagcgtccctaaggtgacagtccatttttcataatcatctatgatattcgtttgttgaaattttattacttttgtaatttaattcaatttatcccattttattgctgttcagggtagcgttaccatggttgcctttctcttccttctggataaggatgtttcttcttttattatgagcgtgatggcttatagattaaagcagcctgctcaatataactgtctcctttggagtcaaccttctttgagcccatctctactcttgtagaattttcatgaagataaatattggcagtgatttatgaagcatttatgtgagtaatcaggttccaacccttatcttctgcttaaagattaaggattttattcagaaatgcttctctgtaccagaaatcatagaaatgagcaaataacaatgaaagttggttagtaatatcttttgtgaagatatagattaagaacatattcattagctgcaaatggactttaaaacataaagatgtcaggagacccctttctaaagctgaagtcattcatcattttgagaaatcctggaaatattttagggaataactgagttgggcagtgagtccaaaaggacatgagcaggtgagaagacaggaagatgtcaggaaggcatgcctaatacggaggctgccacttagctaaattaaaatttagaacccatgaatgtgggcaccgataggtcatgaagagatttggtagcaaatgacactgacataaataattcatataacttgcttgcttttaaaggtagaaggaatggatttgtagttaaatgttttttaaaataaaagattaccttcttttttctataaaaatatagactgttttttgaggctcataagtgcttggtctccaaaccttcctttcctctgcatctgggagcaagagtggaattattataattccaaagattgtgaagacccagctcagcagctacagacagctgggtacagatctgccctttcttggggaaagaggaaagtatagttagctaatcctgcttgccaagtctggctgatgtctcatgatcctgccttcttcggttgacacaagctttttaaaaaatgtcattttgatccagcttctctatttttttaaccacccactggattgtaaactccttaaagttttgcctcaatctttagtaaattgtaggaatagctttcctggaaatggctccagtgatttcttaatgtttggtctcacttagacctcatctgcttggtggcattttttaaagtgttggccacagcctacctgggtcagaccccacggacattttttaaaatgtatatccctgggcctactttattctgaacctcgggagggtgggtgctatgactccaccttcaacatgtgattcaaggctcctggtgatactgatgccttgtgaagtttgaggactctcactgccctggccagagccacagtcatctctcacctggaacattgtagtggcctcctacttactacctctgtttctacccttactctctatggctgtggatgggacatgggcattcagaattataagattatcataggataatggaatggacagccaggttgagtgcactgttcatggcctatgctctatcctgcagccagaatgatccttttacattatgtatcagctcatgtcagacttctactcaatctctcctgaaaaaaaaggaaaagtggcttgcagggatccacatgatgtggcacccattgtatctccaagttaatttcctgcaacctctgctaggtgactgcattccattaacacgagccccttcaatatccctggagcttccctgtcgcagggaccttgtacctttggttcccttcacctggaatgctctttcccattagctatatggcttgttccttctcccccactccattttgtctagatctttgatcatatgccatcttatcaggaagaccttcccatcttccttttctaaaaatgcagcccccatcactctccatcaccttactttgcattattttctttatcagcatttaattcaacaaatacataaacattctctatgaatttgccatttattatgtttccctcccaagaaaatgtgaagtccctgagggcagaatttgttttgtttacccatggtagccctggcaccaagaatggtccctggcacatagtagtcactcatgagttacacgtgatagatgacaaactactcctcttggattctctcagaaacacaagctttcttcattattgaagggagatgtgcaggcagcagcagcctattttctgtctgtgcaattgccccatataactctcctggtagccacttccttcccctaattttaatggctgcagaaaggagaaaatttgattcattatctttacagactatctatcttcaccaaaggttaaaaagaagggtacccctctcagtttctgatagggattgcttctatgtgagtaaaaagcataatcggttttttgaaaaaatctggatgagttttttgtttgttccattggggaagttttatactaagtagattaaggtaagtgactttgaactttcaaagtctacatcttaacattttattaagcttaattgggtttgtagaacatttaaagaccatccaaacttaagtgggagatcaaaatgagcgaagaggctgatgcagacttttttttttttcacccctgcctttgagctgcattaatgaaagtggtgcgctccatgcctgcagatgatgagcatgaaagcctggctttccggggagctctggtgtattccagaactatgtcacagcaccttcccatggttgtctgtgccgtgcacctggccttcaggaccaccccagatttggctctgcttcacactccttgcatctgaaaagtagctgggctcaaggcagaccactgaaagtttgttacgtggtgcttcctagggaagaaactccagttgttggaaataaaatccattagggtacagaatctgttaatgatggaaattaggagcaatttgactgttgttcacagaggttttgctctcagttaaatgagcagtagcgtaaggcagtactaactggaatatgcaaggccaggacttaatttccacatgtcatctcttttttgtgtttgattttcactgaaacatttattcttcctatgttgtaacagaattgttcaggaagtagcaatgtcattactttcttttcacttaaaatgatctttaattattaaagcaatgctagtttgtaaaatggtataaaatttatgaagtaaaaagtatgaggccacttttagaaaaaaatagaattttgtgctacacaaaacccacaacttgctttttacctttaccagtacatcatggatgaggacatagctgctgggtagcccactacacgaatgtaccatgaacttgtagccagtcagctatcaataaagacttagaatttaacagtttttgacctttacaagtaatgaaggtgaacatccttgtacttttaattgtgtatttttgaaaatgtctaaatctgaattctagggcttccagaaaatatgtactctcttctaccacttctgtcctttttgttacctcttagtccccataagcattttatttgttattccagctataagataaatgcctgagggtggaattactgtgtgaaaaaaaaacctgcaaatataaaatgctattattaaatttctctccaaaatatttcctactttaaagtaaaatctcttttcttctgtggtcagttgaaaggcattactgtgagagatgtaggacgtgaacccagcatcctttgattatgtttattttgtaggcagacatgcaacaagtcattttcatgccatttctgctcagataaggaggtcagtgtactgggagccaaggactacaaatcagtggaaatattgaacattattctgattttctttcataagcaataaaataacatacaaaccaatgaaacaaatataatacccataaacccctcagtacattacctgacccaggggatggtgctgattgtagcagccacagtggtggtggtggtcgtggtaggactgtgctggtgaggtaggggacatggtgatggttttcattattatggttattgttagcataattattctgaagcagccatgtctgatctgaagtttggcacaattctactggttttccaaataggttgccatcttttaaattaggagttgtagaagttttgctggtgattcacagtattgttctggagttttaactatgtctccaagagaactcagtttatatgaaggctcttcgtctagacagcagaggaggctggcactcacagccacttttgctcaaaaatatgggttgttttgtgttgggtctttgcttatgaagatagactcatagcttcatttcctcagaggcatctcttaggcttcttgcttgccaaggagccagtggggatacaagtttttgtcggtctagtgtttcccctttaaagagcttaaatttgaaattaaagacaaagatttatgagaaagcatgggtctggtctcaagagacttgattccagttcatcctggattctgtgggtgctggctctgggccttggagctggttgggatcttctgtattgaccaaaccagcatctcccaaaggttgaaagcagataccagtgctatcctgaggtcttagaagtcttctctcatgagctgcaactttgatgaaatgaagcaaaacacttaactgggcctcagtttctcccctcaatcagagattctcagttaagtgccgacagtggacaggcagagaaagtgaacgggggtgcagctatatgaaggagggtcagtggtaatcacttttggcaatatgaggctggatctttgctttttttttttttgacataggccctcactctatcaccaggctggagtgcagtggcgcaaactcggctcactgcaacctccgcctcccaggttcaagcaattctcctgcctcagcctcccgagtagctgggactacagatgcatgccaccctgcacagctaatttttttgtatttttagtagagatggggtttcaccatgttggccaggatggtctcgatctcctgacctcgtgatctgcccacctcggcctcccaaagtactgggagtacaggtgtgagccactgcgctcagctggatctttgctttcttttccccccaagagaagccagaatctcccaatttaaaaaacaaaacaaaacaaaaaccgtatcctcactcccaaatgtgactctgatgggaatggtgtggagaagagccagaggactggagagaggtctgtctgcctgcccatccaccccagaaatccccttgcaggagctgtgataaataaagtaatggccttaccaagcacagatgagcacagactgacattccataataataacgtgcatttacatatccctttaaattaggaagaaaccattacctcacaactagccttcaagttataatgcccagattagaggatatgcataattaaaacagaatattcatttttataatccactgtaagcgttttttgtgttttttttaatctcttcatgtattgagtatcaatgttccaagtgcattgctccatcagggcccagccaggtaaaggagacacatcccttccttccctagtcaactggatactctagtggagcagatcgacttcacagaccagctacacaaaatgctagctaaccacaattgtagcaaaggctggggaggagcaataggagcacttgacccatcagactagaggagctggaaggacatcacctggtaaagcctttgataccacctgctgagtgtcattcatctaatgccatgtcttcactgacctcagtcacaaagaggtggccacaggctgcacatggcccatccgaagggttttgtttggactgtgtggcattgacccacataccattttaaattgaattaaaggattttaaccttttcattccttatctttcttccatttaaccttaagtaccatctggcaggtaggtcatgctttgtttcaaagagttctgacctcataagagagggttgagaaaccagtagaaaataagaaagccaggtttttacatttgttttttgctcttcaggaaccaaaagcttaggaagactagaaagagtctccatagatctcctggccacaggctgtgtctctcatcccagttaattatcttctaatatcatgccagacaccacagatggtaagagagtgtctgcagcctgtcctcaccattggagggaaatgtcgagggtctttcaggggcatttttattcccaagaagagcacactctgcatttcctgtgtgaatggggaaaatgcttggggatttggtccagacttagatgatccttgtccatatgtgtggagcaagcccaggcctgtgaggctgccagtctcccattcccagttattctcttctgttttgacttgcgcaccaaaaaacaaccaccaccagtgccatatggtttaaaagatcaaaggccccaattttgagtacatttctagctgactatacttcagatgtcttaaatatgttcctgcagatgggaagcatggagcattaaagaggtaagccacatgtgtgtgagccatgcatgtgatctgtgcaggatggcgaaaagtgaatgccgctcagccatgcgtttgtcttcccttcaggttcgcatcttcacatacctcattggacgagaggctgcgtttgcagacaatctaaagtggatggcctgtgccaacaaaggtgggtcttcgcattgtgctcggctctgaataacttccacctacttgtgcagaattaggaatattcatgagaaagtagagagttctaataattctaagataaagtctgggtatatctaagtgattactgatagacttgtaacggtttcttccaaattatgtttttttttttttctgttctttttttttttattttttttttgtggacagaatcttgctctgttgcccaggctggagtgcagtaacgcgatctcagctcactgcagaccacgcctcccgagttcaagcagttcttgtgcctcagcctcccgagtagctgagattacaggtgtgcaccacaatacccagctaatttttgtatttttagtagagacggggtttcgccatgttggccaggctggtctagaactcctgagctcaagtgatctgcccaccttggcctcccaaagtggcctcattacaggcatgagccactatgcccagtgccaaattttgaggacatagtcaagtggagtggttaagcctttccactcttctgcttagtagctgagtagccttgggagaattgctatggcagagacatttactgtgcatcaaatatccgtatgctctctcatcattcctagccttcttgcctataggtggggcttcaagactggttctggccaatagggcgggagtgaaatcaacctgagtcatttctgggctaaagcatttgagagctagtgtggtggtgttggtactctcttctgctcttgtgaactctgaaggtacatggtccagacagaacagtcacgagatgcagcagccttcatcagcctgggtccctgagtgagcacatggagcagatgactttcactgccccttgcatctgccaacccacactggattataaatagtgttcatgacaaataaacttttatgttaagccactgagatttttagtttgatatgttcttatagcataactttacgtacattactaattaagttggtcaactttaacttgcctcaatgttctaatactcaaaatggtaatggtaataataattcttcctttaattttttaactatcaaataaaattatgtatatttatggtgtagaacatgatgttttgaagtatgtgtacattgtgtaaatgactacatcaaggtaattaacatatgtattgccttacatctttattatttatttgtgatgagaatacctaaaatctattcttttagcaattttcaagtatataacacattgttattaactatagtcaccatgttatactatatatctcttgaactcatttcttctgtctaactgaaagtttgtatccagttcttcctttaattcttattaacgaaatggtgcatattaagtgcctcgttcaatactaggacataataagtgctcaataatccttagcttttttatattcataaggttaattgattaccaattccctgttgcatgtcagaaacaaatagtttggggacagcactgggaaggaagtaatagggctgcccagtctgtgaaggccttcttttcattttacacatggccaagaaggcaaagcatagcaagttaatagggaggagagtccagactccttgtatccaagtcgtatccaagtcgagcagtcactatccaccaactatgtgcaagttaccaaacctatctgggtagatctgagtcacgtcatctacagagcagaggtagtgacaataccttcccctcacacatgttgtgggcatgacatgatgccatataaataaagttggtagcttggctctggtatgtaagtgccctgagttattctcttgtgttatgttgatctctgggtcctgttggcctcccttctgaggctacaagctccatgagagcagcctttgactcttatttcatcttgggtgctctgacacagcccagcctcgtaccagagtgggtgctcctttgatgtttgaaaaaataggtaagttgactctaagtactaataaaggaaggtaggtcctgttgcatagtagattggttcagtggtctgctttaaatgggtctcctaagccatccttcataaaagttccagtgtttggacttcagtggagaaaagaggactcagtgaagggtttgtgggtcttagctccagttttgatggcctaagacaaagttgttttaggtgcaagccaccaaagttgttccctgaaattaaaaaagggggcattttggagagaggggggtgactgagaactctggtaggaagggaagcttgggtctcacaagggagaaggaagacgtgtttgtgtttttctgttccttctcagtttcttctgacatgtccatggcattcttcttccttgtagatagaccttccgtactatggcatgcatacagccaggaatggccaccccataccatgcatgcccatccatccacgcaacaatactgtgggcaaggcacaatatcggaaaggagtatttatatcttttccgtttgaggctgactagcaaatctaaattctgatttcacgtccttctcctcacccctttgaagagattatggtacccagcttgggccagttcttcctccctgctgaattgggggtgggcagaggaagcccatggagaaataaatgcttctgtgggggggctcagcattgtggatgggagtgtgggaaagttctccaagaataggtgaacagccaggctcttaaacctgcacccatctttccctttgcttggcattttctttaattatctgcttctatttgaacagtcttttaagcaaggctcaatttcctcatctacaaaaggaagggctgcatggaagtttttaacatatccttgaagctctaaaataacaccttctgcaattgtgtttcgttcattgtctggcttgcttcactaaaaggtatcaataattctgcttgtctcagagttacacatttggcctcatttcagggagaactataggaagaacacaggcagaggagagggaggccgagtagatcccagatttcctctgagtgaagaggcctttcttgaaattagttttggaactttgttgacatttaaaaaccttgagttagctatacttttcccattttttcctttattctgtggtcttgaaaaaaagagttcctttccattttttaattttttttaaaaaaatttgctgttatttcttgccacatcagattgcaattcttccatcagctagtatgcatttagtcatgggttattgtttttaccactgtctgtgtccagctgatgaaaattactgaaattgaagtcttgtcttaatcaactaatattacaccataatttagttttagtcattgtttataaagaatctttgaggcatccttttgaagacagtttagtcaactcagagtattttagggcctggctatagaatatagcctttaggatttataagttctgagtacagcagtgcagaaaatccagggaggtaatagtagctgcttggctggacaggctgtggattccataataattctccttcccttcctgtctacatccagttatttcccttcctaccagagtcagcccttcttgatcgtttcatcttcctcattctgcttctatgtaaagagccttgggaatgtcactgtttgccactcttcaaagtagcaatgccatcaaaatgtgatattccagtcatctgtgcctatataaacattggcttcacgttgcgtcagttaaggggttttggaccatgtaacatcggtgagcaagtattcttctatggtcattaattaaatcattgtttatagtctcagattgttatagtatggaggcagcataacatttttcatctcaagtgtcatgaggtccagagggcccccttacatattttcaccctgactcagccaagttctgcagtgaaatgaagcattagcattcagggaccagagcagacccaaggagcgtcgaaggaggcagaactaacgcactgggcctgaccacagaatgaccctgggagggagcaagaatcatgagggctctcacgttgtccctgagttagtggtcaaggacctgctatcagtgcaggacttcttccttgggagtctggtagccatggagacagttcttagctagcagatctcagacactttcctctggaaatgaatgtctggggacattcgtaccccttgcaatagttctctgcctcctccagtctaccagcaaaatccagggaggcctggagcttgtgagtttatttcattttatgcataagtaggtcctgtcttgagggaaccaaccctaatgagacaaagcagcaagccattttacatacattaaaacaatcattaccactgtagaatggctggtggaatttaaagttatgcgttcacactatttcaaaaataagcgaactggaaaacagaaaagagggccgactaccgactagcccagacatttcacaaagccatggtgaccttctctaacattcagtatgccaagattttaaataagcactggctgattctccttcagaaatcacagttaatggagtgttttccagctgtgcaaataaagaagggcctccatgtttgggttctcaaccgatcagtcatcgtcaggtccaatggaaatgccacatgtgttgtcgtctgcttagcttaccccttttccatgggctaaaggtcattctctccttatctgaaagagaactggtggcctgagacttcctggaaggtccagctcctaatcttttttcaataaaaagattcttaacctcattatatctttccacatgtagtgtcccccaaaagatagcttcacatttatgaggccggaatggtcataggcgacagcaggagaaaagtggcaattaaaacattttgctattttaagagaggtgaaggaaggcacaaacagcagctatttaaatacctttttgtagttcattgcacacattccttagaatcagagattttgagtgggaatgaagatggtgatgcttgctgttaccgtaaaacagcaactaaggatgacaagctgctcactaagtgccaggcatagaacagagtacatctgtgcattacctcttttgatcctcccaaaggctctatgaggtactgttatcattatttttgtttacagagaaggaaactgaggctgagcaagactagcaccttgttccagattaccagccagcaggcggtagagctaggatttaggcccaggtgatccaaagccccagcctgaactcttcatcagatgtaaggctgcttctctttggagaggagaaagctgtgattcatagagaactcttacatatctctcttcatttgaggtaatctaggaaaagaaaactagagagtgagaaaggatttcaatgtgccataattaacaaaggccagagctgggatttatgcccagcctgtatgttctggaaatggcactgcttcagcttgcacagtggtatggttcaggtcctgatgtttcagagttggggacattaaggctgtagataagacgagaccaggagaaaccacagcaaggtgtgatgggtgtagccacagagctataagaaggagacagcattcctatttccccagtgtgtacctttagattgttttcttctttttcttgtatttttaacatggagttagaaattaaaatgtagtcatagtcacaaaggaaaagatgtgtcccttgatctgaggctcaagctgattttgagagctctgctcaggagtgcggttctcccaccaagaccattgggctccctgccctcaatgtccattctctccaacaccatgaatatgggttcttctgctctcagcactcaacagacctcttgcttgttttttgtgaagtcagagaagacagggaggtaggaagctgtttataaattgtacctttttctatagaaataagtgtttttttcagtagtgtgtgatcttgacagggaggaggaggaagatgacacagaacacagtattgggagcgtcttccaagaacaccgttgctcatagggaatgcaaaccagggaagccacagcatcaccttcactgccctgctaaatctcattcttacctcggcaccctctggagactgatattttggtgctggctctcaggttttctgcctgccttgcttaaggtgggaagagtctttggaaagactcaacaactcaaaggaatcaaaggaagctacacccgtcactccaaagatggaaggaggacctcactatttgaggtagacagctaggatctgcccactgaggacagactcctggtacccttggatctggtcattgcaaagtggagtatttaatgattcaccacaggagcttctcatgctcaggcagctttgaggcaaaagactctaaaaatccccaagtaagggtaatatctcagaaacacaaagcactgcgttgcatatggtttatcacatgcagtatttgtaacccagagttcacagaaggagctctgcaagggaataaggtaaataaattgatgttatagagaaaaacgagcagaccatttgtaataggtggctaacttcagcattaattgctccttggtaattactgaatcattgctgattctgttttcttacatgatatatgaggtccaaaaaagcacattaaaaaagagaataaacattcaagacctagaatttaacaggaaaaaaacagagggaaaggggagggaaagtggccagctgagagaatacagagggaaaacaagggaagtgtctatggttacagccagattctagcccttagtgatttcctattatccatcatttgttaactaaaacttatactaagacatttaaaaaccaaaaaaaaaaaaaaggctcagaaagattttaaactttaatgagttggaatcaaatgtgcataagctttgcagcatacattgttattgtcaatattatttttaaaattttatcttttcttacctttttatacatctgcatccctggtctacatagtgaaatataagttggaactatagactggggtttgagtagatctttgttgttgctcattgctcaaaggacagtcatatattgccccatccccatcctcagagttccccagctacaatacgcaaatagcccattagagttaccctcctgggggaggagctctgagctgctctcctgtcccttcccagcagcgaaagaggcagtgtcttcagtggttcagagcaaaggctttggaatcaaatgaacctggattcgaattcatccaggacaaattactgactcagagtttgtgtttcttcccctacacggtgagcacatgctttgggccattgtgaggcccacatgcagaaaggcaaggtggatctcagtaagacctcagtgaatgttcccaccttactaatggctcctgcataccttccctccctgttcttggaatattgctcccaacaaggtggggatttttgaatcatttcgtggagctaatattccagttagagagaacacaataagcaagtgagaatccaatgatggatgagtcctctgaagggactgatgcagggtgaagggagaggaagtgacttcagacaggaatgtcagggagggcctctctgagctgagccctgagtgacaaaaaggaaccaaacatggaaaatgggataaagggtgtcccaggcagagggcagcaagtgcacaggccctgaggaggggaacgcagttggcatgtgagaggcggggaaagaaggccagcaagcctgaacagtgagcaagagggagatggcagggatgaggtcacccaggtaggtggagccaattcagggagggtcttggaggtcagggtaagacatctggattttattttaactctaaatataagctattgtaggatttcaaccaggaagatgatgatttgctgtgacctcttagacaatctctgatggctgtgaggagcctagacaagggggagagggatttgtggggagactcttgtggactctgggtgagagatgatggcatcttggagtagtgaagcagtggagattgggaagtgaatttagatagattttagagataggaccagaagaacatgctggtgtattacatatggggtggggtgaggaaaggagggatatggaggataattatgttttggcctctctgggaagtggtgccattttctgagatgagaatgaccaactgggagaggaatggatttgggaagtgaagtcgggagttggctttggatgcattcggcctgagaatcctgctagttatccctgtggaggtgtcgggtatacagttggccgtgggtctgtcgctctggagagaagtcagctttctgtaatctttcagaaccttggctatgataagcaaggacaagtggggatgatttctcagctctgtccttttccaaatgtatgattgttttcccccaactccctctctatcctaataacctgtccctcccaccctcctccttaaattcatctttcttcccttggcactgtttttggaaaatccaaatcagagagctttactgctggctttgaggattagatgtgaatacaggcaaccaagaagaactcctacaagatcctgtctgggcccaagagcacaggcacctaaacagaattgtttgacactgcaaagcactcatccctgtatccttaaggtctggagctattgagttgtgtctccctactttaccatggtagcacccctcttagcttgtcctctgtgtcaagaccccttaacgcagagcccaagatttgcctactaaagaagagatgaaatattttctttcttatcaaacgctgattgcagcctccatgcttggagagatgataactgtgtatgtggcatgttccctatcctctggcaatcctttttaaaacctgtcctttccgaccatgcctctaagaggaaccatctaggagcattgctagagcagcattccaaatgggtctccctaactatggtgcctgatggctgagagaggtgaacataggccctgctcccaggtctcaaactaggacagaaactcacagcctattcctttggggccctgtttcccctgggatgggaaaggctctgacccaggccaggagggtggggcaggcaggagtgacaatgcatgctaattagcactatgcagagctgtcatcaggaacccagaagccacatggtcccaacctggtttggggttggcacaccaaattcaaaccagctggcctttgtttggaaatcctctgggtgggtcccgaccctttctggacaacagcagggctggtatttccttaccctgagccctattttagtcactaagagattctataaactctggagctagtgctgtgatggagctggcctcagaggcacacatactctctttaatttgtttggcgagtaggaggtggtatgagcctaggatccttatttagaggcacggggaggaaacaagaatctgtgtccatcccctgcttgaaatccttccctgactacctgcgtataggataaagtctaaactctttcccaagttctgtgtgacagtcctcctgcccatttctgtcatcttatgtcatcttaactctaccctctctctaccaactccttaactccagccattctgagctatttttagttcctagaaggggcctgcttctctctgatcctgggtccttatttatattccttgttttgctggacaccatctttaatcccagttcctctggctaactggtcctcatccttcaggttctagctacactgacccttgctcaaggtaaccacatttgattggctgtgcctgttgtaagttttagcttaatgttgaatgtgccattttgtaattgtctgtttactcagaactgccaggccccagggggggcaggggtcttgctcaccttgttaatcgctgcttcttcaatgctaaacacaaaggaaaccttcaataaatgtgtgaatgaagggctccctccaagggatccaggcctgtgttcagttcaccctttcccttttaacatctcctaacccacagcaaagctgatgtgaccccaagctctacagcagtacaggaacatagcagcgccctggaactaaagaccaaaatagtgtcaccaatcacaagacaacagcatggtgagaatgtttctgttgcttagaaatcatgtctacctggctgggcgtggtggctcatgcctgtaatcccagcactttgggaggccgaggcaggcggatcacgaggtcaggagatcaagactgtcctagctaacacggtgaaactctgtctctactaaaaatacaaaacagccgggcgtggtggcgggtgcctgtagtcccagctactcaggaggctgaagcaggagaatggtgtgaacccgggaggcggagcttgcagtgagcagagattgcaccactgcactccagcctgggcgacagagtgagactccatctcaaaaaaaaaaaaaaaaagaaagaaaaagaaatcatgtctacccaacatatttaaaaggcagcactggggaccacatcatgatatgggctgaaattttagcctcaaacatgcaaagggcaaaattcagtagaagtaaaagggacaaattaagagacttacaaacctggactcatcatctgtatttgctacttgatgcctgagagaacataggcaaaaaacatatcccccatctgcatcggtcatcttatctttaaaatgggcacagtcatctgcacttaaatatgttgtcacaaagaaaagggacaacgttgatcaagtgtttagcaaattttatggcacctagtactcaaaaattaatcataactattattgttatgtttataaaaatgaactagcctttaatttttatggttcctagtttttcccttggaaatagactcacaaaaatgaaaaaataaggttacaaaatatcatgtagaaagaactgtcatttgtaccagggaataaacacacacacacagtatgtctgtgtaaacatatactgtgtgtgtgtgtgtgtgtatatatatgtgtgtgtgtgtgtgtatatatgtatatatgtgtgtatatatgtatatatgtatatatatgtacatatatatacatatatatacgtatatatatgtatatatatgtatgtggggggggggtgcatataaagttagggaggatattctccaaagaattaacaggaacttcctctgggagatgagtttatggttgattttaattttattacatttgcttgactgtattttctaacatgaacttattactcataaagtgggtgatcggggagaggagctaacgttgaaaagaaaaatgggggagaggagctaacattgaaaagaaaaaagaaggaaactagctagagggcaagaaggcatggcatatgcatattcccagttgcaagtctttctgtctgttactaaacttggccctcccttgggttttgacaggattttttacccaaatctccaccttggctgatgtgcaggagaatgtcatggaataccttcacgtgcttagccggcccaaagtcatcgaccaggagcatgatgtggtgtggaccgaagcttacattgacagcactgtgagtccacggggccctgggaaagaggctaagctttacccccatccccaaattgtgttaattccagaaaatagcaactgtatcactcttattttttgtgttcagtgacacttttcttgattgtttgtatagtgttggtcaccttgacaagcaaagttggtgaaaaatcataacgtactagaaagtatgacacgtacttcagaaaggtagctggtctgcacaaaagaaatcacgttttgcttgtcttttctcgttacttctgtcccactttttcacatgtgttcaaattctgtcagtgtagcaatgattacaagcattcttagattctgtcctcaccatatatgagccccagtcctggcaatgaatctttgtgtctcaattgggaatgtaaccaaagctcagctctaataatgaattggggccaccatggaggctacagttgcattttcttcccatgcataagtgagaatatgcttgaatggtggttcagtaggcactggattgttgtttgaactctgaccatgggcccattctaaagccgaattctaaacagcagattctgatgctgaattagctgaaaaggaggagctttgccaatcatcaagtaatggctcaatggctgggtttcttatgtaatctcagggtgatttttcatagtgataataagtctgatgggagtggttttttcatttattgattgtaagtgttctcacagggcctctctccagtcatttttgttgggattaacatcacattaatcactgtaacccagacacagctgtcctccagagtgatctcaatggctgtcatgggtcagcttttctctccctgggctctctcattcctgctgcacttctggcagctacaggcaaactcagggcaggaaaagcatgtgggaactcatttcaggggacaccatgacacaggccaggccacagcagcctgccccatctcagccttaaagtatgcaatgcggccctggaaataagaatgtatccccttgtcaaaaagggagactccttccccaggaaaagtcatcttgaataaagatgaatgttgagctgaaaagacttctccgatgctagggagaccatgagcttttatcagcttgagtctgtccccagtttggttttaaatcatggaaacaaaataagctgccccatttatgttggcaccatattaacaatagcagccatggtgataacttcatcttttcttgtatgttgttgggtaaggcaggaaaaataggagtgaggaggaggaggagtgtggctagctagtattaaagtaaccaaatcactcagtggttttgtgtacaaaccccaagtagccagtttgttcagtcattttatttgtttcatcaatttaaaaaaatataagacacagtttctacaattaaaacattatggtagtagcacctggacagacagatcagtagagtagaaggtccaaaaaatcaactacatatggggatttagtatataatagaggtgatgtgtcagatcagtggggctaagatgggctttgtaatagatgcttttgggaaaatcagatagccatttagagaaaaatagaattagttcagtcttcacatcatacccaaggaagaaatccaagtggatcagacgtctaaattgtaaaaaatgaaaccattacaagcagtagaagaaaacctgggtaaattcctctgtgacctggattctgggaagactttaacaatgactgcaaaatctacaggcaataaagagaaagataaataagtttgactacaacttatttatcaacaacaaaaaaaaacttttgtaagccaaaaacacatcataagcaaagccaaaagacaaatgataaaataggagaaaatatttgtgacacatagtacacatgaagaattaataatctccaatatacaaagaactttttaaaattgaggagaaacccccaaaattgctataggaacaaaatgagcaaaaaagttgacaattcacaaaaaagaataaaaaatggcttttaaacataagatgtacaacttcataataagcaaaatgcaaattaaactataatgagataccatttcacacccatcagagtggcaaaaactaaaagcttaaccttgcactctgttggtgaggctatgggaaaagggacactcttattcattgattgtgggaatgcaaaatggggcaatctctatggaagttaatttgcatttaccctttgatccagcaatcttacttctaagaattcaaccctgaagatggacctttaacatcacaaaaatatatgcacaagtttgttcattgcagagcagcttgtaatttcaaaatatgggaagttacctaaatgcccaaacataagagattgaatagactatggtacctacacctaatggagtcaatattaaaaacaagaatgagaatgacctgcattagttgatagagagtgatttacagaatatacttctaagtaaaatgagcaaaatcacatatagcatactactttttgcaagaattatatatagcatactaccttttatataggaaatgaggaaaaaagaagatagatatgtaattacttactttacaaaaaaaaaaaagaaaaagcaaaaacaagaaacagaataaaccagaaaccaacagaactggttaccaacagaactatcattccctccccaagccatcttctctgcaccacctcccacatcttattaggatatgggaggtggtgcagggcttggggagaaaatgacacaactctgagtatacctttttgcacagttttgacttttgaaagcatatgaatgttctgtgtattcaaaaattaaacaagattggggggaaattaaaagtgaatgcaaacagaacaaaatgaatccaataatatttcaagtgaataaaaaatttctcagaaagggaggaaaaaaactttagaatatagtagtacacacaatattaaattttgaacacaatactttcactctctacccctcaatctagggaggaaaagagaactgcaaataaattctaaactccatttggtgtcatttgtggtaatatggttacagcaattctgaatccattttgtgagtatggaggtattgggcaaatgtgtaaatgctgaagacaggggatctgcctatgggattagacttgattggaaaatcccaactctgtctttctaaaggacctataagcagtggcacccaagtagcaatgagcccatccagtacccagattctggcttctaaaaaacactccccactaagaggagccagggacccttagagtaattgcttattccagggctgcagcagagaaggtaccaaataataataatgatgatgacaataataataataagcttggaatattttgtgccagaaactaaggaagtgctcaaaacaataatgtggtcatgtcaaaaggacacaggatcagcatgaagaggctctcattggtcaaatctgggacaatttgagcctcaaaataaggaatgacaataatggtttgtaacttgttgaataaaacagaaatccacatgtccttactgataataaataactaaacaaatcccaaacagatgaaccagatacgtaagtcagtgggtgagaagagtgcagtgtatgatggagtgctgactggcaaatgaggagggagtgatggagttggaaaatcactattttgcaaccattttggtaaagaccagttagggcaaaggtctgtcaatggatgctaaatctagggggaaagttcgatgatgagcagggtatttttatgacctcaaaatgcttccctagacttttcattagtcttgagggggaaaaagtggcacctgaacagtgggatactatgtacactgtcttagtatactatatattggatgaatctcagcaacatcttgagcgggtcctcaaaattagcaccaccaatgagaagcagatggacattgtgtgcctgcagagaaagacacatcacacttatgtattgttttgaccagggacacataacctgatgctcacggcagatataagttcatgaagcagatacagctttgcattaatatgatgccttgctttaggtaatgttcagcacttaaatcggttgttgtattagatttgctaattacatacagatataggaagttagagggggaacccattgctactcaaacttttgcgctgaagtacttttgtgaccacggagccaaaatatatggtctggggcagatctgggcatgtagttacagaggaaagtctctgaagtcttttgctttatcttaaacatttgcacaaattttacattctgtgccataatcattcttatttactttaaaataacatttcacgtggcccattactaagtaaacttggtatgccaagatgacagagctcatttattctacttcttaaagaactctttgaggttcataaaactaaacccacaaaatcaggttatccctaaaatgatagcccaacattgttgctgtgcttcccaaggttctgttgctgtatctttgcaaattgccctaataaatacatctcccggtagaatgttctgagggttccttctcctcttcatggtgttgagcaacctgtcaggccaggaagggcactggggagtctgtcttcctctttgttaggtctgccgggtgaagagaaggcagctgctgcttcaacaggtacctctgaccaggaagcagcagtttcttccagctccttatgtggacctggattctgccaggacacgaacaaacaaacaacaacaaaaccccatcatttatacggggtcaaaacagggttcacatggtgaactcatctgcagagtctaaattctgagatgcttaccaactttggaaccacccagaagatcaagggggagatgagcagttttgaatttatgactgtcctgacacatccaggacagtttcaagccagcattaccctaaggtgacccagcttgcagtaatgaaagagactagactccacgagcacttggcattaggaatgatgattgactccattttagtaacctgatgttttgttggtattgatagctctggatttttttttaagcatatttatcgtctaccttagtttattcactaagggcactgaatttaggttagaacagcatcccaggtttgaactgcatgcctactccatatttgctctgtgactttaagccagttacttagcctctttgagtatagttttcctcatttctaacatgagaatacgacctgccttccagggttcactctaaggattaaatgtctatgcatagtatgaatgcaataaatactatttattgtcatttcccaattttagaaaacctagtgtgagtttatttcctgggctgaaggaagtttttaaaaatactggattcttctttctttgagctgggtctcacatagtagctacatgattgttaccatattcataatagaacttggtagttaagtatgatgagtatcttggaaaacattgtttgtttaacgatactctttaattctttggaattcacttggctgtaattatgtgctgtgagccaggcactaatgtctgggggtgggtgcctgggtcagtgtccccagaaaacactgggattgtgccgcactagccaggcagaacctttcaccccaacacccttactgaggagagcccttgctgaattacacaaggaaagggaaatacggtagcagcccccttcaccctttgcccatttgccccgaaaatacttgctgccgacacttgcggctgcagctgttaacccgagataactttgccacaaaatatctcacttttattattatttttctataaatatcctataaagagaatgatgtcttctgtttcccaaaacattctgtttttagtagtggtatttacatttacaaaatatagtaattctcaatggctaaaaatgtcaaatcctagagaatgttgcattcctacacatgatgttaacatcattctcaaacagttgttggccaaagattcgtttgatgaatccgatttttccaaaataagcgattctgacgattcaaacaattttgatgttagttctgttttagaaataactccaagaacagtttttatattttattttcacattgaaaatcagtcagatttgcttcaacctcaaaaaccgtgtttatgcaaaattaaatgagtgctggcagcaagctgcactttttttgttgtttttctaaacgggaaaagggttaattggccacagcttaactgactcagtgtcagttaagcgcccttggcaatgcagccatttgtgcctgtcgcccacagcaccctggacatgtgatctggaaggccattctggtgcacgaagcatatgtctgttccccatgcttgagttgcaagcttacttgaagtcagttgtcttcattcccaaacctattgatgccagtggtaattttatcataattgtataaatgaattaaatattatttaaaccaacaaattgtgagtatgaaaagaaagtcattgtttctgtgaatctgtaaatgaatgctttggaaagactgtaaagaaagttgctaaaaaattaccactgtgctgaatacgggcaaagcaaccataaaaaactagggagaaaaaaaacatcttccttgcattcagagaaaactgatgcttaatttttctttccttctttctatagggtaattttccttgatttgtttgtgtcatccttggttgatgtggtggatctgggggctgggttagtgtctgctttttctcttattgtctcttagtggcctcgggcagctgtgtactccaagaaggagaacagatctttccagacacagagagaggggtcactaattggtgtgtgagcagctgtgatttccatctagaaacaaccaacacactcccattatgtgggtcagcatcacctgtatggctctgctagttctctactgccctttaacaaatcagcacagacttagtggctttaaacagcacaagtgtatcatctccaggttgccatggatcaaaagtctcagcacaagttaggtggatcctcagctcaggcactcacaaggctacaaggaagcgttggctgcactgcaggtctcatctgcaactcaggggcctcttctaagctcattcagcttgttggcagaattcagttctttgcccgtataggactgagttcccattttcttgcttgctgtcagctggggaccactcccagctcccaaaggccacccaaagttccttgccatgtggcccctgtaggctgtcacacaatgctgtttgttttcctccagcccagcaaaaatacatctctctgatgcttcactttcccttaaaagcttcttccattaagtcaggctgactcaggatcatttcttttttaattaactccaagtcaattgattagtaatctaattataccagggatatcccatcagcttacactcaaggagagggaatttgatggggtgtgtacttggggcagaaatcttgggggccatttttgaatcttgcctaccccagtggtctctgtccatgtgctctggtctgagagggaaagataatgccagaaggaaatgcaaccatatctcctgcaaactgtcaagagaaggttttaggatagctatgtccattcttcatcataacatttctacttagcactgatgtttcccagaggagcctggttctctttgttatattgcagtctgaaaggagctgtgattcctttaggaatcagaagatctgtgaccctgctgatgtgtattatttctactaaatactaagggagtaggtaagtatttgttgattatctagtatgtttggacacttgtacccaaaagatggcttaatatggtctgactcttctttctctgtaattatctgggtagttaaggaaaaggaattcctctttgcttgactcatcagtttttgtggctgaaaacccagcagcagtaaatataattatataactgatttaatgcttaaataaatagcttaaaaatgacccgtgagtatagtgctttcgctattaattatacattgatccatagttttggttctggacaagttcaagataaaagtttagctgtgaacagaagctgagtttgggttcttgcacatgagagccaatcattgcatttaaccaattctagaatcagaaactgacaaaacttcctttcagggcccattctccctgcttgttgctaccagtctgattaaatattctgtttcctgcttggctgttctgttcaatttgttttcctggtgaaatccaaataaatgacttaatgttaacaacattaattatgttgaatctaataagatctcatgtattaattgacaaaacagcaaacaccagaattctgaaattcataggcctctcatatgaatacaagtcatgcatagtcattatctcttaggtgcagagcaaaaaatcattaacaatggaatttgttccattttaaaagcaaatgacttgtgctttggagttgggtcttaatcagcttgggaatgctattcaacttgctgtgcaggatagaaccagtatcaaaccaaggaagcatcagcattcctgatcagcccctccaggggagtttacacagaccacagtgacacgcagaagggaagcaaagaaatgttttagaaacagtgggaatgtgaccatttaaaataatgagaattcattatcaagccctcttgcccctcccgtttgctggtaatgcaattcagtaggcaatttgtaggaacttttcaaaccaatttagttgcatttgcaaattggacctgtatccctccttctcagcccccactaagtccaacttggagaaaacactatgcatttgataaattgcacatttgtttcagtttcccatctaggaatggcacctaggccatttaggagtcatttgggtgattaagctataacctcttactgcctagaagcaattaaatggggtcaaagccatcctaaggatgttcttgggcttggaaatggaatttacagtatttttccaagacactgctgcatatcaaagaagttccaatcgtcaaaacaaagagacacacgtaaagagaaacataaaccatcctgctgggttgtggaacagagaatgccatctgcattacatggcaaggaggaaactgattatgttgggacctctatttcatagcagatgggttcattaaatttaatagcctccagagcctttagaaaccgtgttaaaaacatgtggagcatgctgtgacacttcacttctggccccgcagtcattataactctggcacagactataaatattacagtactttatttccattgaaacagattactgttatgattatttttttccaggagatgttaaaaatatgagtgtattcctgatttttggtaccacttatatgcatccaaatattttcctcttccattgattctagagttttctattaaacagagttggtattataaaaccatgaattgatgatataaaattattatcttcagaaaagatgtcctaaaactctatatgggtgactgtcaactagtagaaaagcttagggctaaaaatgaaaatgatttctagatttcaggtgtttattgttgtttctgcttttatggattaatgatttgcaactgtctgtaatgaaagaacagcctctatcctctgccatacaccaatggataagagcatctagcctgaataatcatacaacatgatggcttattcagcactctttgtttacaagtcacagcttccagtgcaaagtgggaatggtcaaaaaggcaatttgatgactcttggaaccaggatgtctgtgcagttctgtcttgaggcgtgactagattcaggggttgtattagtttcttctcgcatcactattaatataaagaactacccgagactgagactgggtaatttataacgaaaagaggtttaattggctcagggttccgcaggctatgtaggaagcatggctgaggaggcctcaggaaacttacaatcatcgtggaaggcaaaggggaagcaggcatgtcctatatgactggagcaggaggaagagagagagtggggaggtgctacacacttttgagcaaccagatctcgtgagcactcactcactctcaggagaacagcaagggcggacatctgcacccatgatccagtcaactcccagcaggccacttctccaacaccgggggttacaatttgatacaagatttgggtggggacatagacccaaaccatatcaggggttaatcccaatattattttgacttgctctttgactatttttttttttttttttttttttgaaatggagtctcactctgtcgcccaggctggagtgcagtggtacgatcttggctcactgcaacttctgcctcctgagttcaagtgattctcctgccttagcctcctgagtagctgggattacaggcgcccgccaccacacctggctaactttttgtatttttagtagagacagggtttcaccatactggccaggctggtctcgaactcctgaccttgtgatctgcctgccttagcctcccaaagtgctgggattacagatgtgagccaccacgcccggccactgttccttgactcttattggcttaattcccagacaggatctctctacatggtgccaaaaatggctctactgtttttggtatctaacataatgttgttaactttcattacatttataaaccttaatttatttgcctttcagcatttatattaagcctatgatagataggcctgtttgagtcacagccaaacgttgagagatgagacagacctatgacttaatggcctcaatctcacagagtgaggagaaatcaatccaaaaggaaattgatcctgggaagaccgagaagtaccagagtcctgcacaaaacttgttggtagaatccgaaaccaatccacgcctaagatcatgtaccacatcagcagggtattaattatgataccatactgttaagctatggagccctttagttaaatgtctttgtggaccctttcatataaagcatatagaagcagaggtcctctggtaggtattgggaaatggagacacgaagcccagttgcttggccacatcccagggagactctgaagcattgttttcatctttccttgcactgcagagcctaggtagtattctaagtaatcaggtgtcaacctctgagaatagtcgtataggattctctgctgtggattctctgttgtaccctttagtttacaacagagtgctgggttgagtccagttaggaaagatggctatggggattggcaggttgtgtctgtattcaaaaatcaaattgagaaagttagtatagtaatatgactattttatcatatttcggccttatttttcttcatcacttctgatgatcaaacactggctcattgtacttctgtcacctcttagaaagcattggctgtaggcaagagaacccactcaagctgtgagaaatttactggatggctcaggggcagccccaggagggataaggaccatcaaggagcaagaagccaccaagagcaaatgaccactctttttgttctttcttccttcttcctttgttcttttttcttgtccctcctacttgccatccccagtcatcggtgaaacacagtttcctggtctcctcccagtcctggctttacataatgccccagttgagatccaaaaaggatgaaatcagtgtgtgttgtgtatctgagtttacatttctgagcaaattatatacacaactcactctagcccatggttccattgaggtcagatgtccatcatttatccaatcagttatgtcccagaaggccaagggatagaaacagatcagccagggctatggataacattttctaagaggtcgggaggctgcctgcagtggcttatacctgtaattccagcacttagcgaggcttaggcaggagaattgcttgagcctaggagttggagatgggcaacatagtgagaccccctgtcgctacaaaaaataaattgaagaaatcagccaggcacagtggaatgtgcctgtggtcccagctcctcggaaggctgaggtgggaggatcacttgagccctggagatcaaggctgcagtgagccatgactgcaccactgcactctagcctgggcaacagagtgagaccctgtctccaatttaaaaaaacaaaacagcaaccaaacaaagacaaaacaacaaaacaaaacagtaacaacaacaaaagaggcctggataggaggaaatgcctagagtctgaaggagttggcatttctagacctctgtctttctgtctgaggtttctgtaacttacagcccggctgagctctgatcctaactctcaggagtgggtcttctttcctattctctgagccccaggctcacatcctcctttaagccccagtggacccaagtgtccccacagcctccccctggccccacatcctggaggatgctgcccttcctccatagactatccctgctgtgtgggtggtgggaagccctctcccttgtgccttccgagagctgaggaagatattttggccaacacaaccaaatctgtactgcttttcccccacttcatggcccagatatttgggtaacttaacttctcagagctgattctcatgctttgacatggtttagactaaaatgaacacattcctcttattaccagcatgaagaacaattaaaataatcccagagaatcagcctgtggtttgatatcagctgccagtttctcttctgttactgtacacaggattttctccatgtgaaagatttcattctttcacctttactccaaaagaatcgatgtgccaaatataaatgtgttatctatgaggccatggcacaaagacaccataggtaaggacatttcacctgacttggcctcttagcctgcttctatttaaaagtagcagagaatcactcttgcctcccctgccttcatgacctttcacacccacttatgagtgaaatggccattgagggctcctcctaaccttactctgctggtgacacatgctcttattagacgtacagagcagacatgactaagtctatctctcagtgcaaggtccttaggagaaatttctctcttgttctgaacaaagaaaggaaaagcaaagccagtagtttattcaggcagaaggaacatgcttttaaatcaattttcattatgtttaatctaaaaatctggaacatcaacatcttttctggttgatagaaacaactattaaacacgcttgtcattgatttctcttctgaagtgatcaaattaaaggcagcccaagatgaagcaaggctggagtactcatcctatagtctgtttctctgtcacttagccagctgttaaaggagcagttgtttccatggaaagagccttcctttgaggaacatggggttcaatggacccccatggtattccaatagcagggaccagtgggaaacactgtccacacaccttataagtgcagggacatcttgagaccacattagatgactttttctgtctgcctctggaaaatatttgaagacccaatttgaaaagttttcataaataattgagctattttaattgtcaactaataagttagagaatctaaaggctcactgctggcttaagtaggatcaccacgggcttaaaaccctccaggggagcctaaattcagagcatttgaagaccttgatgacctgactccagtgaacatctcagtcttttccttccacatggcagaaggcaaaggggaagcaggcacgtcctacgtggctggagcagaaggaagagagagagtggggagctgctacacacttttaaacaaccagatcttatgaccactcactcactgtgaggagaacagcaaggggggacatcagcagcaatgatccagtcacctcccggcaggccccttctccaacattgggggttacagtttgaatggggcctttccccattccgtgccgccatcctccagccttaacctactcacacatttatagtctctagaaccagccctgtattctctcacaccgagaccactgtacctgcttttctctctgcaggaagtgatctcttcctcccactccattcagaagcctctgggcttatcctttggtctcagtttcatcatctcctctgacctccttggatggacctccagtctagagtggggcattgatggcctgtttccaaagcatgtagcaccatcctagaacttcttgtactattatattaagaagtccaaataaactttttgccactgaactttaaattccttgaggagagggatggtgtctggttaactgtcgcatcctcaatatatgatcaggcacgtagtaagtatatgtatagaatcagatgtgtaaatctcatagactcagagatccaaaggttggagggcatgtgaaaatatctgcgttttctagctgttagataagaatggcatcttctccaacatttcactcagcatgtagcatccttgctcaaggccatcttcattaggcatgtgatgagtggatgcatcttcaccatgagactgggcttctctctcaggtacccagcaccaccaatccaacaaagattttgccacattcatcaaaaagatctgaattcatgtgtccacggtttgaggagctaagataatggcattctgacatatcagctgtgtcattgttaagataaaattgatattacttttgcccaccgttatgatgttacttttgcccactgttacaacagaagggcttttttttttgagacagagtctccttctgttgcccaggctggagtgcagtggcacaacctcagctcactgcaacctccacctcccaggctcaagtgattctcctgcctcagcctcccaagtagttgggactacaaggtgtgtgccactacgcccagctaatttgtgtatttttagtagagacgaggtttcaccatgttgaacaggctggtcttgaactcctcaccttaggtgatccacccaccttggcctcccgaagtgctgagattacaggtgtgagctaccactcctggcccagaatggaatttttaaacaagattttggcaagattggaatcaaatctggctgtcaagtaatgggcattcaggaaatccttgaaaataatcccttacagttgtacttgtaatgtgcttttttctgtatttcccccaagttcttaccatggtcaatagtgcctcaccatcgctggccattctccctcactctcagaacatcagctgtgctggtcaccttttagttgcctgaacaacccaaactttctccctcccctgggcttttgaacattcttctccttctgaactggaaagactcccctgctgctctgcttctctactggggaagaggctctttcccatgttctttgtctcagctaaaatgtgtccattgcctttccatctcaggtcccctataggttttcttcatagagattatgatcatttagaattatcttaattaggtgctttgacttttccctctcttttaaaattcttgttttgtctatctcttgaacagtagcgtaaggactggggcagtctgtgatgtgtctctataacctgatactgtgcctagcacagagtaagtacccaggatgaattcagagaggccaagtggcttgctctcagtcctaccaccagtctctgtttactgtgcactacagtttgtttgtttctccctgtctgtactatacttttcctaaaaaacggtacaatgagaccccaaggcttacagaagaaataatataaagaatattgctacaacatggatggtggtactaagagagagtctaaaatattgtctccaaaatgcatgtgtcatatttgtctttccttttgaaaacctagctgaatgatcaagtttaggtctgaagcaactgacttttatgaatgccacctccatctaagcagcagttactgattttgaaggaagaacagggacatttgggggatgaaccacatttctgcagtgctccttttctgtgcatgttgctaaatgcaatatgttggggaaaagattgattgcttaaggcatattgtttatactgtattacttgggtctgatggaaaagttcctaacagtggttttcttgctaaagatatggtttatggggaagtgtggaatgtgattttttggtgggacatcatcatgatttaggtgaactccagagaaatttgatactgggagaggccaggaaaaacatgcaggtccatgaagcttctttagcattagccctcagttcttcatcagattgtaaatgctctctgcttttaattaccatccttattcaggccaagctaattgctctgggccagactggaaaggaaaattcccagaaagcctgatatcttgatagaatggtagtgagtttcctgaagaagacgctaagaaatccttaatgaattagcatttcaacttttgtaacagtatactaaaggagtgggggggttggaatcatagatttttgacagctgtttgccatcatagcacttgacaatctgcttcttatttggctttctggtatgtaaaagcatgaaattctcaagaagtattgatcactgtatgacaatacgtatgtaacaaaactgtattgaaaaaactttcttttaaaaatgatattcctatttggttactaaaatgtgtgggtctttttatttagaaaatgttgtggttttgttaaacataagttatttaagggttaaaataatcttaattttaactattaatgttactgagaacagattttcaaccaagtacaactgagtgcaaacaggaacaaacttggaaaagaagattagtggttgggaatgcagagacacagcaagggctgggccttggccacagtacatacattcacagaggccctttgctatattagcagagccagacatttttgtaaggtctggtgatttccccagacttcatggaatctagattaagtttgccaatttcccatttctctggagatgataatccaacatagggctgaattaggaacactcagaatgtgtgggcttgatggttctcttattaagctggattgcccttctctgtctgtagctggtcagtaaacaggagagtctactctttggccatcagtgttctagggacacttgcagaaccagatgtaaagttacctagttcattgacaaaagacatctactgagctaaagattagtccctatgctggccaatgggataagtgttcatttttaggaaatacagcctaagtccttgcagtgaacaatccaagccaattcggtaatttgtacatgttaaaatatttttagtagttattggcatcctccaacatttagcagtgaggctgtaacaagtctcaggccaattctgccatctatgcagatatttattagcaagtatgcacaaaagccaactgttttaaagctcaaggaggttccagctctttatccttcaggtgttctgatggccccttgcatcagagcaaatgcattatttgcaagagtcagctaacgttctatttggagtcaggtaactgagaggcctgagtcagcagctgaaggcaagactgtttaaaaatctggccagggggcactatttctaaagatagagctcccaaagtacttatttgggtgtttgcagagaaaggcaaggctcctgcagcatattgaaccaatccacagagtggatatgtccagttttaccagtaagagttcacttctaatatccattgtggtaattgagaaaatttttggtgttggtcagagataaatacccatagcacatgcaaccatttgtttaaatactagctggaaggtatattcctaatgaggtcaattgaccatttttgatatatagactaaaattagcattcacatttgtatcaaaacatctactctgaagtattctacagtaaattccatagcatataacaatgctgtattatatactgttaaggtttcttttgtgaaatggaaagaatagtggtggtgatctcatagaattgtgaagatttaaaaacataatattgtttagcactatgccacgcctatatcaagtgctcaataagtgctaatcattattatgtagaaattcaggataacattattacttattgttccatatagagtttttgtggagtgaattcttccttcgttttattttggacttgccaagttctgacactctccaaaagaaaagggaaaagactgggccatgcatgtgtttcccttcccagcagaagagcattcagagtcatcttcactctttgcggtcaaggcccctgctgtaggtcgtgtgtccagcttgtcctgcctaaaagcatcatgccatgcttgagaaaaagaaaaaaaaaagtctactgaagccatcacctctccttgtctcaaaagactttatgactacatcatttagaaacgactagagtaagaaccaagaagcttgagaggaaaggctgagctgtgcaaattgatgatgcacttctgaagcatccttcctaacggtggagtagggcaggtgtcatctgagtagcacagcaagaataactggggtactaagagctgccattatggggcaggtaaaacgcacaccagaccctgtgttacgagcttttgcatgtgtcagataggccctattatctccatttacttgatgaggaagctgaggtttagagagattgaggattttgcctaaggaaatgggataattcatggaacaaatggaattcaaccttgggtcttctgcccaggtgtgagactgtgacctcagattccatgttacatgcaagaaggtctcctgcatacgtgtgtgtcctctgaggccgcttttaaggaactgccaaagtctttagaatgcctaatgggagattagaaatgttgttcctgttcccacaagtttgagttatatcacctctactgaattaaaaaaaacccatggtacccactttgagatatgaaaacactggagccagccgggcacggtggctcacacctgtaatcccagcactttgggaggccaaggcaggcagatcacttgaggtcaggagttcaaaaccagcctggccaacatggcgaaaccccatctctactaaaaatacaaaaattagccgggcatggtgccgtgtgcctgtaatcccagctactcgggagactgaggcaggagaatcacttgaacccgggaggtggaggttgcagtgagccgagatcgtgccactgcactccagcctgggtgaccgagtaagactccatctcaaataaataaataaataaataaaaataaaaataaaaataaataatgaaaactctggaacctaacttgtcctgaattatgtttcccatagccttggcaacccaaggtaggaaactttaaattttgcaacatgtatctcttacatggagagttctctgtgctatattaaatgacagaaggaaaactcagctcatcacacttgtaaaagaaaccacagcattcctaggtttaaatgttgagtcataacaattctatttgatgggcttttaaatatcttggaatttgcattttgaatgtgttaaacatcacaaaaggattttgatggtgttatcacagcaaatactgtaatcacatcctataatttatataaccccaactgctgtcagtatgtcaaaaatcatgaaatgttattcatgatacacacaacttctctactgaaggaaattgagggtcctgaatcaaattccttgagggcatttttaatgactttgtatggtaagtctgtccactgtgaagggtagtcaggcaagtcaagcagtgggttaataagtagatcaaagcttcaaatactcagttgaacaagccaaggtgtccggaaggcaggccagggcagagaggtagacctctgaacggaagcaagtttagcagcctgggaacacctgcattgcagagtgcagcagtgatctgcggctcgtgctggaggccttccaggaagcaggccaattaaccttggggctaagagttggtatcttttagaaaccttgcctctggtctgaacttttgtacccagactactctagatgggggccggaaggagaagccgtgacattgtcagactttttttttttaataaccgaactctgttttgctccccccaaatagtcactttgtcttattaaagaagagatgatcaaatgtaacctcatccctccatgcacaattatttgcaaatgttcacctccaaatcagtcttatattcaaacatagtaccaaacttctgcaggaaaggagttggggccatcaagatgtgaaaggtgtagggagtccagtgcagagttgcaatgaaagaggggaagaacagaaatgttccgtagaagaagatgggacaaatgaaaagagcaagtttgcctcctgagagaagagggagcagcagacttcgtgagcaggcaggggacctgaccccagatgggcaaagtgacaggatcttttcaagagcaaggatagctcctatttaatttcatgctatttgctctgctatagtgaaaacctctgcaccttcctgaaagtccaccacattttcacaaaggcctccaagagtggtttttggaggacatcatgggaagttttagttttgtacctctctacactcttgggaagggggccagagagtgtgcattaggatggtgaggtagtttacaaacagaacaaatctagcaggagctcagaaccagagtaactgcacagctgcaaacaccatccttccgcaggaccacagtagccaccagcagagccatggagcttcttcccacatgggattggttgggataagttactgctagtcccattgttagaatatcttgactgaaagatatgtttctgccaaatgttcaataggttataaaatgcagtgattttaaaaagggtcagaagatgtccattttgattttttttctcccctcctatgttatgtaacatctgctcctcagcttctccaattgaagaatgggaagattggccttcattaggagatctcaaaaatctgacatccagccatgtgtgaatttcaagcagtctgtgatccctcccatcaaaacttgtacatgtgcatgtcttattatttcattttatttattttttttggtagaggaggctgtcatcctccaaaatgttaagaactatgggaacagatctcttatgtttagtctagctatatgggcctctcttgttttcttttgttgtaaattgcttctctttgtctacctaaatgacaagcaaaatacatgaattattttctgtagggaaattgagaagccaacaagcctgaatgcaaatcctgcatgacatgtcttattgtacagaaatgtcagtgactaggagagagacaaatccactgaagacagccttggttggtaccaaaagatagtggcccagatccttgttatatcttgtccctggtaaatgaggcaaacaccatgtcactgggtttgagacacaagtcctattgattccactctcagtatacatctcatatattttcccttcttatcattagcaatgtgccatctaccctgtctcctgcctggaacatccctgcagacttctaagtgatcttttgggttcactcttaacacttccagccttctccctgccattattttagttcctgggaggtgagcacccagccaccctctgccatcatggtcctttcttgtttcctggctaacacttacctaatctttatgtttcaagttacaaatcccttccctaactcctcaaatagaaagggaccacctattactctctcatagaaccacttcttgttcttgttagcacttagcacagcttattattattacgtattgcttgggctatttttaaattatgcgtggtaactctagagtaacggtcactaaaataaagtctgggtcactaactgacatttttttgtttaccactctgttcccagtacctaacacagtaccatacaaatggtaatatggatgaatgaatggtaaaatagtgtccacttgggagaacctgattttactcttgttatagttgaatctatttacctaatgcttctgcagtcctttaagtctctttttaagtactgcctcttctggagtcccctccctgcactggctccatgggccagttattatacaatacagtatggttatctttatttactcctgtgtctcttcactttgtaagcatcccaggactgaatcatgcccaagtctctcatgtccacagtcttccttggcctaggctttatagatatttggtaggtaaataaatagcaaataactatattattagtcctgataagtttaaatcttaaaaaactgtgaatgtaatgcacttatcacttagctataacctagttgataaacagtatgtaatttcacacccatctgatttatccatggttaaaaaaacacacaactgattttacatatggaatgttgaaactgggagcacatacggtgacacctcagagagcctgcatcttacatatctttgcatgtggctcacatgcccaatactcctataaatgtttgttgtgtgagtgaatgagtccatgaatgtatgacttcaacttgctatcacttttggtattagattttcaaatttcccaacatggagatatggaagccattgttatttgaaataactctgtgtttgttactcattttagttagcaacaaaaagatgaaaacgatcaaattttaccattcccacatgtttcagagcttttcccttcttgtggttgtttcctgaacacacatatttgagggaatattcagtactcataacgcgtttaaagacaattgccttgagttttggagcaattgaattctgaaatagctcatttgtattagttataggtaagaagctatccagataacaatacagtctgattctgttggtgtaaaccaccttatcagttgaaattcattgcttcataaaatcatttaagccccctcatatattaatttagatcaccgttaggattttttaaaaaaatctaaatcatgatgtatcttttattttccttaagaatctggaccagaagcacaattgatttcttcacatgaaactggaaggtagctgttctaggggagaaaggaaacttttcatctaccctcttagattcagtgaccaaagctgattaattaaactgacaaaaacagattattaggagaaaggtttatttcatatgcacatggggggccacacaggaaagaagtgaaaactttaaaaattagttaggcctttgagtttatatactgttttaacaaagggtaataaattatggagaagtgacaagacaaaggaaaggaggtttaggcttctaggggtggcacattgtgggaaggtaaatagggaagacaaatggatgataaggattatttagtaaagtttgctatgcagacgaaagttagtgctgtttccagtgataagagttattgcctcttcctggtacaggagaggggaaggcaaaccttcacaacaggaaatttgtgtccaaattttaggcagaaaaggtaaaggacacataattcctcctgcatctgctctttctcagttgccttcagctgaaaataatctttatgacaaagtggcatattttggggtggcatattctgatccctgtcactgtttatagtcttccacttattagcaacttcctaatcattgctgttggcttctgatggccgccattttatactgctctgtccccaatactgttactgcatttatatacatttccttattaattagcatcctgctgtattctgtgacttcatattttcttttatcttttaactgagtaatctcatctgtcagtcatgatattactgtgggtcataagggtttgaaaaccttttaccttttttgtaccagtgttggacatggtaatcttaaggaaggctgttcctcaatatagcctgttgaggtgaacatgtttggctgattttcttaactggttttgtctaatattccttgcctgattgttcaagatgtctcaccaccagtccgtgactaagtgtgggggaagatctgtcagggcacccagacaccttagagccccaagtctctagatgtcttctttgtggtaattaccttcctcttagtatccattcaaggagccagtcggaggtgtccaaaaaatcacttttgaaactctccaaatgaggagtggaaagcctggggatactgaggaactgacctttgtccctttcaacttggtgctatcagtgaccacaccccagaatttctgaggctccttgacaactcaatggacattgacgaaagaagtttgaagactgaggctccagcctgtgctctgccatgtgcccttatataaatcacttcctttttctgggtccaagtttctctacttcattgggtcaggtgctataaaatttatattgtataacaaagttaaagtgctgatactgtgaatatttaaaatattcatgtgaagataatcattgcagtaatgactcagtgggttgaatttgcctactctaagtattcttaggtattcatttctaaaatatttctccagaaattcttagtacctggtatgtaggagacatttaataagttttgttgagtgaaaagaaaaccttacctttccctgggttcatgcattgttgattgagcggccaaaaataatgataaaaattacagctgcatttattgaatgctcacagttggccaggcacagttcaaagagattaacacataactatatgtcaagaatatttctaaataaatgtaacattaatattttatttaaatataagcatatcattaagtataaatatataacagtcttatgagataggtattattgttatccctattttcagatgataaaactgaggcattgaataattgaataactttcccaaatatctattccaagatatgtgttttaaaaaaactgtgtcctttctgagtagaatgcaaatgttcaaaaataaaactggtgagttattaaagcattaagacatttgccctttatctgaataatccctggcttgtcctttgctgaaactttgagcagcatgatgttggaattcctttatgataaccaagtggagattcctgacaccgtaaaggtatgatcatgtgcttggtgctgaataaagtttgtgagcacagccaaggcccaaatgcttctcagatctgtgtgcactaccatattcagtaagtaggctgggaaaatccatgaagctatttccaaaatcaaactgttttgccaagcttgctttctctcctcttaattgtgaacccagggttatttggacggaaagttgatctatgcctctgtttcatttactcattactcattaaactgctatttaattctaggtatatgagttgtcagagctttctctaaagctcctctaaaccaaaatttagattttggattgaggcagtgttcactgaggccagtttggctcacatctaaagtgagcccgagcttaaaatgagctggggcttgagggatctccaggtcaggccgagcaagttaaggtgacacaggctgtttcaggggtcagagcccattcctctgttttgagattcaccctctgtgttctcccaaagaattgcaatatggagctattcgagaaagagtcaaataaacatcttgtataatgaggaatgatttcactttccttcctacttaggtatttatgtcacttatggagtgattcctggattacactttcctggctggagtgtactagggtagttaggaacacaggccctggagccagaggacccggtttcaaatgcttgctttgccacttagcagctgtgccatctgagacagcttgcataacccttctgtgctttttatcacatataaaagggggataatgatagatactgcctggcttgcttgttgtcagggtaactggtgcggtgtcctctcctagggacctgccttctcccctctcatctgctggtgctgtggcagccaaagtagggttgcctgctgctattgcaaagcaacagtctaacacgtacatactgtttagcatccatgtgaaaaggaaaaggttcccatgagccaagctggtgaagtaagtgtgcagagaagactgagtataacacaatgggggtaagggtatatgtgacctatatgtagcatgcatgtgtcatctaaaggtatttgtttcacaaactttaaaaacagctagggccaaatgaaactctacaggtgcaccttctaggtgctcggaattcctgatgcctgattatgccattcacaccttttcctgtactccagaacttcaacagctagaatagcagcagaacacatctcaatctctctatacctagagcccaccttccaagttcattgtcactcgcacctctggagcctgatcatgcttgagcctgagcccctagtgactcactgagctggtgctgtcactgtgtgccctcctacagtccaccatccagaaggggcttttctttcttggccatgctcagggctgtcactattgctaggcagtgtcagtcaaggtgaaaaggattgtggagtttcaggttgagtttgccctgaaaagcaccatctccacagtcagaaattctcacttctgtggtgtctcctgctgtgcactattaaccagcccattggcctatcggtacttcatttccctgtctgattttggcaccttctttgtatttttttttttaactttctgttatgggtagtctatggatgttcctccaagaagagtttctttctctgagctctgctcactcagcagaatgcctccacatgacagatgcctgggaaacatgtcctaatcaattgattccatcttaggtccatcaccaggaatttgctaacatccgtgtgcatatgacattatatgaggactgatacagatgtgggttacacccatttattattatttctcaatgttcagtaggaatataaagggttcccagagggtgtaagaaccaccttagaccctgagaaacaagggcagatgtattcagagcagatgcaaagacagaaatatggagggaaaataacaaggaagagaaatgcaagctaagttcatatgtgattagacattttccatttttagcctcatggcttacatttgcataattcttttaaaaagaaaaattaattatttatgactctagcttttaaccaaaccgtgcatttaaagtaatcactctgggtaatttaaataaaatcttttctgtaaatagtttatgctcattagaatgagaaaactgttggtttattcaattaaaaggacattattgccagtttggattctctctctttttttccacttcaaaacagagggcagtcacattgagacagatgggacttaattaagttgtctcaaaagtaaccagattttgctttaaaaaaaaatttaaagaggacagattccagaagacttttcaaaaaccagatcaccattttagagttctgaagtttttaccctttactctgatggatagtcagtacaaacataagtttgtttcctggcaagcatgtaggacttttcacatgagcccagcagcaatcagagaagatggttctaaacaaagctctgccctactgtgatctgtaaagaatgcaaaaacaatgaacctgcttggtgcttctgaatgtaggtaacaccattcactatggtaaagaggcttttccaaagaagccatctgtattttcaggatattattatcttttgtttactggttagttccctgaatatccatggttcgtgacagctcctggagagtgtgacacctgagtgttttcccagaacatggcaggtgtgtagctctgcactgaagggtgagcaggcaactgatgcctgaggtctatgtttggccctcctttgctgtaacatgaacagtgttacagtaattctgattgaattgggatcagggagccctctcactcagtccctttggttcacctgtggcatgcagaattttgggactccatagagcagagttcatgaaccactggaatagataacttataatatgttgacatagtgaatcaggcttctttggctgtgacagaattccaggttggccagacttgtgtgattaaggaaaatcaattgaatcataaaactgaaatgtcaaagtatagcactaccttcaggtgtggctagctctaggtggccaaatgctgtcaggaatctgcctcttgccatctcttggctctgttttcctctgtgtggttttattttcagatgaggctttttcccctgtgtgcagtcaagatcgtcatcagcagctccagatttttatcctaccagtatagccctctgccctcagaagaaagaaatccgtttcctcatggttccagctaaagccctggtgcccacactcagggattttaccacctgcttatctctaactgaaccagtcatgtggtcagcaagatggagagttctgattggccaggcaggagtcgcgtgtctacccttggatttaagggaaggtggagtcagctccttccaactgcaaaatctgagagtaggggctgggttttacctcaaaggcaaatcaaaatgctgttgccaaaaggagggacagattcagtgcaggcaaaaaactgctgttttctacagactccttttagatagaacagcctatgagcctaagcaaaacctgttacttttcttctacatccatggagattttgtttatgtccagtgatgggagacttatacctctgaagaaaagaaactgatgtttgtataaagaggaaaaggactggggagtgagggagagtagaggagatgacagaaaatagaaaatgccaacccatctcaaccatccaaagttcagtcatctttctaggaaggaagtgaataaattatattttttcctgtcgtcgtaaatacttgttggtttaccacccgatatctcctgtgagaagtgaagtgagagccaagactgtaacaggttttatccctttacttcctgtgctctgtgcaactgtttggcaagggttttttaagctcttgtttcaaccaacttctgtctaaatgcccagaattcgtggctgtttgagctacttaagcttttcaaatgtaggcaatggggatatatctgtgcgagaggtttaataatgagatggtttggcctgtgtggcctcagcataccaaatcttcatctcaaatgtctttcagagagagacagagtaacggggtcaggttagagcagcaaccactcttggtgatgatggggcaaaagcctcttacagccctcgcctagaactctaatggatgaggccatcccccacgtaactccctttgtctaggtcagtgtagtgcagtggctttgtagagaaagctgggttgtatttgtttgtcgggttttaataatgctgatgtaataaaatgagttgggatgtatttccttctttattttctaaaacatgtttttgttagattgctgtatttcttcttgaatgtttgttagaattcattaatgaaactatttgagcctggagctttctttgtggggaagttcctcattccaaattcattttcttttgtagatatagggctatttagattttttatttcttaatatcaatttttctcatttgtgttacaaggagtttgttcatttcatctaagttattgatttattggcataaagatgttcataatattctcttagatttcttttaatgtcttcaagatctatggtgataactcctctttccttgatatataagagcaaattttatatataatgatcacacatatatacatgcatgtatctatatattatgtttttattctttttctacatcattttgaattgaatgttttaacttccattttatctccacttctgacccaataatagctacacctcttagttgtttcttttgagtgattgttaattatttgtgcctttaacttctcacagtctaccttacttatagtggaagaaacttacaacagtatacctgcaatgcccccctttcacactatacgctattattaagatactttttacttccacatatgttataaacctcacaatacattgtttttattttgcttcaaatagttaataaagtgaggaagaaatcttatagttacccacatgtttttcatttctggtgctatttattcttttggatatactcaagcttccaattggaataatttttcttcagtctgaagaatttcctttaatttttcctatagttcacctctgctggcagtgagttctctcagatatattttttttttttttggtatgaaagcatttctactttgccttcttttagagtgttattttcactagatacagaattctagtttacagttgttttcttataatacttgaaagtggctgctctagggtcatttggcttgtattctttttgacgggaagtcactgataattcttactcgtcatcccctaaacctatgtgcctttattttattagctgcttaagattttgttgttatgatatgttttcagcagtattacacagtgccttggtattgttttctttttgtttatttttcttgaggttcattaaccttcttggattggtgggtttataatttttatcaaactaaagatatttagtcattatttcttcagatattttatttgttctgcactgctccaaaaccatcctggacttttaactgcacatttattcatctacttgatattatcctactggttactgaagttatttttcaacttttttttctctgtgtgcttcatttcttattgtttctattgctgtgtcttcaggccgattacttcttctgccatgtctcatcctttgttagacccatacagtcacttttaaaaaattttaagtattgtatttttaaactttaggagttccatttggttttggtttttattggtttttgatttggcttttaatttttatttatccctttattgtgttcatgttttcttttaagtcttttattaaattttagcagctaatttaaagtctgtgtttgtgaattttatcatttctgtgtatatgttacctattgattgttttaccacttatgagtcacattttcccatttatatagtaatttttgaacagataatgagcataatgacattgtgatggtgggcattatgtttctgagtgtctggattttgtctattttaaaggaatgttgagttttgttctggcagtcagttaacttacctatatatcaccttggcccttaaaaagcttgtttctaagtcttgattaggtgggtatggcatatctttcactctaaggcaaccattttgttgctcaattattgagaatccaattggcatttggatttctctagtttttaaatgtgaacttcagaagcaaatctgcctctttgaggtttgggcccaagagccactgataagacctgactttctatactaagagaaaaaactcccattgaattgtaaacaccagtaggaaataccgatatttgttaagagttactctatttcatgatttaattgtaaattaatcaacggcaggaaaaattccactgaaaatacacatagatttcaaaatcataggaacatgtgtttggcaaagtgtgcttgaagattgccaaaccccagacttgggggctggggaacaaaatgtagtttgagagaatcagcaatcccagcatattaacagacctccctttcacataggaccaaaataagcctgaagtggtatggtagtcagtgtgtcagcaggcttgagtggagaacaaagctctttgctagtctacaaggagaccacttcatttttatttttaccttgtattcccttcattatccattaacagagtactttaagtttttagggaaagagcagccagactatttgacttgattatactatcagatcaaaaaacaggctttggagtcagtctcagtgtcctcatttgcagagtgaagatgattgtacttgaaccctagagttctcagggggctttctgtgagcatgcatagatcccttagcacctggcctgccttggagtaagcactcagcttgtgtgagttctcattgttagccactggatccagtcttgactttgagaagtgcttatgtgcacaaagagaactaatatcaggcaacacatggctttggtagttctttctctggcccagtgaacataatatatatttaccaatgggccaaggtaaaaacaatatgtaagagaatgaaatgttcataaattttcccaagaaaagaacttcacttagactagaatcacagcattcttcacagactaaaattatagagctgaaagttccctgaaggattctctaatcaggagcatctcacagaggactgtctgtctcccacagctcacacctctactctggactggccatttactgtgttcacttccgtgagacacagacttcatggataaaagagctacatagtcacttacttttatttaatagcttattacgtttttcataggagtaaggaaatggaaggacaaaattgaacctttcagtttacatagagatagggctgccacagagctccgtgtgaaggcatcatttcatcagctgtatcagctgttttcaagagcaacagggaacccattcttctggagatgcttctccagagctgtcttctgaattatacccctaagccacttagttagagcagacagctttttaacatgggattctttaagatcatctttcaagtgaccctagaagatggactgttgtcatcagaccacttgtgatttgctaaatgatgctctctgtcttgaaggcagccattggtaaatttacactggaacaagctaaagtgacattgtgtcttttgtttctagggtaagttctagatcaacaagagacacagggttgtctttcttcccctggctgatgatatactgagacagtgtttcccaggaatgtatctctctttgttcaggaatgttctaacagtaaccatgcagccaaggagacagaagaacacaatgatgaacctggcatttgcccttgctgtggccacctcctattgtacaatttcagtaggtggtagaagcccgtgtcactgtgattaactatctttagggaggcctctctacacaaagccactattttgagaggcttacgattcagccataaaaatctgaggacagcatttaaagttgtggaagatacgacagtatcatatggtatcatacggtttttttggtctccccaccacccccatttttgagccatttcacttttgcaagttctttttgaacttttttaacttgagacatagcaaagcacaaaacatgataaaaatatttaaagcaccttactgattgtgtgacttcttgagtttgtaatgtcctctaaagatgagttccagagcttttgcacacctttttgtcattctctcagtgactcccttaagaaaaaagacttttataaaccttatgatagctatgtgatgttcaccttagagctcttacatctaaaaacctgtttgcaaactaaaccattgctatgcaaatgtaaagctccattattgttaagtaaaaataagtaagccaaataaggaagcaaatatagactccagggagttgcttgagaaatctggaagatctgctttgtaatattatatttcatcctagaaggtcccacacctttgataggtgcccctctccaactttgaaaatcccgtgaaaagtgtgacacttaaaatattactcacttcagctactgtattataaagttatcaaatattatctgtcttagaaaattcatagctttgctgctttttgatcattaaacttctcaaactttgtaattcttcattatggctaccaagaatgttaaagctattttaccccaatgtctttacatagtgtcattttctatgaaaagaatggaccaggctgggcatggtggcccacacctgtaatcccagcactttgggaggctgaggcaggtggatcgcgaggttgggagattgagaccaccctggccaacatggtgaaaccccatctgtactaaaaataccaaaaaaaatagccaggcgcgttggcatgtacctgtagtcccagctactcaggaggctgaggcaggagaattgcttgaacccgagaggcagaggttacagtgagccaagatcatgccactgcactccagcctgggtgacagagcgagactccatctcaaaaaaaagaatggaccagagtttagtaagaagaatgtcacctcttccactacagcatgtgtttctataatgtgaattagctcccacgtaattggtaaatagagaatgatgttactataagacagaatctcactgcgtcatagggcatttttcctggactgctagagttttgcaccactgaggaagcaacaggtgatagcagagtataccaacccactagcgagcagcagcctgcagaggggcacatttcagcacacaagagtttttcacttaaatcttttactctgggctccagctggtcacatgttctgtcttgggacatgttccctgtttgtttcaccccagacctgagccttttgcccttgctccattactcagctgcctgaactcttccttaaacttcctgccttcaagttattgactccttctttaaaaaatgatagagtaatttatttttttaatcaaaacatgtcattttaattgtgctaatagtttatgaaagtggtgattgtttttgtttggtgttctggttaccaagtttctaagagtttgagctgtctgttctaatcctatttttcccatacattctgttatttttagtgtgcaattttacagaaggtgaggtttctcactgatatatatcataacatagcagaaatgcctggagttgtacttatttcaggctaatagttgtttttatattatagaccaggtctgtggctaaaaaatatggcaccagcatagtgcctcttgctttctgaatgtgtagattgcatatttatttgattctgccacctctgatattttttgctatgacaaaaactgtttatatactcttcccactgcagacatggaggatgactgaagattttgttcactttccaatgaacaaagtgtatgtgttgggggaagttctttctgtttgtcattcttgggggcccggtatttctagttaagttactatacagatttctttgtggttcagcagtttgtcagctctctgcaggttctctcttgaagacatctgttgagtgcagtaatggcttcattgcagactcttgagttttcactaattttcttctgaaggattttaatgctgccttttgtagggaatatgaagaccctttcatctttttggagagtttcaagttctttggctcccatctcccctggtgaggttttccttggaggaccattctggccattattgactctctgggttctccatgtctataacctgccaaacaggctgtctgcctcacacagcaagtcccatgtctgtcccaggtggctgcagagccaggttgacaggaggctgaaaggaagtatcagtaccttcctctactgtgtccccattggtacttctcttcctctgtccctttcctcccctaactttctcggcatagtgtttccttatatagacctacattggctccaagctcacaatctcagaggaattacatgacatgcataaattatgaaacatttttttgcaaattaagttttaattaaaaccagcagcttagagcatccaactggaagcagtcacaatgttgaaaagtgacactggtagggtgggagttcaggagaaggtctgagtggctttgcatcctgtttggatatttccaaaatgaatgctgcagaaaagagcttccttccatatcagaccctccttaatctacactgccgccttcgatgaatccctttatgtcgttagaccctggactgccatggggaccaatataattttcaagcaggaaatacaaatgcatccttattgtagttttatctggactttgccaaatttccatctggttctaccagtctgcattctcacagagaactggcagaacctccagctcccccacattaccaaaactccaattcagatcacttttcagccggatgatcacccacaataaggctgaagaatggcaattttaattggaaccttatttttcagatacaatgcagagtgaaagcttgatgagaaatgacttctaattgtgagaattttcaggacattataatgagcaaaatgtggggggccttccctccactgatactccttagctatatgtaatatgagacttgttctggtctgcccattaataatgcacatttttcagcatctcaaagaatgtctgccatcaaatgagtaatttatgcaggcttgcctttcatctaggcagggctgtactactagaacaaaaactccagatcttttcattcaaaattaagtttgaaaatatgaccttcagtgaccagtccacattgctgctaactaatctggtgtggtggacggtgtggtgctctttgtagacctgtagcagagctagccacttggccattcaggaattttgaagtttaatattctctatgcctttaactcattcagaccctgggaaaggcttatccagataatctgtattttaaaattactggaatatcttttttttttttttttcttagacagagtcttactctgtcacccaggctggagtgcagtggtatgatctcagctcactgtaacctctgcttcccaggctcaacagattctaacgcctcagcctcctgagtagctgggactataggcacccagcaccacgcctggctaatttttgtattttttattagagatggggtttcaccatgttggccaggctggtgtcaaactcctgacctcaagtgatctgcccattttggcctcccaaagtgctgggattacaggggtgagccatcatgcccggcctggaatatctttaaaaatgaaggtgttggcttggcgggggtggtacaatgaacatcagaaagagagaaccttgctcagagtgtaacttgggacaacttttcttgagagtatttggactgaaatgtgcaataccctttaaccagtaattcaccttcttgaaaagttgagagggtgcctaacaatttgactacaaggatgtccattaccgtgtcattcatgttagtgacagcctagatctctaataataagaaatttaataagtaacttattacatattcaaataatttaaatatcataaagtgatttaacatgaagttaattgagatcagcggtggatattagcatcatagggagctttaaatgtctttttttggcctatcttttatatctaattttctacaaaaaaccggcattacttgtgtgatttttaaaaagaaacacttaggaaagtatatgtgttgccaagaagggtctttctgttcatcttttccttgcttttaaacataccattggaagaaaaaaaaaattgaagtcccatccataccccaaactagagattgagaaatcactattaaattatgtatgtcctggtaagataatacccaatttcataaaagcaagaaaatttggaatacatagataccattttacccataagtctttccaacaaaattggaaggacttactgatatgcagcaaaaattagaatgaggacatgactagttttaaagtagtaaagtcagctatgtttgtttgcttttattgaccctgtttttatcttatcttaccccctgcagggttatctctctacctgtgttcctactctttcctcctcctcctctttcaacatcaccataatagcaaggggttagctgaagccatgcaactgggagaggtcactcaattagggattatggagtgagcaacagggtgcccacatttaaagagctagagaaggaaggtggagtgaaggaagtagcagactggcactcatgggaaagctggggtagggaggggagaagattccaaggagaaggatattcagagagataccttttgtgtccctgacctatccaatattattataaaaaccagaatagcttccagactttggagaaatatgatgtcccatgtgtttgtaaggaaatttcatgcatagcattggaaatcttttgaggaaattactcctgagtatttttgaagctgagcaaagagttacagaaatattttgttgaatccctttatttgtacaaataaaatctagttgtgatctgccatggtgtgtacctaagagatacccagctgcaagtttctatgaaaatagtagtcctctgggggcagggcacagacaaacaaaaagacagcagtaacctctgcagacttaaatgtccctgtctgacagctttgaagagagcaatggttctcccagcatgcagctggagatgtgagaatgggcagactgcctcctcaagtgggtccctgacccctgacccccaagcagcctaactgggaggcacccccccagtaggggcagactgacatctcacacggccgggtactcctctgagacaaaacttccagaggaacgatcagacagcagcattcgcgattcacgaaagtccgctgttctgcagccaccactgctgttacccagtcaaacagggtctgaagtggacctctagcaaacttcaacagacatgcagctgagggtcctgtctggtagaaggaaaactaacaaacagaaaggacatccacaccaaaaacccatctgtacgtcaccatcatcaaagaccaaaagtagataaaaccacaaagatggggaaaaaacagagcagaaaaaaaggaaactctaaaaagcagagcgcctctcctcctccaaaagaacgcagttcctcaccagcaacggaacaaagctggacggagaatgactttgacgagttgagggaagaaggcttcagacgatcaaactactccgagctacaggaggaaattcaaaccaaaggcaaagaagttgaaaactttgaaaaaaatttagacgaatgtataagtagaataaccaatacagagaagtgcttaaaggagctgatggagctgaaagccaaggctcaagaactacgtgaagaatgcagaagcctcaggagccgatgtgatcaactggaagaaagggtatcagtgatggaagatgaaatgaatgaagcgagaagggaagtttagagaaaaaagaataaaaagaaacgaacaaagcctccaagaaatatgggactatgtgaaaaaaacaaatctacatctgattggtgtacctgaaagtgatgtggagaatggaaccaagttggaaaacactctgcaggatatgatccagtagaacttccccaatctagcaaggcagaccaacattcagattcaggaaatacagagaacgccacaaagatactccttgagaagagcaactccaagacacataattgtcagattcaccaaagtggaaatgaaggaaaaaatgttaagggcagccagagagaaaggtcggattacccacaaagggaagcccatcagactaacagcggatctctcggcagaaactccacaagccagaagagagtgggggccaatattcaacattcttaaagaaaagaattttcaacccagaatttcatatccagtcaaactaagcttcagaagtgaaggagaaataaaatcctttacagacaagcaaatgctgagagattttgtcaccaccaggcctgccctaaaagagctcctgaaggaagcactaaacatggaaaggaacaactggtaccagccactgcaaaatcatgccaaaatgtaaagaccatcgagactaggaagaaactgcatcaactaatgagcaaaataaccagctaacatcaaaatgacaggatcaaattcacacataacaatattaactttaaatgtaaatggactaaatgctccaattaaaagacacagactggcaaattggataaagagtcaagacccatcagtgtgctgtattcaggaaacccatctcacatgcagagacacacataggctcaaaataaaaggatggaggaagatctaccaagcaaatggaaaacaaaaaaagtcaggggttgcaatcctagtctctgacaaaacagactttaaaccaacaaagatcaaaagagacaaggccatacataatggtaaagggatcaattcaacaagaagagctaactatcctaaatatatatgcacccaatacaggagcacccagtttcataaagcaagtcttgagtgacctacaaagagacttagactcccacacaataataatgggagactttaacaccccactgttaatattagacagatcaacgagacagaaagttaacaaggaaactcaggaattgaactcagctctgcaccaagcggacctaatagatatctacagaactctccaccccaaatccacagaacatacattttttgcagcaccacaccacacctattccagaattgaccacatagttggaagtaaagctctcctcagcaaatgtaaaagaacagaaattataacaaactgtctctcagaccacagtgcaatcaaactagaactcaggattaagaaactcactcaaaatggctcaactacatggaaactgaacaacctgctcctgaatgactactgggtacagaacgaaatgaaggcagaaataaagatgttctttgaaaccaatgagaacaaagacacaacataccagaatctgtgggacacattcaaagcagtgtatagagggaaatttatagcactaaatgcccacaagagaaagcaggaaagatccaaaattgacaccctaacatcacaattaaaagaactggaaaagcaagagcaaacacattcaaaagctagcagaaggcaagaaataactaagatcagagcagaactgaaggaaatagagacacaaaaaacccttcaaaaaattaatgaatccaggagctggttttttgaaaggatcaacaatattgatagaccactagcaagactaataaagaagaaaagagagaagaatcaaatagacgcaataaaaaatgataaaggggatatcactaccgatcccacagaaatacaaactaccatcagagaatactacaaacacctctatgcaaataaactagaaaatctagaagaaatggataaattcctcaacacatacaccctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaagaggaattggtaccattccttctgaaactattccagtcaatagaaaaagagtgaatcctccctaactcattttatgaggccagcatcatcctgacaccaaagccgggcagagacacaaccaaaaaagagaattttagaccaatatccttgatgaacattgatgcaaatatcctcaatcaaatactggcaaactgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaggcctttgacaaaattcaacaacccttcatgctaaaaactctcaataaattaggtattgatgagacatatctcaaaataataagacctatctatgacaaacccacagccaatatcatactgaatgggcaaaaactggaagcgttccctttgaaaactgacacaagacagagatgccctctctcaccactcctattcaacatagtgttggaagttctggccagggcaatcaggcgggagaaggaaataaagagtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaatagcggacaaacagagaaccaaatcatgagtgaactctcattcacaattgcttcaaagagaataaaatacctaggaatccaacttacaagggatgtgaaggacctcttcaaggagaactacaaaccactgctcaatgaaataaaagaggatacaaacaaatggaagaaaattccatgctcatgggtaggaagaatcaatatcgtgagaatggccatgctgcccaaggtaatttatagattcaatgccatccccatcaagctaccaatgcctttattcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactgataccaaaacagagatatagatcaatggaacagaacagagccctcagaaataatgctgcatatctacaactgtctgatctttgacaaacctgagaaaaataagcaatggggaaaggaatccctacttaataaatggtgctgggaaaactggctagccatgtggagaaagctgaaactggatcccttccttacatcttatacaaaaattaattcaagatagattaaagacttaaacattagacctaaaaccataaaaaccctagaagaaaacctgggcattaccattcaggacataggcatgggcaaggacttcatgtctaagacaccaaaagcaatggcaacaaaagacaaaattgacaaatgggatctaactaaactgaagagcttctgcacagcgaaagaaactaccatcagagtgaacaggcgacctacaaaatgggagaaaattttcgcaaccttctcatctaacaaagggctaatatccagaatctacaatgaactcaaacaaatttacaagaaaaaaacaaacaaccccatcaaaaagtgggcgaaggacatgagcagacacttctcaaaagaaggcatttatgcagccaaaaaacacatgaaaaaatgctcaccatcactggccatcagagaaatgcaaatcaaaaccacaatgagataccatctcacaccagttagaatggcaatcatttaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactggttatatacccaaaggactataaatcatgctgctataaagacacatgcacacatatgtttattgtggcactattcccaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagaacacatggacacaggaaggggaacatcacactctggggcctgttgtggggtggggggaggggggagggatagcattaggagatatacctaatgctaaatgatgagttaatgggtgcagcacatcagcatggcacatgtatacatatgtaactaacctgcacattgtgcacatgtaccctacaatttaaagtataataataatttttaaaaaataaaaaatagtaagaaaaattcagttcactccagatgccccaatagcttatactgagctgaaagccattagaagctaggtctcatggatgtggggtcagaagacaccatgggtgctgagctctgccatgtcactgccatgccctccctgctgttgacttcactcttaggcctatttgatgatctttccccagtagtttagttctaggtctttcctcacagattgtagtcaagaggaaagctagcaggggaaaagtgggagaggggtgtaaatgaaaagtctcgattagactagattaggtcacacgtctaccctgagccagttgctgtggccgagggaaagcgatgagttgagttgatggcttgggtctgggtaatgtccagatcatggggcttggcctcttacctagggcaagggacactgaaggaaaggggttagataatgaacataaagagataagtgttctggatttctcacctgtaaaattgtagtaataacactattagtagagataggagtcacactctgcctaatgtaccttgctcagaccctatcatttcttcactaacccactgtgatgcagcagtggctcagtgagaggggttctgataccaggtctgtagggtcacctgtggaccatgaggttggtgattactgtaacctctcatacgctatcggattggagccagccctaagtactctggaggttacgaaatcaaaggatgaaaacagcaaactgttatgggccagttgttttcgtaaagactcaatatgcattagctcgtttaatcctcacattaatctcatgaaataatgttattactactgttttacggatgagacctctagagttcagagacgctatattgttgtccaggttcttatggctactaagtggtagaggtagtatttgaaaggtggtctaccaagctccaaggccctccttctttcattgcttcttcctttcttccttctttcttctccttcctttccttctgctctcatttctctctttctctccctctctcttcctttcttccttccttcctttatctctttcttctctctttctttccttccttccttctttcttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccccttccttctttctttctttctttctttcattctttcttcccctccctcccttcctttgttcctctcttcctcccttccttccctttcctccttcctctctccccccttccttttttctttttctctccctccctccctgatctttttttctttctttcccatttccctctttccctccttccttcttttcaacaaatatacactgaattcttaccaagggccaggcataggtatagtccctaggaatacaacagtgaataagatagatacagtccctcggtagatcttatatggaggtcatcaaaaaacctaaacaagtaaagaggaagattacacagtgcaacaaatgctaagacaggaataaacaagatgatattatagaaagacacttggggtagagataataacacctgccagaagaggtgccatcagagctgagatctgacgcatgggtagggaatcagtgaggcagggaagtggggtagtcagagaattgacgtgaagttgtcggggcagagcattaaccaaccagaggaaagagccccacaaaggctttaaggcaagtgaaatttgaagcacaggctgccaagtaccaggcttatactttcagatcattctgggtgccatgtaaaggaaggattggattggagggctggagtgaacctggagagaccagatgagcagcagtggtggcatggtgtggggtggcagaagtggaaggatgtgagacaacctgcactgccaaatcttagctcatcagagaccccttggcataggttttagagtttgagccatttaacagaactttctttgctctatagtagagtgcggatctttatccacattgcttaatgaagaagaatggaagattatacatgcaagcatccacagggaaaaaaatgaacacacagaacctcagcagcaagcagggattgatcattcattcatgaggcccgaggcaaagggccagttttacaaatggaataaagatatgtaggccaggctttttttgttttacacagttggcaggaaaatactttgtttcttatttggtctttacatatttcacagtgaaatgtgttgttttgatcaatagatctttaattggagttttatgtttgaaaaagggtccactcaagtttggaacttcgttgagctagagcactagatgtcccttcaatcacccccatgggtctgtgtgaaactctgaggtagaaatgaagtgaattaggagaattaaaacaaaaacatgtccctctgctcggtgggtatttttctttttgaaatacctttatcagggcctcagatctcttcctcacatctcctttgtgcctcacctattgttcctcacaggttgcctgcgctggtcccatctcatcacatgggctctccctggtgggatgtccccgattgagtcctgggctctcgctgtcctctgcctacactcaccccttcggtaacctcatctacgtgcagacagtaaccaagctcaggcctcctcccgggacatgagcttcatatttccagctgcctaccctacacctctgcctgcaatcctaagagacatcttgaacttttcttaattttggacaaaactgagctcttagtgtttttcctcaactgtgcttctcccatactcatcttctcagtatgcctctcccatagtcatcttctcagtaaatggcagctctgtttttgcatttatcaaggaccaaccttggccgcatcttttatgtctcttctatcatgatccaggctatcatctcgattctcaactctacctggggtcagactattgcctgctgcctccacaccaccagtgtgctgatcctgttctccctcagttcttttttttttttttttttttttttttttttttttttttttttttttttttgagacagcatctcactctgtcacccaggctggagtgcagtggtgtgatgttagctcactgcaacctccgcctcccaggtacaagcgattctcctgcttcagcctcccaagtagctgggattacaggcacactccaccatgcccagctaattttttttgtatttttagtagagacagggtttcgccatgttggccatgctggtctcgaactcctgacctcgggtgatctgctcacctcggcctcccaaagtgctgggagcacaggcatgagccaccatgcccggcctctgtcagttcttatctagaccattcaatagtctggtcaccggccttccttctcaaattctgtctttattgctctctggctttgtgaccttgtagtttcaacatctgcagaattagagtaataatagagcttacctaataagattactgtgagttttcagtaagttaatataggtaaagcacttcaaatggtggatagcatgtcacagctgtcataatcacctgtcattactgctgtcttcaatatcctagtgcatggctgttagccttaagataacctcataggccagaatgactgctagagctctagtcatcacattcaccttcctggcagtaggatggagggagtccttttaaagacactatctggaaaagccacatttatgcatacctcattggccacgactgaagccatttaactgcttatatctttaatagagtcatttagctaagcttggctaaaattagggtttctggtactgaaaaagaaaagcagcatggcaataactttgctaccaattgcaggtatgtggtactaggaaggcctgcgaaaagagcatatgacaagagagggtaaacaagtcttctttgagacacagacaactgaccagagaaataggtgtttgccaggcaagtggagaggggtcttaggaagagctccaggatgagaggacagaacaaatgtctgtgaccagagagagcacggacagtcttcatgttgcaccatccacctgatacaccacatattgaaaaccatggtggctgggttctctgtcctccatccagactcttccataaggagtcgtgccaggatttctcatccctgctttctcttctgggtgatgcccagatggaatggcccatgaggtccccaagtcctttgggggtgtaggtttgtgctgctattgtgtggtcgtgtgagaagtagcactggttggagcagacgtgggtccacacagagccttgtccttgactttcaacaggaacatttcctgactggggtgaccttggtgagatacttaaccattctaaatattgtctgtttcctcacctgtaaactgagaagatactaatatctaatccagagattcactacaaaaagcaaaagagctaaaactgatcaagcatttagccaggtccctggtttaaggaaaaagtccaatcaacagtgactatttctgttattgctgtcacctttatcttcatcatttcctctccttcatccccttctgaatacacattctccatgtttgaatgtgaagtgtcacctgaaatgtatcctgcacccagctttttctcaggagtgtgtaaacccacagcacaccacaacttttttctttaaccttcttttggaaaaatgacttgaggatgtattcagttatacagagaatcctacagtctgcggtgtgggccaggaaggaacccaatgctgcctgtccagacccctcatggagtaaatgaggaaatagacccagcaaggcagagcctggttggcaatgcctgacaaggtggctttgaagaagaaaacatctccccggtgtgttgaggaagagatgtgacctcatctggagcctcatgatgatgagaagtgcccaggctggttttatgcatatccaggggtcactgagacatcactcatagacagacatctataccaggcatgtgggaatgtgagtttcaaatctattcctctagcagatatatttttctcttgaaggccatcagcttgggtgattaacatggtggtggggggtgttgattcaaggattcaaggcagttaccccgattatctttccctggcatcaactctgggcatatcctagtaataaggtagcttatttaacaagggaagtaccagtcacaggttagaggacttcacacgtacatatggggaagatgtcttctctgccctcatggagtttgtgacctagcaggatagaaaggcattacttgaaaaaattacatagtcactagagttgtgctcagaactatagaaaaaaagcgcagggaaatgttttgccatttcttatttataacaaattctgctatttggttataatattctttttttttttttttttttgagacaggatctcactctgtcgcccaggctggagtgcagtggcattatcagggctcacagcagcctcaacctcctgggctcaggtgattctccccacctcagcctcccgagtagctgggactacagccatgtgccaccattcccagctaattttttttgtattttttgtagagatggagtttcactatgttgcccaggctggtctcaaactcctggactcaagcaatctgcccaacttgacttcccaaagttctgggatcacaggtgtgagccactgcacctggctggtcataaaattctttccagtgaaactcaggcatgacttcagaatccttctcaacatagcccttcatccagccgttgctaattagttagagctgggtctcaaggtaaaacctagcggccatccaagacctggcctttccccagccctctctctatcattccactttacaggcaagcacactggccagaggctggaaggcatatgcctcaagacttgagtcaaaggccaaagcagagcaggtatctggctggtctggcccctagggcagggccctgcacgcaagtcatgaatgctgggtgacaatgtgttggggagccagctcccagcagcagcatctgtggccacagaggatctgatctaaatatgtgctattctaccctgagactccttcagagaggtccagcctggtgagggcatcacaagctgtaatttacattatttaaaagctccagtaggaaagttgctctttgttctcgtaagttatttcttgaggaaaatatatgttttgtggggaggatgagggcagtcttaaactgaggacatcaccacaaaggcctggtctgtcattttccttcccaggatttcttcccatatgcttaaatggatgagtcaaaaagaggtgtttcctgctcaacaaagataaaatagagagagagagaaaggacagctctcctgtcagagaggcctgcaaagtccagcagtttgtgcagggcttcactttggtatttattttgcagtccatcaaacatttgtcatactcatggccccttgctttcacaggacatagctgcgattcgacacaaacactttcctaagaaaatatacatttttcattccacaatgttcatgtatccaaggtttgtttcctgttgtgtgaaaagatgtttaatatttgagaagcttttttaaaagtgattcctcattttaaactcagtttctcatctcgtggtctatttttttctgaactcttgaaaagcactggaggagcttatgagcttcctttctgaatagttccagccataagtaggaggaacaaatcaggaaaacatcctcatatttccgtcttcttaaattgggagacccgtataagataaaagtgttggaaattgagtgttggagaagttggagtctgcttttcatagacattctcaataccattttggagacatctctgagatccaaaacatcttgtttgttcggttctactctttgtgggctccatccacaggggcaggggtttagggcaagtttaagagagccctggtcttcttttatcagaagagaaagcattcttcccagagtaaaaagaatgggaaagtctgatgattcaagtggagaccttaagatgtctcatttagttgctttgcattttctagcacttctgatgtcataagctctagagagacagagagaaagtctactgtcacaattcccaagtgtttggggtctttatttatgtgtgaattgagttgaattagtatgttctaaagtcaggcagcacagtcctatgattgtttatctatgggacgttgtataattacttaacctttaagttccattttagtttttctctgtaaaacagggatacctagcattgggttgttgtgatttaatgggataatgcaaagacgtaatacagtgcctggtgacaagttcacactcgataaatgttagtccctatgttgagaagtaaatcttcgtaatgatgtaattcttagattgggtatttaatacatggatcatgttaattccattccagattagaaagatgctttcaaaaacactgcatgctataatggcagtcataatactgtggaattaaaccgtagcctaatactctcaacacagaaatatagacaaatatgtctcgtaaatgttgatctttttccacatacctattaatttcagttcctcgcctgtgccattgggaaagctgttatgtcttattttatggattgactgactgccttttccttgttcttagaacatcagctttactttaaatgcacaaatcctggtgcatacttccttaaccatcaataaagggaacagttaatgtgctacaaagcaagaaaaattgactttaaaaacaagcatttttctaacagtcttacctttatatacagcagggtttctcaactttggcactatggatatatgggctgggcagtttgtttttgtgggggactgtcctgtgcattgtaagatgtaccacagtgtcccttggcctctaccctctagaggccaacagctctcgctcccttccctttcaccccctagttttgacaaccccaaatgtctccagatggccctcatccagttgaaaactgctggtcaaaggaagaaggaactgggtcatggaattgtgcccttcggatcactgggcagaagagcctcggttccagctttataggagtttaccaactgctttggatgtggtgattcccaaaacacatgctggaaagctcgtagattatctgttgataccacaaattcagaaagcaggtcaaataatcagcactgtagcttcattttgaaaaataacttgctttacctctttttcacttgtctccccattttggtttctccatttgcaaatggcaagaaaatgaagctttaccattaattacttatataatgatcaacttttttcttttttgttttgttttgttttcccccttcagctccctcaggcacaaaaggtaaattctcttctgtcacattccagtcacccccagaactcacgagtcatgcatgcctccatggtgttgtacatttgacactgttcatgaccagtgaaatggtttttttccacagcttcagaaacctgaagttgggcaggaacagagaggccagcagactcagttgtccactgctcctttgctgagttagtccctccaaaggaccctatagtggccagtgattgggaggtgaatctgtgcccaactgtttctctaagaattatcaaataataggtcaagaataagtttgacacattccttccaatgtagcattccaggccttctctgaggtaatttttagggagacaaataatgtgaataattagtaaggcgtggtaaccaagtttaaatttggggctcctaagccaaatcgctgaaaacttattggattttattaattgtaaaaatcagcagctcctttgctagcttcatcatcccagagaccattagagcagatttcttgccaatggccagaccctttcactggtcctcattgtctgagatgatctagttccaccatctagaatgttctgtgtccagaaagactccatgtggttgcagtgatggctttgctgtgtcaccctcatagcatgtcgttgtatcctaaggacatttatggcagaaaatatgtcactcagtgcctgctgcattgttcttgtgtgtttcacaaattctggaagacacagcaatttctgggggccagatgttgtgtttcaagagtcaaggtagggcacccccctgaaatttaaacagcatctcctaagctctccagtttagagcagaggtgatttggttccttctcattgagagagagcacaactgctctactaaagacagtctgttcagaccatatggacaaccagaggcctagaaatcattacacaattactcagatatatttgaggtatttaaacaaggcaaggcatgctagtgtgtgacttggcttgtggtaatgtttgattacacttcaatgccatcacaaaaggacggaatacttcattaaaagttaaagtattcaaggctcacaacagcttccagggtaaataaatggtcagaattccagattgtttggaaggctcaatgtctttgataggacatgctttcttaattacctacatttgaatttttttgatagagagacttcacaaattctctgcctaaaaatggaccagcttccacttattgacatttattcatcaaatttccactgatccatatacaaagtattcctgttacagaaaataattcatgaattggaggtgccatcagccgtagaaatttgttttattttattttttgagacagagtctcactatgtcacccaggctggagtgcaacaatctcggctcacgcaatctccacctcccgggttcaatcgattctcctgcctcagcctcctgaatagctgggacagacatgcgccaccgcacctggcttatttttgtatttttagtagagacagggttttgccatgttggccaggctgatcttgaattcctgaccttaggtgatctgcctgcctcggcctcaaaatgctgggatacagtgagccactgcgcccagccagccatagaattgtaaaacaaagttcaaaacaaagcaacacagaatacagaagaacaaatgttgctgggctatataatacttcagtagcacttacttcattgcattcacttcttctgtcatcatatattgactcacatcacatgccctgcaaagtggagcatattattgtggtcatataaaagtcaaggaaggtacctcagctggcttcctaatttttttccctgtctccgaatgatgtcagacatcccaagggacttgttctatagccctatgtgaaaaggaatagctttgccttctgttcctatcatggctagaaattgtcttttttctgttaaaatagagaaaggcacttaccttacaaaatattaagagatctatgcgacatggtttcagaacactttgggggtagtttgcgggaaattcagctctttgaagaaggagtttgaacgtaaacctcaggtatctaggctggagggtaagaggagttgagggagaggtgcaccatagattgaaggcatcctcccaaaggctgcaagtctccacctggtaatgtattagcatccctgcccccaactccccttcccatcccttccccagtattacctcagtgacacttgcaagaggcctttgccagaagaatgaggttcttgcaagtgtcagctttccttagatttactgtcttgctgcttgaccagcaaaggaatgtggtggttccattttggccttcatccatttgttaccatgggtaagttacttaacctctctaagcctacatgtttttatttacttaaggagaatgataaactaactttccacttttgttttgaaagttacttctcttacctgttcctcgcacagagcctggcatatggtagaccctcaaaatatagagttcttattacgacttggcttgacttgacccctggtgcttcatagcacatcaagagagcagtcatatctgaggggtggtctgggacctctgcccaatgttttgtgattctgactcaagcctaatgaataactgggagagggcaaaagagcccagcaggtatgggtgctccccccatttcattagaaactctgttgttgggccaggcatggtggctcacgcctgtaatcctagtgctttgggaggccgaggcaggtggattacgaggtcaggagatcgagaccatcctggccaacatggtgaaaccacgtctcttctaaaaatacaaaaattagccgggcgtggtggcgcacacctatagtcccagctaatccagaggctggggcaggagaattgcttgaacctgggaggtggaggttgcagtgagccgagatcacactactgcactccagcctggtgacagggtgagactccacctcaaaaaacacacacacacacacaaaacctgtgtgcttaaactgactgcaccttcttcatgtagtcagaaagaaatggagattggtcttgaaaccccaacaaagcaaaaatttgtcgggagaattgttttgagaggtttcttcctaatgcctttgacattacccatagatttcactcatctgtggccatgattctaatgagctctttccaaacccctgagtttgttgttccaggggtgaaagagaggcacccccagccactacagctttggcctacttttcacatgaggtcatgagcgcatacgttgtaccatatggtgtctgcatttgcgctgtgtttttgttggactctgcctttgtatcatctgcaactattttctctataaatattttaaatagttacgtctctgtaaacatacttatttaaatctcttggctgatctgcaactaaaaatgtcccatttgggtgtccctcttatgtgtagcagccattaatgactgttgtctgtaagttatggttttcatgattctaatattttgagggtcttccaaaacttctagtcctttatgacaatgttttagaacaacagtttgaaaaaaaatattattttttctgtggttcttaagcatctctaagataattcctagactctataaatttcaagccttgatataaaattggagtggcactaactggtgatgaacctgataaatattaaatattcttagcaaatatggaggtagtgtcctgaggttttggctaaaaaatatgtagcaatacagatgcagcactttcaaggcgtcacaaattcattcttctgggtggaaattggaccagtttcttgggtggattgattgtccctgaattcaacaatgaagagaggtctatgtgtaagaaaggtctgctttttaaaaattcttctttacttctacagaagtgtccgagagatctgattttatgataataacatagcagaattacccaaagccatttacaaatatatgttcaatagtaatactattgaacaaaatagtccctttttctagctgcatttttcttcacgtagattctgtctataggagctaaacatcagttattcactgcaggattaatttaatcaatgtaggtttaatcaacgtagagtgggcccgaatgtttaaagtcaaaaatactcttcagggagttccaaacgtggctatttatgtggatgaacgtgtccagactctggtaccctttcccttcattttctgctgcatccacacaactttggaatttgcaaaagaacatttcttaaaggtttcctaggtgctctatgtctttcctgacaccgtattagttaatatcaacctgagaattctgagtaggcataagcatttttcacaaaaccatagttaaagcaaaccacatctctaatcctgtttggaacagcaattgatgcattcagggctgcgcagtatggcaaaatgatccctgtttaatagcccgactgcgtgttttgtttcctgttaggaacagcttaacttgcctccttgaacaaacacagcagggttcaagatctgttgttctatgcctgctgtgattttctgtgctgcttaacttgtatgaggactcaggagtgcataaattagcttcttaaatggaggtcgatttttggtctctttttcagaatggaactgttttattaatttctccccctgagtgcaaacggcatcctgaatctatttgcattttctttgtttccttgtttatattatattttggaggaataaatggaagccttcgtttttctagagtctttcgttctttctttctttctttctttctttctttctttctttctttctttctttctttctttccttccttccttctttcctctctctctctctctctctttctctctctctctttctcattccttaggtacaaatttgtacaagtagaatttggcctagctcttatctcagggtaatcagatttcagcaattgcgaggcatcatttatcattctttgcctcatttaacttctatacttcgaacagttgaattaactgtcaatgaaaattgaaaattgaaagtttgcaaagctgctgtttttgtagaactgcaggtctagtgatttcagtgtttcattacagttatataaccatctaaactgatgcaaatgaagtgcaaaactgagaactgataactatttacatttggttctggtttatgactcatttgcttttacctgtactttgctttgcatgtaaactattacatcttgttttgaaaaccctatttttctccttatcatttactattttatagtaacatgtaaggtactttttatatgcattcccaagccgggggtgttaagattgatatactcacagtctgaaaaatgatagcagcacagtggactacagtttaaattattggatctattttatgaataaggctatggtgctagaaaccagagagcaagtctagtcacttcagcttttcctgtagccagcgtgagaggctctgtggaaatctgagtgatggcatattgcccaaccctaacaatggttatataactaagtattttgttctctgccatagttctgtatgagtgtgtctgtggcagcccagacaggctgctctgctgctgaggaaggaggtgaactttgcaagtgtacccatgtgagtcttggctgaccccttttccatggccctatccaactttgcacttgaggcctgaaataaatgaatgcaagaccctcagattcaaagtgcatggcttcctaatggcaggatagccagcaggacagcatataggcactccagccgaagctacgtgtgggttcctgggggtcatggagctctgtttggaagcaagatgctatttgcatttcttttttattttctttctttctttctttctttctttctttctttctttctttctttctttctttctttcctttctttctttctttctttctttctttctttctttctttcttttctttctttctttctttctttctttctttttaaatttgagacagagattagctcatgttgcctgtgctggagtgcaattgcgcgatctcggctcactgcaacctctgcctcctgggttcaagcgattctcttgcctcagcctcccgagtagctgggattacaggcacctgccaccacacccagctaatttttgtatttttagtagagacagagtttcaccatgttggccaggctggtcttgaactcctaacctcaggtgatccacctgccccagcctcccaaagtgctgggattccaggtatgagccaccatgcccagcctgctatttgcatttcttattgaaaggaaataatctcttcatatcaaacaacctcatagtgtgtgtctacttgtgtgtaaggggaaaaatcagggtttactccattttcagatttatttgaacatttgacgtgttcatgtactatttttatgctttatatactatttttcctgattattcaggaaaaaaacaaagtaaaaacaatattacattttattattaacttttttaaaagtttttttttagcttttacacttttatgcatgaaaattgataaaagccttcaataaaacataccactacataccagtaactttcacactttcagcctttgactcaacaaccctcttttgcagaatctagcctaaattggtcagtgacttgcaattttatttataatgaggaaaagaagagccaaaatacctgaaatgagaaagtggttgaaaaagtcactgaacttccaaaaaacagaatattaagaagccataaacaaaaccatagttcaaaaggatatttaataatgtaagaaaatacatcattttaaaattagagtgtaacattttatgtacattatgctcctgttgtgtgtgtgtgcgtgtgtgtacaaacagatgtacaaaactgtattggaaagaaatgcatagacatatttaatagtggctatttcctagtggtaggagaacaaatatgtattttgttttcttaatacatttttgcatatttcaaattctgtattatgagcgtacattatttttataagtaaatgattatatttgtagtaatgaactaattgttttactcataaatacactaaatgaaatagactaccaagagttaacctaacaatagtctgctaagcccaactctcccaagaaataaacaaatgaaaaagtgggaaacccaaactctgttgtaaaaatacacatgcataacatgcattgattcttggtacagacagctataatcagaaggacaaaggtttataaacagtgggttgtcttacgtgggacaagtctgaaagtaccttagcttatcagtaatccttattttctaccaaaggcgatctaccaatctttaatcaaagactcagtccatgtcagatgcttagagcgacattgatctgagcatgggaaatccacaaaaaatggtaggtgtgtggttacaccgtggaggtcacccacccaacatgagcctcagtcagtaggtgttccctgtcctcctcacacctctggttgggggaaggactaccttggcttaaaaatggaaaaaatgaagtggggtgagaatgacatctgcccaacttgctatttggagagtgttgtaccaagttgtgtaacctctggtattgcattcatcattgcagaagggacgcattccactcctacaggtgaggcaaaggagcccatcgctcttaagactaacttgagtcagctggatatggagtggaggccccacctgccagttctcactggtaaccttggacccaggatatggacccaggatacatcgtcctgagcctcggtttttcttgttttaatggggtacagacacgtcccttatgggattttcctgagagtacaggagcagcacctgctcagggcccatccacgccacatgctcaatgaggggtagtgttggccatggcagggacagtaatattattaataatgctagcagcattataccttgtttaatacagacacatttaataaagttaaagcagaaatggtttcttttaaaaataggcaaaaagaacttggtgtttattaagttgaaaaccaaaaattgattttacagttccttacatctcagtgctttctagtttcagacttaattcttagtgtcttagaaatccagtgtcttctttcaaaaattctcatttatttaaatatgtgactgttttctatttatttaaatcaagcacagttataaaatatgactcttttaaggtgctaaaacaatacaaactgtactcacaacattgctgcaatgaaactgccttttcttttgaatgttaaggaaacatctgagtaaaaacaatgaaatttttaaagttgttttcatctcagttgttcttacatcctcgaagatataaaaacacccttcttccttctacacagaagggaaggtagaggatcgaggaaagttatttcacaaagccctctgaattgggataccatgatattaatgtcagtatcaccagtatttagcctgggtggtcttgaaggggacatcacaggacactcaatgttctgtttccttgcttatagatacaattctgtaggtcatttttattgacacaaagttgatcttgaactcaatgagttgggttttcattttggggtctcttccgtatttcttggtagatttagaacacctgtatccatcacttgacacactggatgtttcctgaaatcaacaatgtatgaatctacactttatggccaaggccttggaagaggccagctaaagaacaagttaaaggacaactgccagtatcttaaagagataaagaattaagcaacccaggaaataaacatattttattttctaattgcattagagaaagatgacacaagaacaccattttaacactgaggtaaatcagattcaatacaatttagttactaatttgaaaaccaaatctatgtaaaatataataaatgaagtctatatcaaatcaatgtgaaatcatcatcagtgattttaatctgactttattagttctcataggaagggatttcctgtgtggaagatatactagattaatatgatgagttactcaagagaaaacacacataccatatgtgcatatgcatagcttttctttactttttggcaaaatttttttgatacaatacaaatcgaattttctgacaaaatttgtctacctgtattgtttgtgcacattaaaactaaaaaattaattattttaaagaagcaactgccttttggtttttcttagtaaattgagccacatatttaatggtctggtcatgttcagctgcctgatgctttttccagtcatgttactcactggtcacatccccaattaatggatatatatccattacaaacccaaatgtagcccacttccatgagaactgaaggaatggctctggatgcgctgccagacatctcatgccaaaggattcaactgaaatgaccctctggggtaaactggagcagttgtgcaatcctgtacatcagtgctaccaagaagttcaaaaacaaaatgttagatgtttatcccttcaaattaactagaaggattttggaaaacccaaccaagtttcatgaagtagaaaatgtcaagcaaagactaatgtcgtggtatggattttctttttccagaaatgactcacgaaattgaaccacttgctgaatcatgagccctgtgtgcttggatgggacccatccatatttgcccaggcctggaacacattagatgatttacaggctgggtacttctgaagcatctgtcccttcttcccagactcccttcctctataacaacttccttcccagtgtgcatccttcctaatctcctttaatatttatgatcataattaattataattaaccactccccacccccaccaactgctttcatattatttaactgttaagaccaagatatttgatcatgggataaaggaaacatgtcttcctattttatttatgcaattcaggagatagatgaagttcaaatctttggatttcaaagaagcataagaatttctctggcctagtctggaatggtctttatgagattaattgcacttgtcagatgtcccaggcactgtgctaggcactttatgtctataattcatttaatgcctccaagaactctaaggacttttcctatttgaaggatgatttgcttgattgcaacctcctttgctacacttcaaactcctgagggccaaacatggcatttgtctttgcaccccaaaacaagagtctgagggtggagtggttactacacaggctctggcatcaggtagaccaagactcagatctctactctgctgttttctgtacctgaagcaaggcactttgcctttttaactccttcacttgtgaaatgtgcgtaggcacttgcaacgtctttgtcagggttcaatttaaggctacgtagatgcaaaacattcacagcaacgtttggtagcaagtacaaatgatatttggcaatggatatggaaaggtaggcgtgtggatggatagacagaaggaaggatggaaagatagatcaataaaaatgactcagcaagtttgagtaaccttctccagcatgttaatgcaggtctgtttgcttccgtttgcttgttactttttgtcttctccgtgctgctaagcacattgcagtgttcaactaagctgtgttttttttaagtccttttcttttatcactgtgacatcagctggacgttgtgcaccagcttctcagcacttccttacagtctcagtccaaccacattgatacaggcaaaatacacaaagatattcagtgaaggagccgtgagcaaggagagactgtataatgtgaaagagggagcactagccccagagtcttgcctgaattctggtactaattttctctgccttctttactccctgggcctcatttgtgaaataaattaaacgatagtgttggaataaattcatttaaggaccatttgctgggcatgtcttgtgtaccaggctctgtgctaaatgccgtggatgaaaagaggaatctttcccagcttctgcccttggagttcacaggctttacacaattcccagcatttcttccagccacagtgttcagtgactttgcttcattaacagtttgcacaaattttggtcctagatggtatctttggttgtagaataaagatgattatctttgtagtgaagtttgagaacatctggttctcatttccacttagttagggaaggttttatggaggaagcagcatttcagggggtctttaaacaaggagaaggttttgtcccagggccccaaagctctgacagttgcctgtgttttcagggcatctacttggaggtgtctaaaccacgtttgtgaaaatatgaacatttggccaccatggggggtcaattatgtgtcatggctcatcataaatattgaccaaaatccaatgcctcatgataattttcattgtcattagtcctgggcattcttgaaataagcaggttatacccaaataaaccaacaaagcggtttccaagacagctttcagatatgttaatcagtgatattctcatgaccatggctttatttatatatgttcatggtcaaaggcagtatcctccctctatctagaagtttactcataaaacatattcctttcttaatgacatatcctagaatcactggaacaaaaggacagaatatcaaaatgttcccgaataataacaattttattagaagaggactgtttttagattctcatatagatgttccaagattgtccagcattatattcacaaagttgtcttcagtttgttaagaagagaaagagaacaaacaaattcaacaatttagctcatacaagatgcagttaaagttcaaagagggaaatctgtttacttttgtatttaaacaagttaaaatgcagtgaaatctcatggaagaatatggaatctccagatctcaaatgcaagtaataatgattcagtaagaagagggaaaatgttttggctaaaagcaaaatatcttttttgtagcattctcaagatttagtgattacactttaccaagacaatcaagtgaaaagcaagaggacatgttacttgaaaggtttacttatttcttattcttgtttcttattctaattgtaaagtctctcaattaaaactgctcacaatcagcaaaccttaagattatcactaaaagtagtggaaatctaaagaatataagagcagagcaaaatccacagccagagtcagatgatgttaacattagccaagtaggcagaatcaatactgtggtccctttccaggcatgagatgcaataggatctccctgccccacgtttcagtggattttcacctgtgttcttcctccaaaaggtgtctgtatctctactgggggtgtgtctccagagaaaacatcctcctgaacatgcctagcacagtcttactagattctttccctgacatgtctgcccagtgttgaggataagagatgttgtgatgatggaagtgggtgggagatttgggggtggtgcaagtagttggccattgaaaggttaggtacagaggacttttttggctggtggaggagggaagggtgcagagactttgtttggggaaggtatctaaattgccacatagtctgcttacatccccttttccagatgtacgtctccctgctgttctccctggtgccctcacaaactaattgtacagagagctgttctgatggctttctgttgtcttcctctctccttgccatggagtgtgcaaactgcaggacatgggtgacatttcttcccagcctcaccccattaaccctattatgtgctacccagagaatggcccttaagaattcccaagtcattgataaacttaagctcatggggagaggtgaaagtgccaaggagttggtgtcccttttgttcaagctgcatttgagaaagtgggtgtgaaagaacctctcctttgctaagctcccctgtcacattctcagattctgcatatcttttcttcttcttcttcatctttttttttttttttttttttttttttgagatggagttttgctctgtcacccaggctggagtgcagtggcaagatctcaggtcactgcaacctctgcctcccaggttcaagcaattctctgcctcccgggttcaagcaattctctgcctcctgggttcaagcaattctctgcctcagcctcctgagtagctgggattacaggcacccatcaccacgcctggctaattttttgtatttttagtagagacgggatttcaccatcttggccaggctgatcttgaactcctgacctcatgatccacctgccttggcctcccaaagtgctgggattacaggcgtgagccaccacgcccagcccagattctggttatcttaaagaatcaatggttctcttttcataatgtctcgtctgatttatagatgtgcacagctgtgtttttccacctcttagtactactccttttctgtcaaggcaaatgttattatcagacctaattgttgataaccgccggtctttgcttcagttgggtaggtaactaaacgacatcagctggcatttaaatacttttttttttttttttgagatggagtcttactctgcagtccaggctgttgcacaatggcacgatatcggtttgctgcaaccgtcacctcctgggctcaagcaattctcctgcctcagcctcccaagtagagtagctgggattacaggagtgcccccaccacgcccagctaatttttgtatttttagtgcagacgggttttcgccacgttggccaagctggtctcaaactcccaacctcaggtgatccgccctcccaaagtgctgggatttggccacttggcctcccaaagtgctgggattacaggcgtgagtcaccgcacctggcccctaaatatatttttgtttgtaaggcccatactctggaaatggctttttgtcgtccaggacctcgtgcctgcaatttaccctaatggccactagatggtggcagtgtcttttcatagagtgcaggttgaagttcctcgcaggtgttgaaaggaagctagcagaaacaccgctgcgtattcacaagttatacacacacatataaaatatttatgtattatagtattatacatttatattatttactaacatagtcaatatgttgatcaatgttaataataaagcaacacaaatgtaagaggagcaaaatatagaagaaatatgatatttgatgagagttagtggattagcttttgttcttgacttggagccagtcctgtatctgagctgagtccaccatttgtgcacaaccttccctttaagcccaagcctctagggctgagcagatctggcaggcggctccgctgaaaaccacctggcagtcctcaaatgggctgccaagagtgctgtccttggcttgctcagatgccttccaggtccagcttgcctcctttctctgcagcttggcattcacccccaggggcttccagctgcaggagaaacagaggcttctgccaccagtcctggcaagcttcctctgaatagagttatgaagaaggcaacccaaacagatgtccttcaaaggtggaggctgcccagacagcaagcacatagccacagctgctccccaccatgggcaaccactggggaagcagccaaacttctactcattgtgaaggcttgacataaaattctagtgacaatagtcttttataccatcataaagagtagtcattaccatcagtatttgggtactttgcaggtacctaaatttcttctcttgtgggaaagatatgcaaccatccatcttgggaatgttggtacccttttgcctttggcctttttggcctcagaaatttctcctttgtgtggattgtacatggcacttgggaccacctcagtgggtatctagagctgcctaggtcatttatggcccagattggtatgtctaagagttacaaatccatttcatgctcattgaagctaaaagagaaaacttattggctcaggcaaccccataatggaaaaggggcattggtggaattgatcttgggaatgaaggcattcagggacaggtaccctcccgccctttccctcttttttttcctccctccctctttatctctctcttctctgtcacacacacacacacacacacacacacacacacacacacacacacgtctctcctcctctctgttgagtttattttattcagtctcatcgcctctctgtggcaaggggacacggctgtcaagctgacattcttatagccattcacaaaggagaataggtagtctttcccatttgctcctggttagaaaaagaaaaacatctcaggtagcctagcctgaactacatgcctagttaataaacttaccagtgcagctcgcgcagagtgtgtgtgtgcacacttctgtgtgtgaagtgctctggttaacacagcctgggttggctgtccatccccacactcaggatgggagagcttgactgctaagaaaccttgtggttggacggggtgaagaggactttcctaaaggaagtgggtgatacctgcagaagaaggaaaagaaaggggccaggcagtttacaagatgtctacccctgcattgttccatttaccaatatccttaagtataaagcaatggaatgaaatcactctgcggcagactactttctcctgcgtttgttagactggctttcaggaagcattctgaatctgtcatataaaccctgacagatattgataaacaccaggcattttcactttagttcatgctggacttggaaaagagagcctctctgctcaccgaatgagagccagcatgccattcccagctagttcttcctctgccatgttagcttttctttctcccttagcagacttgaggctccttggggataagacccatgccttattcctagttgtcttcccagcacatggcatggaacctggaacatagctgatgctcgaggagtgtttattaaggaaatcaatgagtaggtgactaggccagcagcaaaatggatgggtcacaagtcctgtgttgttatactctctggggtcatgccctaggtctagccatgttgccaactggtgccatcagtgggaaactaatcaagtattaaggagtaggcctggcatggccacgtggaccttgcacatgagttcaaatgcatattcatatgagcctacatgcatgattaacttgggaagctgacaggaagcagtcaatctgttgagcaagtttgtgttttataaaccagatgttcagtattattattcatcatttcctttgatacccaaatggtccccattatgtagcatgggaaatgaaggatatggaataatatatacttagtatacaacagagcaccacaaccacaggtttcagaggcctgcttaaagcctgggcaagtgtaattgcatagcagttcattttaagattcccacttggacttaagttaatgggattttgcccagatggaccatggtgacccccacctcctgctcctaccccttggaaaatgaatgttgactctacgtctgcatttttcttggaagccacatgtatgaatcataagcagcacccttgcctcagtagcagctacaggttggggggccacagaaaagcagggacccccctagcaacgtgttgggggacagagggtttctggccatagttggctgcataacttctgcttggtggtctgggaaaaaaaaaacaaaacttgccattgactgctatttcctatggcaagagtatagaatgcctttcaatcataaagtgcttacagtgcaaatgaacttgcaaattgatgtgtttctccatgaaacgtttaagattcacagagtccagacctgtggggactgggaatgatggagctggtgggtgcagaagagagtcttaattttctgcaaatggtatttctgtgttcctgccagtctttgttgccataatgatgaactggtatacataggaaagcctacgggttagggttctggccaagccagttcaaattggggccagaactgcccctaggagaggtccatgagatcattggcccacatgtgaactgttgccagactgaactgaatgcatttcctttgtttacctggggctggttacaaatgaatggtttcagtacaaatgcaatattatgggtttcttttttaaagtaatgatgcagtaattacatttggaattagctcctgagtgaagttgatactatattctggcttaatattttgaagttagtttctcataatcttgtctttgtgccaggacaattactagtaatttataactgatttttactggttgcaggaaaaaggcttcatttctcattattgtcaatggtatgtttttatttcatccatgttacatgttggcactgcttgaaatttgatttgagttgcaaagtggaagttgtgcggagttatggatcagctcaaatcagttttctttatagcattaacgattaatcaaggagtcagaatatgggaagacttctaattctaagagaactatttaccatgggctggttctgcctttgaaaatggccttgcaggtttccagtggtggccacagtatgctttgagtattttaagcaagatgttagaaccatgtttccaaaaactattacagactgtatatactggttgacttggttcatggcaacactaactgtcagcatcatctcatagttaatattttttgtttattatattgatgaattaaagttgtttacatattctttcacccaaattagggtgcccaaaataatcacttatatgattaccatgtatattattagtcatggttctctagagatagcctatagagctagagataggctatacagatagggtggggaggaatttagtttaaggaattgggttacacaattgtggggctggcaagtctgaaatctgcaaggcaggcagtctgacatgctggaaattgcagcaagagttgatgttgcagtcttgagtttgaagacagtctacaggcagaattccttcttttgaggggggccttgtcttttctcttaaggccttcaatggattggatgagacccacccacattatggagaataatctgctttactactgattaaaatgttagtcacatctaaaaaacaccttcccagcaacatctagactggcagttgctcaaacaactgagcatgatggcctagccaagttgacacataaaattaaccatgtcaccatgagttcccagtcctagacagaccaggagattcttgcttcattttacttgtcacggagggatataggactatcttgatatccatgtaaaacttataaaagcatggccccctccacccctgttgggagtttttttccaacacctgccagcttctctttagctgtcatgattattggtggaaatgaaatggaaaggattgccctatacgaatgcttcttgcattttaatatacatacgaatcattaaaataattattcacattcagagtgtttggaatggggcctgagactaacaagcacttaggtgctacaggtgctgctgttctgggtactacattgtaagtagtgacaccccacagctctaataatctattagaagaacaaggcaaaagaaagactaagtttaatgacctttactcaagagaccagccagtcaatgggggcttcaaacgcttagattttaggatcttctctttataatgcctctttccaagtagattgagggagcaatgcctgattattctgtggaactaaagctatggaagagaagtgtccaaatatcagaaaacacgctaggttgaagatagtggattctagttcacggattgcttcacttggggcttgaacaggctacgaagccagaaggacttgcctggtcaattttggtgcctgtcagcagtgcctccagccttaatctcattttggactctgctacttactagctgtgtgacctcgaaggcagagaaaagaagctggcatcctttgagcacttccatatgccaggtaccatgctgggcagttttctgttttgtcttcatggcaacagtgctggggaatagtgggcattatttcatatgagcatgtggagacttcactagtgcagttaggaaagattcagagctgagatttagaaccagatttgtcttgggccaaagcctaccatgttccaagactctgtttccctatttgtttgggacagagtaggggttcctgcctgtctcccaacactgtgtaaaaagcaggtgcaatggtgtgtctccatgtgtctgtaacccaattgagaggtttacagacgtgaatcacatgctgtatttcaagggccattctttttttttttctttttttttttttttgtttttgttttgggagagagtctcgctctgtcacccagcctggagtgcagtggcactatctcggcccactgcaagctccgtttcccgggttcacaccattctcctgcctcagcctcccgagtagctgggactacaggcacctgccaccacacctggctaattttttgtatttttagtagagacggggtttcaccatgttagccaggatggtctcagtctcctgacctcatgatctgcctgccttggcctcccaaagtgctgggattacagatgtgagccaccacgcctgtcctcaagggccattcttataagagaaatgattaccttcttcatcatgattttagaagtcagataataaagttattatttaattttgtttttgttttatttgttttccatctgggactggcattcagagacccagagaggtaaaacagccttgactggctaccttggggaaaataagtgcatccagattctgttgtttttagcaggggcaactcaccagaccctttatgtgcatgctttctgatcctcaatatttagattacggagaagcactcttaagaaacataagtgtctgggaggcaaaatagtaaaataaacctgtgctaataaaataaaatgaatcaggaagatccaaacaaggttctctttgaaccaaagtggctgaaagcagagaacagatctgctagagtgactaatgacaaatgatttgtttccccagctgggggctgggactgtcctctgcaaatccaggacacacattgtgctccgcgctccactaaaggcttgagtgggcactgttccatctcaacagcccctggtttggaaaggacatgattgtcaagggggtggcctccagaactgtggtttccagaccgttccccggtaactggcttttctcttccatccagctgactgatgatcagggccccgtcctgatgaccactgtagccatgcctgtgtttagtaagcagaacgaaaccgtgagtacagtcgctgagcttcctgcttgatgctaggagggtggttttctcagaccccctctgactccagctctggtgacttttgatttttaagcataggatgtatgtcatttttccttattgtttgatcttgctgttagaatcaccaaatcaaaaacagatgagaggaacccaggctggcatcattttagagttggcaacacctttccaaagtttaagtattagaggaccagaggaggaaaagccccagagaccatccatgattatggtgcactgaccactctcatttatagttaccagccttttattagtttcctagggctgttaggaatgaagtgccacaaactgtgtggcttaaaaaaatagaaatttcttctctcacagttctagagcctggaagtctgaaatcaagatgtcagcagggccatgctccctctgaaggttctagggaagaatttctccttgcctctttcagcttctcggggcccccagcattccttggcttgtggcagtgtcactccaatctctgcctctgtttccatgtgacctgttcctcttatatgtctctctgtgtccttccctgttgtaaggaaatcagtcatgggatttagagcccacgctaaatccacgatgatttcatctcaagatccttaacaattacgtatgcaaagatgctatttccaaatagcattatattctgaggttctgggtggacatgaacttggggggacactgttcaactcaccataaagccttaaaaaaatggcctttctgacactgaaaagttttagcaaatcacaatggctacatgccttggaaaatggggctccagaggcctattccttcaccttggtcctcagttggtaaaagtgttagggttattatatatttctcttgctatttagactctctctcctgggcaccagatggcagtgtaaattgagaaagcagttaacatgctgtctttcctgtaaaaagctttcataagagaaactggtgaacgtttagagcccttagctgctgaaactcttgtgtttcttcaaatcagtgtttaattttcaagagaggagagggaagctattgtagtatcttggtaggattatgcgttggggactgtagtagttaatggttggcctgagaagctctcattttacccagtaacattttgggtggagggtgggggatagaagagaccattcttggagatatgggttaatcctcaatctgtatcagtttggggaaggcaccaggcagacggtatgtgacttctcgtgagattctatttcttttgccaagttaacttactgttattataattcaatgtttattttcgacagagatcgaagggcattcttctgggagtggttggcacagatgtcccagtgaaagaacttctgaagaccatccccaaatacaaggtaatgaatgacctaatccctgaaatcaaagcaacagagatgcccagagccttgttttcacaaagttcaggcttcaaactctactttggagcgatgtttttgctcaccactattacagcctgttagcttgtctttataccatctgcacagttatttaaaaggttttttttttattatttacaatgacttgctgtttttcttatttacctcctctaacctcagtttaaagaatcaatgttatatcttaagttttgacatgatcattgaatttttctgatacacacaggatatcaacatgactggtttgccttttaaaaagatagtccaggccgggcgtggagactcacgcctgtaatcccagcactttgggaggccgatgcgggtggatcacgaggtcaggagatggagaccatcctggctaacacggtgaaaccccgtctctactaaaaatacaaaacaattagccggtcgtgatggcaggcgcctgtagtcccagctgctcgggaggctgaggcaggagaatggcgtgaacctaggaggcggagcttgcagtgagctgaaatcgcaccactgcactgcagcctgggcgacagagcgagactccatatcaaaaaataaaaaaaaaatagtccggagagttcttagaccccatccagaaaactctcctatttcctggtggggactctttggaaaaacaaatcaaaaagtgggagggggatgcccttgaggcacaacccaggcacacagcactgcccaagagtgctctaaatgtaggcatgagcatgtgcatgccagaggcatcagagagcagcccccaccagatctggttgattcactggacgaagggctccactggctgcacaggggcgaacaccacatccacccccttctcccccagcaccaagctgactggctagctggtctccatttctggcccactcagattaacgagggttctctttgtctccatctaaagggagcccaggaatcagggattattggctgccaggggcttctttcttggcaccaccctccctgatgtgctggggcctgattcaccacagctgtgagggggacctgggctttcctgggcctcaggtggaggcaggcagtggttagagcttgactctgcaggttcctggctccatcgttgatgaggtgggtgtggacaagtccctccaatccctcgttccccagcttcatccaccagggcttttataattggagttaagttcccagaggcatgaaaggacatttcattgatccaaacccacataataaatattggaaactgtagttcctgagaaactaaaagtcaaagatggagatgagggaagactttgaggcccctaaagatagtggacttgacttttgatgaaattgccagacctaggtgtccagaactgctggctcagtttcagaaaaggcatcccacctgtagagaacttttccaaacaattcttgagcctcttatttcacatgaggagatttagaaacctaagcaccgagccactacttgatacgtgtccaataaatcaagaaagaaggaacatgacaaggaaccagtaacaattatcctttgtgtccatttctccaagcttcctctaccaggcaatgtgcagagctctttatggcattatctcgcttactaagtaaacattacggtcacccccattttatagttaaagaaactgaggcatggaaagcttaaatatcttgccaaatctcacatcttgcaagcaggagaaccatgtctttttttttttttttttttttttttgagatggactctcactctgtggcccaggctggagtgcagtggcaccgtctcagctcactgcaacctccacctcctgggttcaagcggttctcctgcctcagcttcctaagtagctgggattacaggtgcacgccaccatgcctggctaatttttgtccttttagtagagatggggtttcaccatgttggtcaggctggtcttgaactcctgacttggtgatccacccgcctcagcctcccaaagtgctgggattacaggcgtgagccactgcaccctgccaagagccatgattttttttttttttttttttgagacggagtctcgctctgtcacccagggctggagtgcagtggcatgatctcagctcaccgcaagctccacctcctgggttcacgccattctcctgcctcagccccccgagtagctgggactacaggtgcccgccaccacacctggctgattttttatatttttagtagagatggggtttcaccatgttagccaggatggtctcgacctcctgacctcatgatccacccgcctcagcctcccaaagtgctgggattacaggcatgagccaccgtgccgggccccaagagccatgattttaacctctgtaaccacaatgctaccaagaacaataagagcaatgacaatcataatagtaatagttaaaatgataataataactaaaatacactaaaacatttattgaacttcttactatgtggttggtgtcatccaaagtactttacatgcattattcctgttgaattcttattacattcccatgaagtggggacccttcggcctcatttttacttaaggatgcttgaaataactttctcaacatcattctgctagtaacagatgaaggaaacgaagcataacaagggaatagaggaagaagatcaactatagaaaattaaccagcagtgcttgaaatgcaggcatgtgtgttttgtgcttttccaagggtcaagctgggaaccattgacgtagatatggcataagttaacctaaggcatccttccctctggttcccatacagagctttgtgaaaggggtacgtgtcagccagggacagccatggccaaatgggcccctctcatccaggagaggagagctccagggaacagagttcaggtcacaccttgccctcctgattaacaccttgtaaagatgagtcagctcttggctcttggggttttcccagaagatagaattctttctttctcccttagcttcatagattttcccacaagcaatcagacttcctgtaatttttattaagaattccagacaccccagcaataatttccagacaccacgacctctgttaacataacgagccattttataattgggttcacttcattagcccagactctccagttggaagggaagtgcctcctttccccaggctgttggaccacgtggcttctggcctccaggagaatatgcctctggtccagggcccctttggcaagcccaagtgctggaaggccttgtgtccgatctgttctccattactccatggcactgtacattagaatggacaggaagactggttctattttggataaaaccaaaattagcgatttcatcagtgtattgatttgtggccaaaaactaatgttggacttcgtcatataagcttttaattatttgagagactcatccacagaatgtgttgtattttgagatgtggtcagagctgcccttcctttgtctacattaggatgtagctatatgccatcaaccaacacacaaaacattctgatgttattttctcagaatgctttcctggggaggattttaaccagtttctgaatatcaggaagactttctcaggtacaggcttaagaaggactggctgtgcatctcctggagcaaattggcttctccttttcagcttgtttttaatatttactttagttggaattttcaagatgagctaggtaacatttgagttaagtggcaaatgtctaaaatacacaaactgtaactgaatgcctgccacatgcctgaccttgtcctagggactgtagaagtcaaaggtaagtgaggtggcccctttcccacaaagagctcattctgatggaggaagtactgcctccagttatttcttttttcttctcttttcttttcttttctctttttcttttttttcttttctttttttttttgagacagggtctggctctgtcacccaggctggagtaccgtggcacgatcttggctcactgcaacctctgccttccaggttcaagcaattctcctgcctcagcctccagagtatctgggattacaggcacccaccatcgtgcctggctggtttttgtatttttagtagagatggggtttcaccatgttcaccaggctggtcttgaactcctaacctgaagtgatctgcctgcctcagcctcccaaagtgctgagattacaggcctgagccactgcgcccgaccacctccagttctttctaggacaaatcagaggaaggaaagagaactacctagggttgagaggcggaaaagtgagtgtagcttttttttttttttttttctttgagccttactctgttgcccaggctagagtgcagtggtgcaacttccacctcccgggttcaagcgattctcctgcctcagcctcccgagtagctgggattacaggtgcccgccaccatgcctggctaatttttgtatttttagtagagacagggtttcaccatgttggtcaggctggtctcgaactcctgacctcaggtgatccacctgcctagcctctcaaactgttaggattacaggcatgagctactgtgcccagccaagtatagcatttttagatgctagagtaaacatagtgatgatggtatggaaaggacaaagcaaagtgcaggtcaggagagcctttttacaagagatgagctgaggctgagcttatagcatgggtgaggattagccacagggagagagaaggaggggtgccttgggtagcaggcactgtgacaataaaggtctggctgggagagaaaattgcagggggattgttactgccgtgtgccttgagtggcagtgagtggagggaggcagggttgggtactcaggcaggggccagaccccagggagacctgatgaacaggcctatggctctgtcttacatatgaaaggggttgttagtggctgtcacaaaggaaagcaacgtggtcagaattatctttgacttggatcaacctggaggatggttttgttggggtcaatctctgaggcaggaagagcagtgaggaccattgtggaaatctattgaattaatatagtagtggtacagttgggtagcaggatggaattggagcaaacctggagaaaaacattagtaggatttcatactactgatgctgcagtttctaactggggagtctgtgtggttggtggtgccgcctactgagagaggaggaagaagaacagctttagaagaactccactgtgactgggtgagtctgaggtgccagagcaatggccaagaagagatgaccactaccctgttggatacttggtttgccactgaagggggagactgaggccagcacatggatctggggagcagcagcacagaggtggtcactgcagcttattgagggagaggagagctaaggcagacagtaggtactggggacagaatcttagggaaaatgagtacttgaggaatgggcaaaggacaaagatcctgtgaaaaggagaaagcccaggagtatgggacctggaaactgagggaatagtgtcgaggaagaggaagcaatgggctaagaaaagtaggaagatttgagggagaaaatcctgtaaggtttggcaatgaagaggcccctggcaaccgtagagaaagggatttccatggcatatttggtggtggagggagggcaaaggcagaatgcagtgggttgaggcataaaggggcaataaggaaacagagatggcacttggttaatgaatacaggacattgggatgggaagatgagctcagcgtctgcattctgggggaggaagcagagagtttagctaagctgtgtagaatctgcactaaatgcagtttcttctattgtttccctacttccacctttttctctttcttctttcccttctcatctctctattccaaccaccccgccatatattgttaaccgcacgataggacctttgccctcatgaaacttacattctggtaggggaggcaggcatgaaataatcaaaagtcctgattacttatactcaaccccacagataattgattattataattttgataagtactataagagtacaggcattaagaggagtcctgccttcttttgaggattgcttctcacaagcaaaagaagaagaaccaaagtaatgtacattagaaggtgctgaatacatgagctgactataaaatattatttgttttgtttaattttgagtttgaattcccaaatacaatttttgcctttaatggaaaaagccaaactctcaagatttttttttgacccctccagtccatctgaaactaaaacataataatggtaattaatgcagcgttgactgtgtctgacatttttccaagagacaagatgaaagagacgatatacatctcaaaggataggaaatctctggtttatctttcacagcataatgaaatatacttttatcattagagtcaagtagaatcttattaagacttgctgtgcaaggtaactccagggaagacgtctgttgcccttgactaccatgtgcatatttgctttatgtagtgcaacggaaacttttaattgccagtgttaaattctctgaagttaatttcacatcaccttgacgttaagctaacaggcagacagggtcattcctggtttgtaaactctgttgtctggatcatttaatagtatcatattcaagaatgtgagtggcagagaatttaaagaaaattaacagtggggctcagaactgtgaaaaaactcctcaggaaaaaaaaatagaggatttcttttttcttctcccctttcactgctctggcaaaactgggttacattttctttcttcagagagacagatcagtatgggttttatgccagaggccgttttaatacatgaatgatttgtaggtaaatttattgtagccaatgggtgcagtcaactgtgtaatagaaatattgtcaaaaagccgggattattatttaaataagtgcagtgttaaatttgattacatactttttaaagctaataaaacatttcattgctcacaaactatttcccatagtcccatttagtcagaaaacataaatcaagtgaggctccgcatagaaaattacccaggctttgtgttgatggaagcatgcatggaaaagctaggcagccacacaatttgaagacgaaaggatatgaaaagggttgccaggctcctgtgtaggctgggacagggggacactttatatttgaagaattatggaaaatgacggcctaggggagcgccaatttgagatggcccctgtgggcgtggaattatacgaagtctagaagtgaggcagcgtggggacccctctttccttattacaggcagagagaaggcacctccattgataaagttctgtgcacttggacatagggtctttacagaaacattagccactttcttgttaaaaaaaaaaggtaattgttttgttttaaataaatcaaaataaagcccttggatgccaatgtggggatgtgacattttaaattgtgctatttgttgagcttatcctctgacaggtcttcatttccaccaaatgtcaaggatcagtgccttgcattcattttaatgaaatattgtgctgataagggttatgaatgacaagttaaagctgtaaattactaaatgccgggctgctttatgctttgtgaattcaccagggagcaagctaatgaaggtttctttcttgcttcctcttacagttagggattcacggttatgcctttgcaatcacaaataatggatatatcctgacgcatccggaactcaggctgctggtaagagaaattatgtacttctgcatttctgcttttatgattttaaaagatttccttcaattcaacagtgatgacactttgctgcagttttcacttttaaaaaactattgaattcatagcattgtaaagattgttatagagtttataaactggtatttggacacataatacataaataatgttggataaatatatttaccattatgattttgtatataaagccatatatgtgtatatgcatttatttatttatctcacatctgccaacatatggaaaatttttttaactctagacagcatgaaacctatcataacgggtcccttgatgtaatacatggacactcatactccagctctagacccacttactgcaagtctaatttgacacgataaattagacccaagatccctggaaatttattacaatgggatttgcccccaaattacattacttaagcccagtgtcttgtggatagaagctattcaacagcttttttgttaaatcagggcagctgagatttttctctgtttcctgcctatgtcatatccagtagcattgcttggtgaactgatatgtaaaccactttctttctctcagtatcatttttactgtctctgaagtgagtagggttaggccaaatccaaaacagcccatggtagcatcaacccacatccctgggcaaggctgcccttggggcattggccacaagtgtgccacatgtttgccacccctgaactagttgcagtgtgttgaaaaaaggacatccctttgggtttgtgtgtacttagctaatttttaaagaagatatagaattataaagagtaatgcagtgaacactgttttttaaagttaagaaagtgtagatcgttttctttagcaatcaacaaacacacacgtacctatatgcacatacacaaatgcatacatacccatccaccccacccatcttttcccattcatcagaatgagaaagtagcggcagtgcctgctattcaaatgtttgttggcaaagcattgtggggaccagttcacttctcacttgcatcattgtttagaaacagttcatgtgagagctccatcatcatgcaactttgctctaatcgccctggtattaatggagtcatgaccacatcatgtggatgccatatgcatgctttaagatgggccttatggtaatattcaatttcaacaatctttttatcagaaaaggactgaattaactagttggctaattccaaatgtaactcagaattattgaaaagtctgattgaaaaagcggctgtctttttaaagacatttaagtccaaagacatattgaagtttaaaactcttagcacattacccatctccaggttgcccagttggcatcatttgttggaagtaagagaagttacaagtttgcgtgacagagtttggactcctagtgtgtatttattccaaattggaaaggaacagagtccatgaaacaatcaaacccaaatcttctaccagtaaatggattaatttcctatttatcattgcctgtcatttaaaggaaaaatgaaatggaatcagatgtcagaagtcaccaaggtagcatctttctctctgtggcaatggaaatgattagctgcccgccacacagtcgactcacaatgtgaactggtccccacagtgctttgccaacaaacatttgcctagcagtcttttatgtcttctggccctgcagcaaatggtgtgtttgtaaatagtccatctgatgcactctccagagctgtggcccctgagagggcagctgaaaggctcttggaaaagcagaccaactccatcaatgctgttcatctcctaagagtacagatacttgtaaacacatgccattgctgttcttctgttgacacaccaaaagtggtagtggttgctagggtcaaaagtggtggtggttgctaggattttggccatgccatacatggggtggcccaaacaaatgccccatattctgtttgtgagaacccaaaccatatgaaccatgttgcagctgatccatgacaagaacataaggaatgatcagacctgttggtcatctgtcccattcatctgtctctcaccctgaggccatcagatacttagaagaagtttagggtgataccaaccgttaagcattacatgaattaacccatctgaatgtggtcaataagtgtatgttgactctgacttgagttctgcattttccttctgagcaaaagacgcagcatagtgggagggactcaattccagcatcacactgtgaagctcaactcctagtcccactacatccacactatgtgactttgggcaatcacacaggctccctgagctgcacttttctcttgcaatcctgccataaccatagtgcatagatcgtagcttgttgtcacagtaaatgagataatgcaagcaaaggacctggtgcagaaaagcaggccccagaatatctcagaggcagtagtggttatttggacatcttgtttgtgtttattttctattgttctgtcctcagcttccgtaaaggttggaagaacatggtggtaatggatgcttaaagaggcaacctaaagagcactttttgattattcaggtgattcaggtttttgtgatagacattgggaagggatcgtgtacatacaccatcagttttctttttggttctacggcaagcttggccaactgtggtctagaagacaagtagacaacttgtactagaggttctatgtgagtcctaccatgtgaagaaaccaaggttgtttgtttgttttaaaggtagcaataagaataatactagcagccacagtagctaaagaatgatagctaagagtcagccggcatgaatacccgtggctctggcgtgcacaagttgtttgttcatctctgttttgttcacttatccctgctttccccctcctccttccttaaccaccagtcccctcagcacagagcagggactcagtagatgaataagtgaagggatcctctaaaaccagtttcatttttacttactttaggttcttctggaggttgtaaatgacttgtgaacttaccttggaaatccagtgtcttcatggaccataaatccatcctggccagagctctcaggcatggctaggaacagccagctgctagcagcttctctggctagctcaggcagggaaccctcattcaaactccatttgtctcctcgcaagcccagccatataatcgaatccttattacaaatggacgatccccttagttctggccaaggctgccagattagcacggtgagtgtgagtgtggggttgtggccagcatggggaggacacagcaagctgacttaaaataactcctattccctctccatctgccatggactttgtttcggcccctacagccagaggaaagaggtgggtttctctgaagcacaataccaatatttttctaatttgtcctataaaatctttcccctgaacttaatgtttggcttgattttatccagtattttctttaatcttgtgtgatttggttgtgaatcacaaagtgtctccaagaacagctcagacataggggccttaatcagcggactcactttggtttaactggcaaagctgctgaagcaatgcttctctgtgatctctgggctctccttagtcctcctctaagggcttctcaacctttctgtcctcgccaccagcttgtgacttcctgatagattaactgatgttggttcagcaagcattgcccttgtgcctggtgtggctcagtcctgtgttagactgaagactgatgaagtaatcttcaaaggggccggggggctgcagcacaagtggggacagacacctgttctcaaggtggggaatggaacaacagcacgtagcaagagtgattaaatgctcttgatcttgagaaatgctttttgagttgttatgatgcccctggaatgtttgtttgtttgatcgttaccacttgttaaacattgaagtatagctacagactagattttgttttcttgctttttataattcctttgtatttgagagctttaggaatttttcttagaatgtggagccctgaatagatctccttttcttttgcccaacagcggattggtcatccatctgtccctaccttttagaataaagggacagctaaattgatttccttcccccaaggaggaggtctggaatgtggacctggtcaaaccgacaggagaacacaaaggaggttccctttcagcagctgcagcaatggcagggttccacagaggagcctcaggcaggcaaaatttaggactcatttccatgaagcctgcattgaaattggccagaagctgtttgctctgtgtctgcaaacccaggagatgaggaaggatgctgtagggttttcattctggatgaaaatctgccagtcacatgggtcacatatgtgggagtggatgagatgggaggtaaaaatgatggagagaaattcacattcattccttcaacatacactgaatgttcactatgttgtaggcttgagcaagctgctcagagaggtcacagagatgtgccctacctccaataactcaaactctaataggatggatacgatacgtgtatcagtaactgtggacagtagagaagatgcgctttttatttgtttgttgttgttggtattagtatatttttctaacattcactgattcctttttatgggacaggaactattctaagtgtttcacatgtgttaatgcttttaatcactgactaattgaatagcaagcctaggatattatgtgccttggaaaggcctagaggcttaaggaaaggatgaaggggaggggaggtccaggtggaagatacatctagcagcagcctggagttgaagtgaggacaactgtgagtactgggctgagcagctgggcttctctaagatgaaggtaaatatcctcatgttacagatgggaagctgaggcactgagtcctaaggtgacgtctcccagatcacataactggaaagtgccagaactaggacccttaaccccagtcagtttaggtgtactaagttcactctgctgcgtgggttcttcaggaaatgggaggcagagtggttggagggtgggagtgactgggatacctggtctttgcagccatttggaccagtaccgaggtaatcatgtcagaatctgtctagacttaacactgtccagtaggaatataatgtgagccacaaacaggagctgcctatgtaatttcaaattttctaggagccacatctaaaagaatacaaaagaaacaagtgaaattaaatttaagaatatattttattatcccagcatatccaaaatatcagtgtttcaatatataatcaatgcagacattattaatgtgatattttacattcttttcatgctaatctttgaaatatgatgtgtatcctacatggcacatctcaattcaggcaagccacattgcaggtgctcaagacccaccagtggctgtggcccccataagggacagcacaggtctagagtgtgaccagacattttggacccttctagataaaatggattataggacctcctctttccttaaagtgggttagagcaggctctatttccaccaccacccgtcattgtgccatcctggaagtctgggccaacagttagtggccagttagcctcctctgccgtggccaccacccctccctccctcccaggctgtagcctctccagtgtccaggagtggaagtgggaggttgcccagaattcaaggggccttgacttgattgccagggcagatgagctccatagtttggcctggaaactctgcctattctagccatgtaggttcacccctacgccatctagacttccgcagacaaactgtcatggaggccagtgggtggaaagcagtagccacactaggtgaacctgagcacttaggtcatctaaatcagaatgttttgatgccaaagccatttctgttgttctggaaaactcagatgaactcttgaacgagtttaagttttcctaacccaagagtcctcgcacctccgctggaatttaatattgctgtttccaccaccagctctccacagcctgggttccaggatggcactcgcctttccctgtgtcactctggactgtccttgccccattccaaacatggattctgcttctttgttcttgtggattcctgggcagtgcacgtttgttagtggttatagatgggtcctcatgaaaggttattaaatccatggattgatacatggacatgctaatcagtgtaaatgttctcacactttagtcctcttgtatggaactaagtggacatcccccatggacacatgtgaatatgtgttaaatgctaactagacagtgcacatcaaacatcagtttaaataagggtttaaaaaggtaggagcacttctagaatccagctgacttagttcaagcaataggccataggaagagattctgtataattccaaagaatttagatgtgaaagtcaaatggaatttttcttaactatgcaattccgcaactgaggaaatagcaggtcctttcgtccgttcctcagaaaccgcaagctccttcctgctccaaattctcatgctcaactcttctttacctgaaatcttgtcccaggtacaccttttactggcattttctcatcctccacttcttagctcagatgtcacctcagagaagcatcgctgcgcccacccagagaagccatactcctccatcactctccatcacatcccctgctttagttttcttgaatcaccactcttggaaaacgtctattgtttaacttctcccctgtggtcctttgtgaatagctgggagtttgctactacacagagcgggtagtcagtaaatatttggtgaatgatctgcaggatgtttgagtgatgctgatggttggatatctgagtaccagtttcttacaataaatgagaagagcaggtgacacacgttcattcaccaaacatttgttgagtccttgctacgtcgggtgcagaaacagaaatgtggttggttaagctcccttttcttttcatccctccctatcccctcctgcttgcctgcaagcattcatcagatgtccttaagtccagcactatgctatttaatggagacatagaagcaggtagaaggaggtctctgcccacaagaagctcatcacacaaagcaagggttccctggtggtaagagggaccaagaagaactatgggctcacagacaaagtctctgcttttccttagaggaagggtgccctgagatgcagaagggcttcccagaggaggtgggggaggactgcactcagcagatactctacagtctccccaggatcactgacctcaggcctgacttctctgtctcatctcaggaccatgcattctgccggccacagcctatgggggtggggggatggggagttgggcctagcattgttcacggaactttcggtggtccccaaatgcagggatctgttgccagcctcctggacccccgctctcaggctgctgctgaactgaaagagactgtccagtaggtggcgcgcgggcaccgccgagtacccggtccccatgcagagccagcccctgccagtgcacattctcagaacagagcccgggcgactgcaacctaggcctggtctgagtccatttcgtttagtttcaaagaaagaattaacagaggcttagtaagtgtatctgctcagaggagagcgttctctgagaaaaaataaacaagactgtgtgaccccacgtagcgagcctgttcttttggaaatacatcatttggtttgaaaaaaagaaagaaaaagaaaacagagccttgtgtgctttcttcctgacggaattggtgagggcaccgtcctcactgcctggtctgggcacgagtggacagattgcagcgttgaggggagggcttacaactcaagtcagtgggtgcctgggtttctgttgggtgggagctacgccctttctgcaaaccttgagaacccacagctcctgtgactgggtgtgtgcttggacactcaagggattgatggggtctggaatcaatcccacaggtattttttttattatggacagtgtgcttatgaatcccctttgggtgccaggcgccgcagcacccaggctaccaggaatcacaacactgccctcaccacgggtctcgggccaggccttgtgctgagagccctgggtgccttgcctgggtcagttctcattgcctcgtgcgtggagtgctcaccacagaggggttgactgtgtgtgaagattctctatatataatgatttaaaaaattaaattaataaataactacatatttgaagggcaaaaaagatattccctgatgcttaggccaaggaatgtgtcaagcaaaaagtaaattcgggtcagtcttcagaagaaaaaccaagaagacagctatagataattacccacctctgtgagcccatagttcttctgggtccctcttgccagcaaggaacccctgctttgtaggacagtgtattttcttcataaaattaagcttattcaactgaaagaatgttctttaatcctgaagctgtgtcctcaggttatttgacaaaatgccaggttgggctgcagagcctctgtcagcctctccagacagcatccccctggccctaggatgcccacctgtatggaacacagcagtgacccctctgatctgggctgcgactctgggtctgctgagtgggggacactcacaggaaatggagagaggggaggggagtcaggctgtgtgttcacccgtgtcctctgggactggctgcaccccctctaaagcttcataagcctactagtctccgggctccggcacctgcttctccctctgacccttcatgcagatgggtgggtgcgccccactgtttctaacttcagggtgctgcaccatttcctgtcatttcctacaccctgcccaggcctttccaagagcctctttactaaatcctccttaatttgccagctcatgtataccacgtgcttcctgctgtggccctgagtgatacgaaggtgagaatacatggaaggtttgtcttttatagtcattactctgccaggaaagaaagagagaaagaagaaaggaaatatggaagaatgcaaagaaaagtgaaggagggagagaggaaggaagaaagagatggagggaaggaaaaagaaaaaggaagaatgagagaccctctgtcctttattgattgattcattcattatttatctatctcccattgtagtgggagtggagaatttccatattcccttccaataagctcccccttctgctcaagtgattaagaattgttatctgttgctggcaaccagagcagcctgactgatccaaccatgaatcccaaagtctgggaaccactgctgggtgtggctctgacccctgctctcaaggagctcacagtctgacaccacctcctgctgccctgtcacccctcctttgtaaaactttagtcctctcagcctccccttcccccacagaggggtctgtccccattcctcaagtcttcttgcatggacctttgagtctgggctccccacgacattgtagaaatatcatgacacatctgctcctctgtgctgcaagtagcatgaagacactgatgagactgtgttttgttcagctttgtatatccagggcctggtgaggtacttggcaaaggaggtggaatgacaaataaatgacgagagaaaacccatgtgtaggaaatcgagcacacaatgaaacaatatgttatcaagcaccacggttgagagtactgacaagaaggagaatttatgaaagtacctggtgtctcgctgtgcactgggtagctagggaaggctgcagggagctggtttgcagcctataactttgaggccacagtccagcatgcttgggagcagcagaaggcctttcagataacatggatgagttacttgctcatttgtgtgtgactggaacccttcctcccttcctttttcctcccatctttccctcccccacctgctcctgtccttccctcacttggcatttgtctgttgaacacctgtcatgtggcagacaccctattagatgccaaagatctagtgataaagcagatagaattgtccctttatttggtgttttcattctcatagagaagatgtgggtttttaaagttctaaaacaaactgataaataaaaatactacacaatttggataagctcgccaaaagaaacaaaaatctgagaaaacaaaaagtcgggagaggtacctgccttagttagatggtcagggagaccctttcttaaggatgatggttttttcgtttgtttgttttttgtttttgagacagaatttcactttgttgcccaggctggagtgcagtggcacaatctcggctcactgcattctccacctcccaggttcaagcagttctcctgcctcagcctcctgagtagctggcattacaggcacctgccactatgctctgatgactttttgtgttttagtagaaacagggtttcatcatgttgtccaggctggtctcaaactcctgagctcaggcaagccacctgtcttggcctcccaaagtgctaggattacaggcgtgagccaccatgcctggccaggatgatgtattaagctgagtcctggaggatgagaaaaactgtggagactggtccaggctgaagaaacagtgtgtacaaaaactctgaggcatggggatggtgaatatgctgggttctggaatctgttcatagatttaggccagattttcaaagaagggtaggtgacccaggttttgttgacaaattcctatttgaggctgcatgtcgtgaagtcgttgctggtactgccccgtttcctccactctgctctgaccattcctgtatgtgtagcatggctcatacctgacagcagctaggtgaaggctttctctggcttctgtagtcatctcttctcaggcatgcagcagacaagatgtgacgagaaattagcatccctcagccaaagactgcccttctcaggtggggtgtctctgagggttgtgttttacactggctcccagagttccctgatgggattatgccacagttgcccgtagtggtaacatgcctgcaccctgttggctgccctcccatctctgaatcactttgccatgtccctgcgggtatttcctgggaatccctgtcaaataaaaactttgcacttgaatcctgttctcagggacttctgagagaattcaagccaagacaccagcaggctgatgtgtctctgcaaaaattgatttgctgtagactagagcttcaaatgcagttttgagtgctctcacataggcttttacattaacaccatggcgttgagcatgcttcccattccatttcaggcccctgagcatgtattcctaacacaccagcctgcttggagaatccacatttgcttgtagaagtaccaaggagccttggctttatgctattaataactgagagtaggcactttaaggaaatttgatttagaagataggattctcggctgctttattatttgaagaaaggatttgatgaggaaaaggcttttcttttcactggacacactctgacctttgttctactagattaatttcatatctagaatgccccatcttggatgatgaattagcaataaaaacctcatcaaaatgtaattacaggcaaagtgttgaataatgatctcttaaaaattcctgtagatttgtctgcacctccttccccttgtgggggaaatgagcctcagctgccagctactagcctcagctcaggaatgcagaccctagccctattgcaaggctgggatgtgagtgctggcttctaacttgcccagtgtcatctaattgatcaattgcttttctccatgtgattgatgcacatctttatgtaatttaaaggaccatctcaccgggggtaggaatacacaggaagtaggagctcaaggcagaatgaaacactctcctcttccatctgtgacagcctgctggggggagagagttattaattaaaatgttaactgcccagacaatagcaggcagaacagcttggagaaagcctgagaagcaggcattgcattagaactttcataactgcaaattccaggaaagtttgttcctccttaaaataggaaacagagccatctgcctctaagaggagactcgactgggctgcttaagtgatgttagactttcccaaagagcacatcttgtttgtctccggggagatggacttgaccgagagataacctagccttaccctcactctgttgtgggccctgtaaaaccctacagctggatctgacagcagaatatccaaatggtcccaactgggtagatgcccacattcatttgaataactgaagaattcaatcatttgaatgccaatgattattcctctgggagtttacattttagaaagaccttccatctgaatccccatgagagcattaaattgctatctaattagcagtcccaaattatatatatttaaaagataattagaggtttgaaggctgttggaataactggttatacatttaaatgaatcactagaaatttgttggtaatgtgtggagttttcttttatttcttgctcccctctttgaagttcagtagacccaacctcgcggggttaaatctggtagcagtaagatgaaggcagacttctttaattactgcagctcaaacctccaaataattataagcagctgtcatttttacataatcctaaatgataagacccaaagaatgcaaataaaaatgttgagaccatgggctctttggcacaataatttaatccgtatcacaccactgcactgagcattgtacttcattgaggaatgtgctccaaccgtgacacacttaggtgaactttcatcatcatgtgataggcacatctatttccaaacacatctcccaggtgccatttttacattctctgtggaggttgctaggcaaagggaaacactaatacatttggaattttgaggcaaagaaggagcttggctaagccaggcaaggtttttgctgaaacttcttctcagcctcacttgtccctctctcctagagatggagtctaccccgtgcctgccccagtggccccctccctccattatgtagcatgataggattgtccctgggagcatttgtttggcctgttgctggggtttttattggcttggccacttctgtgtgccagctaaccaaggacagaaatcccaaatgacaaacggacctaccagctccaacctggtagcctctgggttcaggtcttaaattccatgcttttgatgcctgtctcttcctggaagggcaagggcctcttgaggagcaagtcaaggggacatttactgcagccatgacagtttctttcctttgaatccaatgactataataccaaagtccataagatcaaggtaggcaattcaccccaggcagagctgaagccccactctgcaagagacaaatttagaacatcatctggaaagtagatgcacacacacacacacacacacacacacacacacacacacacaaacacacatattccaaattagatcggcagcccaaggatccctctgctaaggaatgctcaagctggatttaaattgggactgagacctggcttggcagaaatgtggccaagcagaaaggttggcccagtgagctaagctggattccttgggaatgggaaatagaaacagatgaaagaggagagaagtcagaccaagggtttatctggaatatttagaagctgacagacatcacagagtatttttacctctccacagtgaagaggtgtagagattttagaaatgtatcctgaatattagaaccagttaaaatattctgattcttccaaatgcctgcttctcccaaagggcctctcctggagtttctaagtctctagctgcaccccaggaagaggatctagtagtaactgggaggggctgggacttttatctgactcccaggattgctgcaggtttttcatgaatatggggttggactcccaagttaatgaagcccatgtttatccaggctgaaatacaaatataaatgttatgttcgtatatatttaaagggaagattcatttgagcgttaatgatttgaaactcagctctgctcagtatggaattctagggacctggttaatggtgactgtaggtcaccttgctgtcatccccttcctgcgtcctcaggatacatctcaagtaggcactgggcagtgatttcagctccagactgggaggctcactagtgcctgtttctctatggagcagagcagtctctgaggtcagattctggggctgaaattcatccaagctacttaaccttcctgacctcagtttcctccgctgaaaaatgagaacaaaaaaatagtgcctactacatgagactgtgatgagggttaaatgagttaatgttcctaaaacatctagaaaaggccaaaaacataggtcattgttatgcatgtgtttattaaatgactacatagactaatttgttcattccctcggtccactcattcgtcacatattcatgggaacctgttctttgccaggcactgtcctaggcatgtggtccggtggtgaacctgaaatagtctttttaccaaagatgcttaggacctagtaggggaaacaggcaagtaagctaataatttgcagtacaatgtgatggctggggagatagggccatgggaggctgaggagagtatgggaaggacttgacctgacctagcctggccaggtcaggacagacctccaagaggagttgaaatcctgaggggttagcagaaattgaccacgaccctaagttggagtaaagagaattcagagcacatggggtggcatgtgcagaggcctgaaggcaagaacgatgatgacattttcagcagccagctcagtctagctggggagtacagtgagaggcagggagtggcgagaaagaggccagaacagcaagcagaggccaagtcacagggacttgtggaattctggactgttgggtgccatcacctaggacatgaggagctatgaggattccagcctaagcagtgatatgatctgatttgggttgtgaaagaatctctctggctggaccctggagaatggattggaagggttagagtacaggcagggagaccgcttaggggatgcctgcttgttatcaagggcagagctatcacagtggctgacactaagctgacggcaagattgatatgatccaattccaagaggcatttagaagatagaagcaatggacatggtaggttgatgggtgctgcttgctttgcctggctcacgccactttctctgattatactcacccattccagctcctgcctgtgtttccatggtcacaggcaaatataagacccagagaactcagtcttacaagggacatttggctttcctctgagttatgaatcacatcagagctctcttgggtttattcagaccagcatgcatccagaaacatttttaaaaagacatatcactgtaattgagaatcacacacacacaaaatcaaaactgagtattttgctggatcacctatccggtcgagaagacggaccaatgatggacaagaaccagctcagtttggtagtcggaacatggctggggcttagagcatatgtgtacaaagtggtcacatacatatttatactgtaaagcacagtatcctcagagggttgcagaagaagggccaccccatttgagaaaggagagagactcagctggaaggatctgggaaatttctttcatggaaaaggtggccacaaagatggagcccttcatgtcttttcttccttcataagtatcttcaacaatttttagcaggaaaagcaaaacaaaataaagctattaaaccaagcatctccctaaataaaattacacacacacacacacacacacacacgcacacacacgcacacgtgatgaaggctcagcattctgacgttggttgttggttgatgctattacaggcataaatcaggtaatggcagttggcttggaagaaagaatttctttccctcttgcctgcatccctttattaacttcacttgcaaattcattgccagcttcctgccctgcttgtcgtttagcataaaaacctgaagttgaaggctctctctgttcctcagccatctcagagatggtgagactagagtccactgcccagggactaagttaaggagaggcattggaaatggggtgacaggatatgagtcaatgggcccgaactacttaccacaggaggaaaaccaacaagagagaactccctcttccgtggtggttagccgtggcatctttcgaaagttaacattttgtagtgttgatggatactactttgagattttacttgagtgaataaaggaagtcaatgtttttgcagtttcaaaactagaatcaattagttgtccctaattgtacctcatattcaaaacggtctgacggctccacatacccaaaagtcttttgatatggtcaactgctcaaaggaataatgtcaaagaaagttctgtaaattttttaaaaagttacctgccaaatgtcacagacatactttcaaattatagaggtcctcttttttaccctggatgttctaatgacacagcagtttctgaaaacttttatgaacttggctttggagaaggcatatatccacgttcgagaactcagtgcagccctgtctgaaatttatttcgaggctgtcttgcatctaacttttgtcgaggagactttagagacggttttgtttgcctctaagtgctccaactcatcagagcagatgcccctgggtgcccacatggatctttattttgcatgcccatctgtgtgtgttccttcctctttgccgaggagcattcttttctcagcgttactcctttgcctacagcagaggtatggagttgccactctccctccctgctttcagagtgtcctgttctctgtcccattgccggcacgaaaggttcctcccagctcaactactcagcactattttgatttttatgtctagcttgctgttacaagaccaactggctttttgagaatgggagcttaaatccagcctcggtgtggtaagcgtgtttgacctacaaaaacggtggtgggctaagccgcctcctccccacacacagtgctgtgtgtgactcatggctacccagaggacactgattaagataaaggtcattcaggttttcaaagcagcctgttaattgttgtttttttttaaaaaaaaaataccaaagctgttttagttttacagcgatcaaaaggattttgtaatcatactaagagagcacatacaacttttcatctttgagatgcttaaaaacattaattaataagagcacagtaccttttagaaaaaggaaagggcttgttgtcttgacatgccccgttgcctccttcccaccttcctgctggtttttgacacaccctcatgaccctttttctctgcagtatatctgggcttctcatctttccgtgacatgtaagattacatctccgaatagaggctcattggcatttttctcttggcataatgtctatgtcgtcccattgggcatcttgtctagagaaatctgggctgtcagggagtcacacatccaaggagacagcaccatttcagtggaaatccaagctgaaatgatatcctcccataccacaagggttccctgaggccctgagatggatattggtgaaattgagtaagatattgtaagttgggcatcagcatattgctgcttaactcactgcagccactcagtttattgtaggtgttcttttttttttttttccaagacagtctctctctgtcgcccaggctggagtgcggtggcacaatctcagcccactgcaacctccgcctcccagtttcaagcaatttttgtgcctcaacctccagagtagctaggactacggcacacaccactgcgctcagctaatttttgtgttttttggtagagatgggtttttgccatgttggccaggctggtctcaaactccagacctgcctcagcctccgaaagtgctgggattacaggcgcgagccactgtgcctggctttggcctaggtgttcttaatctgacactgcttctcctctccctggccaccaagctcagtttcagggcaggccaaatgagtcagctggtaacagagacaagaccggctagtgggatttgactgccaatgtgattctgtgactgttaatgggtcttctgggtccagtcccatcagcagttgccacctgaaccaaggacctgcattagccaggagaagagcacctcaggtgaggcagtgccgagggccggtgaccaccagaccacaggctcagaaacgaggttgggctggctgcaccacgatgctgctgcctgtcagccatgtcaccacgtgacctgcctttcctgggtgctgcgttttcccatctctgaagcagttatccctcacctggagttgtgaaaatgaaacgagacacgtaccgctgttagcacaaagcctggcaccagaaacattcaccttcatgacgaatgatgggaagtgcagggggaaactgcccagtgggggaataatcgcttttttattcttttctaaaggcactcacttggaaagcagaacaagattagttactacattttataaattcctttttaggaaaacaatgaaccttgaaaagtgaaaacagtaactgattcaaagtacttttaccctttgggaaagagagcagaatggcaggtgccgacgccggtgtggtgttagtaagggcaatatacttttcactttgtatacttttcattattttccaaattttcaacaatgagccgttattacatggataagagggggaaagtaaggaaacaccaaatgcccaaagtacttagattgtgactctctcaaagtacttagattgtgacttcatgccccccaccttcccgctactgatccccaagggagtaggggctgacagaggccactggggctgcctttccccggggccacctcctctgagtctgttgcaaccagaggccttgatgtgcagctggcaacatggaatcaaaggggaggaggccctcactctgccacaggcccctctggccttcgccttgaccttgagacaaatgagcaccaagtcaggtcgaacaatctccttaaaggaatagggctatttataaacaagatactgttatgaactccctttgcctgtgaaggaacttcctccctaggggtgagctgcatgggggcaggggctgctgcatctcatcaatcagtatcagccattggtactggccaaatgggcgtgttttcaggccatatttattaagacacaggatgtgctgggctccttgctaaaccatgtttatacccatttgcttcttagtgcagcactgtaagctgagtgcccgtacctccatcttacggataaggaaaatgaggaaaatgaggcacagagacgtgcacacctagccccagaccacacagcatgtagaactgattagaatcagagtctgactccaggaccctggctttaagcacccttctcaatgggttcccttgatgaagcctgattcactggtagtgaattgggatcaagaacatgagggtgggagctcattctccctgggtgcttttccatgccctccaaggcttgcccaggcctggcacagagcctgagaaatattaggtgtccaacagtattttggattgtgtaggtgaacaaatgagtgaatgagggaaagaatggatgagtgagtgaaggaatgaagtgccctgtggccattggtccttatctcttgcatatggaggagtaaggcgtacctacatcccttctcctgaaatggtcccttgagccttggggaggagagaagacacagggcttcagaggaagtggtaaaggtcttcaccagctgaggactgcggctgcctgggagagaaacatctgccccagataatcgctggctgtcagccctcggtcacaccccatgtccagatggcattagctttgggcaaagtttcttcctctcccaccccatccccttccttcctgttggcagcatggagtggcacatatagattatcaattattagcacacacaatatttgttccacagaggctgcatggatgtgtacagctgatttcctctggcctttcccagaacacagaaagagcaaagggtttttgttttatttaaatcaacatggtcatcatcttggcccagcccactgtgcttccaaagtcagtctctaggtaacgcaaaggggtgctggtatccagaccattaaatatggccaggaaggctctgtgctgcaggcaagtcctggttccagcttgctcctcggatgagtgccctctcgtcccatcctgctaggccaagggcttgtttgtgtgttccccacatctggcctttatttgaaactccacctcgaagtatttcatagcacagaatatctttccttattaaactctcccccacagatttttttcgtaaaacaggcaccaaaaactacaaacctacctgtggctctcaaagtatctgtttataaacctttggaaaccgtttgcaattagttaatcacattttcaaaggaagttacagattatagatacactaacaaatgccatacacgatgcttaggccccggtaaccaactcctcacgcagaagaagaagaagtggtggagccgagggacctgggatttgtccccttttaaaactgcatgggagaagggagattgggcatgggagttggacatatgagaatttagttctttttctgtcactcatgggggtgaggggcgagggggagtaggcaaggagaaatcaactgtgcccagacgcaatcgtgtatcttggaaaacagtgaggcattttataaatcacatgttcctcaataatcatggaagcaccagtgtttgtgaatacttcacataacatgtactttaaaagccattcatttgaaaagaaaaaaataaaggaactaaatatatacaagttggaattctgttgactactcaatgcttaagatctaagccagctttaaaaaaaaaaaaaaggcctttaaaagggaagggggataatatggagataaagtattgatacatgaaacatccaaggatttcaggtacagcctgatccaggtgcacacaccaccttttcaggactctcttcatatcttttctctgctttccctgcactggcttcatgcccaggaagactctctccaagtagtggcagagatggccatgagctattccaagctcccatcctggcaccttagcaactcctcttttcctggataaatccaggaatgcatcccaaattgaatctcttgaatctcatttgaatttgcgtgggttatgtacccacctctgaaccagtgacatcctggagcgatgtgggcctcccccactgatcaggccacatgaaggatggttgtaccttcactagaattatgcttaatgggagtggtgcccaaggagttccctacaggaaaaccgaggtgattaacctggaaaacatggggaatgggtggtggcaggccaaagcatgggaaccttcctaatggagtgccactctctggccttttaatgtagtttcttagtaggggaaaagaggtaggtggatttaggcttagtacattagagttgtctcatagctcttggcctgttatatctatgcaacagcccactgacttttccttttctcactcaaattaatcactctgctgcatgactgtttatattctaaaggagcttattctctaaaaaagacccaaatgaaaagtgtttcatacccattttacgtacctggctaagcagacattgtagaagggcattcttaaacagtgttccagaggaagtatccctacccccgatctgtatcttgccatgaaattagactatagagacttgctggaatatggtggctcatgggctagtatgatgggaaatcttttattccatcactctctaatcattccaagtatcttgaatacctttttggtgaaatatactgtatttattgagagattataaaaaacgaataaagacatttggggaggatcagaagtcaagaattctctgctgattccacctttgccaaataccatctaaaatgacttgggttctttagcgcaggtatgaattttcggccaggagagtcttcagttcaaacttgtaagctccacaccaagcagagacatatgaatgtgattgtctgacaccatcatagtcaacaaacagcttctgtctgcctatggtttgcagaatggtgaccagtaaaattattgaatggtcttcttcatttcaggaaaatgagatattagccaattttattcaatgagcctgtgtcattccacaaaatgcatgactctcaggaatcttgctagctgaatattaaaatattttactgtgcctgggaatgtgtttgccattttacatacaatatttcatttaatactctcaacctttctttgccatggaggtgctattgtttttacccattttgtaactgacgaaggaagcttggagtagctggatacctggctcaggatcacacacccaatgtgatgtgagtggtgtgacacggcagagccactgtgaccttctcctctgaaaaagacacgtggacactttttttgaggacgaaggaacatttgttgctctggagcttgtagtcttttttcaaagctctttaacagtggttgaaataacatgaggcttagacatgaaaatttgacagaggctggtgttgggtggggtgtcctctaccatacaagctatgcgatcttatttaacttgtgatttaatttatttaacttgtgagaacctgttttcccaaatgcattatgggcaataaattgaccttaaagaagcagaattaagaaggataaaccacaagtaagtccttgggaaagagtgaagcactgtttaattgactttgtatctttagtgccttgcacttagtagtaggtatacaataaatgtgcattgaataaatgaataaagaagcactttgaagtgaccaaagaaagaacttcctcaaaatagacagtttagatccagtatcaggctacccaagaaattacgaaagttctgcatgtgaagttcaggatctgggctgtgtgagtttctggggtacctaatagttctcagtaatggttcttaggtaacagaggtccagaacgactgtctgactctaagtcctcagggggacactactatccctgccccgcactcctccacactgaggggcaaggcaccgctgctgacaactccggttgacctcgttgctgttcttttctgttcagcccaagactgcatctcacaaggaccagggcttccatgcacacaggaactttccttaacaagatccaactgctaatctgctattgtttacagtggcttctgagggaaccactttccttccccttcatctggagtggatctgatgtcataaaactgaccgtgaatgtctgttaattgaaaacctaagagtagtggggtgggctcaccgttgatcagggtggtaagagcccactggccataggaggctaggcaccatcctaggtagtggtgaggagggggagtctccagagaggtcgcagagttcctgaaatgcagttgacaggtaagaaaagagtgcatgcgtggacacttggccctgtttggcaccacagtggtgcaagatcgaccccttctggccctcccctcatcccactgggggtcagtttacacttgtctggttcaacatatgggtggcagttttctccttcatgcccagtatggcctcagcacctgtctccatagtagctgatcagtgtcaaaaatggcaacctatggttttggggtcttaaaacacttagactgaccctgcatctcacttagaaccttccagttaaatcaaaagatgaccaagctggagagaaaagtgaaaaagaaagcagtatacatgcatatatatttttccaatgtgccattaaccgtaactgatgaacgtgtaaaggggttgctaatccttagcctgcagcagagggcagactttcctacattataaacaccccacaaccagcatgaaaggcctcaagacacaagaatgtccagacacaagaacgtccggtcgataaaatggtaggcttgcagggtgactaacaccagtgatttaggggagaaaactaaaaccacttccccagttattcatgcactcatcagcttttccggagaaatgccctaacagccattacatctggctatgattcccaataccctcatctactccaggtaaaggagccatgcttagttcagtactgctgtggccagtgtgacagcgaatagatggttctgtgtgtctgcaaaatgccaccagtatgctgagcccagccccagctctggagatcagtgcttttgcttcctagctaaggagtacgggtaggtttgagacaaaaggtagaggagagagaattataaagtatagggggatatgactagattctttggtaaatgtaagtaagaagccctttctcgtatcacggactgagttttagcagctttgggatacacacacacacacacacacacacacacacacacacacacacacacacaccattcaatgggaagacaaatccaactgctaactagtctgctatgatttacagaatttacattgtttacatgtataccatataggtggagacacacacacacacacacacacacacacacacacacacacaccccccattcaaggaggggacagattttcctttgcatctggtgttttggaaaccaagaagtctacaaggtaaattcatatcaagcaaagagttaacttttctactcccaacttggagccaatgtttagaggcatctgaccttggctttcctgtcattaaaagtccctaggactgtcaccctgctgggcttctcaccctcatcggtccactcccaagccctgtccatgaaacaggacttgggaaggtaaagattgccctggctgatgacttcacggacttttgtttttcttttctttttcttcttccccttgctagtacgaagaaggaaaaaagcgaaggaaacctaactatagtagcgttgacctctctgaggtggagtgggaagaccgagatgacgtggtaagtgatttgttttcaggcctcgtggagaaggacctgcattgtacccacttctgtacctgggggcgatcccaggagttggccaagaggcccactgaagggacacctggctaccagagggacgtggagacaaggggcctttgtaccatgtgtggagttttataactcttcagccggtcagtcggaccagttgcagacaggccagccaccccagctgcttgtgcagtctactaaaaccatccccctgcggacgctggtcccctctgcagctgatgactccagccttcttcccagtacagtggatggcccctgacatcttcagtggaacctggctgggcaacagcaggctctgcctggtgcaaagtcagggtgcctgcaggccaagcaggcaggttcctgggcagcaagaattcacctgtcaggacctcattggcacagcccttgttttcagagtacagcccagggctctgcaggctcacttttctcctgcttggtcggctgcccatttcctgtaccttcccagcctttcattctgctctggccttgctgcaattgcaccccatgctttttccccacgtagattcagcctatggtgctctatcaaaagctctccttatacccatgacttaaccctgtcaggtcttcttggtacttcctcaataaatcagatttcttagacacggctgcctttgtgtgaatccaggtggactctccttaattaaatcataacttcccaggtgtttccatctgggtccctactcttccctttttctaagagtgtgtctgtgctgaggccacgtttctctgccctaccctcccagattcgtctagggtcctttcttaagttccactgttgagttggcgttgtttccatctctcactgcatcctgctctccaaagggatgttgaggagaaccatttgaaagcccagcctgggttctcatgccttccagaacagggggccagcatcacagtgcttccgctgcagctttccttctttccacacgctctgcactttgtcaccagctcaactagcataaatctctcattttcatccttgctggtaaaatgtgagagccatacctgttttagaaacttagcctcttttcttcttcatctgctctaagtctacttaaacccaagtttagacaaaataactttgccatttgataaaagctccttcctcctccatacccttttccccgcaagccaatgagctgacatagtgtcagctcaatagcatggtcgagttttctatcttcttattccttaaacactgtcacaaggatccggtcagttcttaggactgtcctgcacctaatgtgcccaccctggcttagcgcaattgtgaggagtgccactcaggttttagactcctgccaggttcaaatcccgccttctctgcttgccggatgtttgtcttgggtgagtgattatgcctctctagacttcagttttattttgtgttctttgttttatttttccccaagaaaatgagtgtgatggcagttgtccccacctcatagagctgttctgaggattaaatggattaatagattgaaaaacagagaagtacttgcactgttctggggagtaagtaagcattctacaagtggtagccattgttagtattattctgacctcctcagtcctcaggggaccctgtcatgaatgaatgtcctgtggatttacagttgctaggaatctttggaggggactttccattgttgcccttcctcttccttcttcactttatctgttgatttattttttttgttgtttgcttgtttgtgacctcactgaatcgtctccctttttgcatgctacttgaagagatgtatgactcagctcactccagtcatcacctgtgccccagctaattttcagtgagcgaatgtctcctttagtaatcacagtttgggaacactttgtatctcctcatcctactttgctttctcgttggagctgcaggcattggattcgcagcctcacgtgtgtgttcttcacctccacatgacacccaggactgcgttctgtctgtccaacttcagagttggacatctcaagcaagtccagtgcttttgttctgcacaaattgttctctggttacgtctttggtttgagtctcttaacttgtcgccttggaatatggtgcatttggaatgtgaattccttctctatcaacatatttgacttgggaaaacccaaaccaccatttctctcctggggatttgcatgtcactaattggagaattctggaatctacagaaagcatcattgtgaagtctgcacaaaatcttacatatccatgtgctgggccttgggatttgcacctgagtagcagaggacagggtttaggttgaaatctaggaaagaacatgtaagcacagcccactgaggaagaagcagtagagtctgcccagatgcagagaatttcttggaaggtgagttctacttctctaggaagtaggctcctgaatttagtaaccacagttataacctgcatacttccaaaaatgaagtaagttcatatatactgttacaatgtatataaaatagactggctaaaattaaaagaaaaaaagacaacaatttaaaactatttatagcagtatgagcaggacttctgtcccactctgcaggatgagttaggcatcagggcaggaatacaataagtagggcagatctttggcggacccgtgtgccagcaggggattttgagacatgcatagcccagtctgaattgccagtgtagatcccctctgggaagggaaaattatcttaaaaatagcgtttatcctttggttataaattctcagagatggcacaaggaattgagggtgatttttttgttttgttcctattaacttccagtcattcccaagctttccacattgaatgtgattattaatagaaaaaaactcataaaaataataactgccatatattagctcttcctgtacaccagtaccattctaagttcatgagtgaacttatttatttatcacagtgaacctatgaaatgggtgttttatctccattgtacaggtgaggaaactgaggcagagaatggatgtaatggcctaaggacatagagtgtggattccaactcaggcagcctggcccacagagccgtggtcttgacacttggatattccatggagagagcccttaagtccttgagtccaggagtccttgaagactctatttcagtgacgcatagtatatgggttatcctcctcggggggtgcagaaaagatagggagtgccttgcacatagtagctgctaaacagatgtttgtctgcatggtattgttgtgagtactgccccatagatgctgctttgaatctaactacaatcccttctgttgtggtaaaagccttttttcccctactaccctctaggcaactacattgcttcatacccatgatgactctgatggaaaatttctccggagtcttttttgcccgaagccctataaggcaaaaaagcctttttcatgggacatatttctgagaccttagtccatttatttgattcttttttatacccttcccagagtgtctctccagctcatgcttgagctctggacacccaaactaagcacagcactcccccaccccctccaaacccaaactgacacataggggaggaggaagagagagagaatgttttgcaggttctccatgctcaagtctgttttcctacgctggttgaatgcttgcttgggaatgacagacctgtttatccactgtgtctcccttcctctttaaactgccagcttgtctgtggttgcatgtcattaggggcttagaaatgcaggctgcctgtgcaccagaaaaggtgaggctcacgttctaatgtggacaatgagccaccattaggagcacgagctatcattccataatcatacacacaacttaaggtggccagtgaatctctggggaaagcttccttaatgaactgtaacatggctggtcagagtagcagactaacaatgaaacaggaaacgtggcttccacctgtaacgaggttggcaggaaagtgggtgctttgagtggttatccaaggagcttctgcttcagcactgcagaagagagacacattcaccaggggctctggagaagcacatctgaactggacaatgcagggcccaggggaaagggtggttcccagagagcggagaggctgatcactgtcgccagatgagtattttcagcttgaggagattttaccttttattttattgagtacactgtggtacaagctgctttaatgtccattgcattaccacacttgcgaatgcttgatatctgatatggaaaaatcaaggtatgccactgatgttttaatttgcctttctctgactatgtgttaagttgaacagctgcacatgggttttttaatgactacataatatgctaacatatgggcacatcaaaacttgtttggaaattttcctccgccaggccatttgcatttttccagttgttcactgttgtaaatccaagcagtggcaagttcaaagcagtgaacatcttgccctccccgccttaggtggggactgattgcattgctcttccccatcactttggcctgtgcttaggactcctctgccgtcttacaacctaggggtgccactcactgtgattctgggcaagttgctcctcttctcaagccgcagcttcctaagataaaaaagtgacatttctagaatgttccagcctcacagtgctgtattctcacagggcagtctattaagtcatcaaactccctttcctcctctggcaaggaggacagaaagccaccttcctgtcaaccctagatcatagtacttagagctcgtagaagagtctgccaggaagttaggacctcagactatgacgtggtcaattgttaaaacattttatttgatttttaaaaactcagaaataatatatgatttttatattaatgctataaagtatttaatgttgtccaagtgctttctcttctgatttgggaagcagaggttaagagcatgggctcaagaggcagaggcctcgttaccctgggcaaacttcttatctgtgcctatttctccacctgtaaaatggagataataacagcacctcagaagataagtttgaggggtttaaaatctgtgcctgacacacagtaagagctcagtaagaactcagtaaacagtatctctcagtagtatccgaatttcataggaatctgatgacctccctttttatagcccctgacaggatccctgggatctgggagtcctcactcatgaacactttagacagaatgaatgaaacaggaagaaagtgagccacagagaggtcacgggacagctggcttgtgtcagtggcaaaacttgaacatcgatatcgtggtttacctctttacctggggctgtctccttttcggtctatgtaaacctacaggcagttaagagcagcagttttcaatgtggggagttggaggagaggtcacaaaatccatttagtggttcatgagcaacatagcaacgaaatctactaaaataggagatagagaggggctcatcagagtaagatgtatttcttacatggctcaaagtcaaaacagtttggaaaacattgagcttgggcatctgcctcaagcaaacgcaagtccgaatcctgatgctttaagctactgaaaggtgtctgacactaagtgaaaatgagcaagatggtaatgaggatgacgatgatacagatactgttgactgtggtgttgatgatgatggaggatagctagcatgtattgagtgcttgggaggcaccagacactcttctaaatattgactcgtcagtcttcactacaacttaatgggatgggtgctggcattagttccatttttcagaagaggaagctgagtcacagagatggtaagtgatcgagatacccaagatcataaagctctggctccagagtccattccttaactacagtgccatcctgcttcactagtaggttcaataagtataacctgtttttgttatgatttaagacaagggcaagactaaaggaggcatcagtgaccctggccttggacactcccagacccccatgttgattgttctgtgctactgggagttgggggtggggtggcatggagacacagcgaggcttacctaatctctagtttgcctggggaatgtgagaggagaaggtcccaaatggctttaggcaggcaccagaaagaggaaaaatgaaaaccatgttaaagataaatcgagccgttcttaaaagttagaaagtagacttaattaggaccagctctccctgtccaaaaccacaaaagttaaaatgggaaaatatttccagaaatgcctattatgtgttgttaaaaaaatatctagagtaaaatatatgttttattttatacatgcctccagctaaaaattatgcctttactcactcacacagaagatgagaatgcaaacccaaatctagacagcctcgaatcaaatttaggttgcttgctagtgttgcagttttctatcggccagatcttactcaagctcctcaaaggagaaaagaggggaaaagatgaaaaagacaagagaggggtggggagagagcctttcctgacaggctgtggcatgtcagcgtttgctcctattccattaactggccttctctgtcgtcttgccttggtgcccatgacggcacatctttcatcactgcgtctgctgtcctcctctgaactcatggaagggccacatgtaattagatgaggtcagctgggggtgggggaggagagccaggctcgctgctcctaaacaggacctccaaaaaatcagatacagggtcgctcctgttcactgcctcatcagcaaggtcattaattggcccagatttctcagagagcatttaaagatgattcatcttaggaaaggctaacccctgtcttccaaatgcttggcctttttttttttttttcttcttctttttaactactgtgtaggaaaacgtctttaacttgattacgttttgaaaagtgatttctccatgacaaatcagtaccctttttgaaaacgtaccttgtccccagagacgttcttgctcggcatttcagcgggtctccaggagttcacgctctgacccccgggattcatcagtatcgccaaggctcttttgttattgtcctgaagtttacacgagctccccaaattaaagatgaaggtcatttatttattgttgttagcctgtctcccattgtacatgagcagttgggtgttttattcttcagaagctctgttttcgaggtgtaagttcaatatggaggctccactgcacgctgaggatgcaagatgtccagattacatgataacccagggaagaactaacacacttttcttttatcattttagttgagaaatgctatggtgaatcgaaagacggggaagttttccatggaggtgaagaagacagtggacaaaggggtacatttttctcaaacatttttgctgcttaatttaaaacaaaccactgtgaaaaattagctttgaaagctatatctggaataaatatctttcgctgagatcatttttctcttgtctttacttatctcaaacaagattcatgtagtactgttaacctgatcatagtgtgtccatttatttttatttatttctgaagacgtcacttagcagactaaccatgttttcttttctctacgacttttttttttttttcaatctagaaacgggttttggtgatgacaaatgactactattatacagacatcaagggtactcctttcaggtagagctgaccataatacatggacattccatcagacccatcagttgtgtttgtacaaaacctgctgacactctcagagctcatcatctgaagataaccaaacaccctgccaaaaggctggaaagagtgaggaaggggcttttcccaggctgcttttgttttccagaagggggggagatggttcaggctcacctaggagaactcactcaatctgccatggctttgcatctcattgtcaagcaaatatgctttgggggttcccgctaagggtgaagacaagtgcagagggttaccagggtccttaactattgaacttgctgctttgtgagttccatttcaccttttatttccatgaccaaaaaaacaatccttcaaacctggaggtggcatatccattcctacatgttgtgcctctgtttccatttctctgaactgtccttgtgtgcttgtctacttttgaatcctgttgtttctctttgtaacagtcctgaaaaatggctttgcctcattggctgctttcagatgtgtatgtagcattctaaagtttcccactactattaacttagtgttgtaattcattttgtaaaaaattatttcagtaagcctgcttcatattcctgaactggcgtctcagagctaaggagagaaggagtttactgactgtagaataatctgaaaaataaattctagcattgttgtcctaaactgccaaggatcatgggtggattccatgtggaaccaggagcaaataaggaccacatgagctgctaagtgggtttgccaaatagtctctctaacgtaagggactatgttttaaaaacatagtctcttgcttttgataaaaacggaatggatcttaaatcaagccagtgagtgtgaaaaacctattagactagggagaggattgggcaaagaagcctgcaacacagtaatgtggttacactcatgtagtagtggaagtttttgtttttgcccttgagcaggggtcaatttcccgagtcccaaagtctaggggctggagagacccatctctggctgaatgcaggacaagggtgtataaagagcagggctcatggtccttgggagggcatctgagagaagggcttgctggaagggcgagcagtttgccacaactctgaaaacacaaagagtagccaattgctgctggcatttctgatcagaagttactttgaagcagctgattgaacctaagaaaaaccaacaccagtgataatcagtggggttttgaaagtaaacagttggaaaaattgttgacagatcataaaatggaaatgtgaaaaatggaaaattaaaaaatgttagcccacaagtctattcgagtcgatgccagggatttcaagatttgctttgtctctctgcacagtttaggtgtggcgctttccagaggtcatgggaaatatttcttccgagggaatgtaaccatcgaagaaggtaagatactgcctggctcgtcttatcctttggtgtgggaggaaagctcgggagctagctactgagttagctgaagaacttgttcatctgtccgcacctgtgaccagtcccttggacattccactcaaacgaatgcctacttgataattcttaatacctttcttcttccctggtgtgcctagatttcagaatgacaggagttccgattcatggttgtgatttaatttacttatattctactttcatccacaaagctgttgactatgagtaactcacagtcaacagcattatggatgaaagcagagtatcagtaaataggaatcatccctcaagtatattcttctcatacataaaaatcagtacttgggagaaatacaaatttatgaaataactcatgcccaggggaaaccatgaaaacagagatatgagagccttagtctctcctacacagttgagccacgtatttcacttgtgtttcatggcagccctggcccaaagggaaatgtgaccatttaaatgatttacataggtcagagggagtaagtagcaccttgaagttcccagaccctcttatcttcataaagcacagaggcacagtaaactctcagtaaacaggagcagttgttatagctctttaaattttaaaattgctgtcacatgtgctatccttttcatctgccagctccctagtagttcagagaggttacctgtcccagcattaggagctcacaggggtggtggacattgtttctgaagggcaccactccctgagtggccttgagtgactcacttgcaggtcattaggttttgcatgtccacagaggaggagtgggcccagaacagtagtctttctggatgtctttagggaggacagccaggaatgggaaggtcaattataagcaaagttttaattggtcggaactgattacacatgtatgtggtgagtttccagaagctgggccatccatggcgccctcagatgatgccacagggcgtgaggaaggagatggatgttccctgagacgccaaacccctagatagcctctgatttactgccagtggtccctgcccgtgttgtttcagggatgttggtttgtgcttcccaagtgcttgtgagatcgtataggggcagaaaggagagtagagaggctcactgtgagctgggcacaacccagagtgtgcccaccaaagagctaaccatgtggtctctcttcccagagacatgccagagaacacaggcaactctgtgacttgagcaagacactctgcaggatgtgttttcaggatcatgttttcacttctagaattttctgcctctgtgggccatgttggctctgtggacatcactgcccatgaagccagaaaattcatgtctaagccatgtgaggtcacgctgaagaaacaactcatggtcagaacaataggagaggttattaagagatattaactgcctctcatgcgtctgctcccttggtcaatcctcaatacatgggcctgtccctcccttcctctctctctctctctcacacacacatacatacatacatgcatggagacacagatacacacagttgttttgcattgtcttttggattctttttcagtcactatcttcctgtatgttccacagctgtgaggctaagcagtcacagagaatttcagagctaactgtaaccactgtgcaaaaaattagctcaaatcctcagcaagggggagagtggctgcttatccacccaaatgaggtcatatcttcctctctctgttggtcctctgtaaataaaaagactgacaatcctgccagctttgctgagtaatagaacttaagaaagctgcttccccttgggccaaatagtagaggatcttgtcatctctctaggagccgtggtgtattattgttctcttctgttcttggagagggaaggagttccttggggttggcaaccatacttctataggatcttcaataaggaataactgcctacagaatgtgggaattttccacatgctttgccagtgccagagattacaaaggcggcaaataggtagcttttgctaaaaaatataaaaagtcattaccaagattgaaggtgtgggctataattctacctgctgaaattgtttctcttatgaatcttttaatctttttcaacactttgtatctttttgtgtgtgtgtgtgatggagtcttgctctgttgctgaggctggagtgcaatggtgtgatctcagctcactgcagcctccaccatctcctgggttcaggtgattctcctgcctcagcctcctgagtagctgggattacaggagcatgccaccacgcccagctaatttttgtatttttagtagagacagggtttcaccatgttggttagactggtctcgaactcctgacctcgttatctgccttcctcggcctccgaaagtgctggggttacaggtgtgagccaccgcgcctggccactttgtatcttttatatgtattgcacatgataattgttcaacaaattagagcttatgtcattattgtcaacagttccagtcatcagtggatatgatttttatcagaaggaccaatgtcagaggtgagagaattagaaagcaattaaatttccttggtgccctaggaacccagagaagaagcagtcaaaaagatcttcccgatagatctcatcttttctgagtgtcatttataggtcctgtgaaatagagccagagatgattttgtaaatgaggttgggaggatgggaactgcaactagaaaaagacttgacactctaaacccagttttctgggaaggtacagtcccttctcagggcctttgcacttgttattccttctgccatgagcacccttcctgccacctacatgactcttcctttcctcattcaggtcactttctcagtgaagcctttcctgacctccatagttacaatggaatctctctctctctctctctctctcctctctctcccttcaaccctccttatctcttggtcctccctgttcttgttccatgttctcttttcctttttagcccttgctaccatctgatattctctaaagttaaattttaatataatttactatctcttttctgccactagaaattaaatacaatgaaggcagtaattttcgttttgttttttcactgctatattctcagggcctagaatcatacctggcatatagcagatgctcagtaaaagtatggaagaaaggaaggaatgggaggagggcaaaaggaaggaaggaaagttgtttggttgggaagaaggaaaggaaaaaaagaagaaaggctgcacagatagatggattgtactagggactaatccctgtcccatttaactgttttctggcacttgtgagctatgcagtattacttgtatctcatggtagatataactcaaagagctgacatgacatccccaaggtcattcagcctgtaggtgttggagcgtgggtatgcccacttggatcatatgcaatgatgttcattctaatgtattctctactttctgtaaaatcaagcagaattgtgtgataggtctagtattttgctacttcttttatagatttgtgtttgagatggaaactggagtcctgagtgcagtaagatactatcagtcatttaagaaactaacttcccaaaacaggctataagcatcatgggagttcccgaggtcatcattcagaagtgtatgtctgctgataacccattaagatcaagccatgtgaaagtgcaatgaaacagttatccttgcagagttaggatggtctggaaccttctattaaaactcccagattccatgcaagccccagctcccctagtttccttcccaggcggatgaccgttttcacttaggatcctgtaacaactagcaatctttgctgctcaaaaacagttgagtattgacgacttcatattgttcaacctatgatttcaccctcacaaccacacatcaattagggactactattcctgcttttcacatgaagaaactgacgtttagagaagtaaaataacctgttgacatcacacaggaggtcagtggcctagcccggttcccaacttagactaaatggagcaccagagagagtgtttctaaagtcctgttaagcttctccctccggactcatttgtgtatcctctatcttcaaggggttaaggttttcctgggatgaacagccagggaaggtggcagtgctgggctgagtgaggtagagatggggagagagtcctgcctggaagggaactcgtttattttcctcagaaaataaacctgctgctccaaggcaggtcccttagggttgatgtctacccttaacccaccccgcagccctaccctagaatatttgaagcacacaggaggactgggggagtgatacttattcatgaaccccttctccttgacccccaggcctgcatgacttagaacatcccgatgtgtccttggcagatgaatggtaagaattaaaccatccctccttgaccatggcatccttcattgccctctttgattccacatggtttgtgctcccttgcccagttttcctgattccaaggcaaaggaagcagatgctgtaaatattgacatgctcttgttttgggccatgtcatgttcttaggtcctactgcaacactgacctacaccctgagcaccgccatctgtctcagttagaagcgattaagctctacctaaaaggcaaagaacctctgctccagtgtgagtatgctttcaaaagtgtgctgtgccttcaggggtgatggtggggaatgaactcaaaacattttttggcctcacttgttaagggaagctttgctttggcagagattatcagtcacatgaaatctaatcaaatatctgcttcctgtaggaacaggagaaagaatgtggattatggaaaattgtacagaatccccaatcctggtttagctgtttgcattgggctttgtccccttctgaaccatttagtcaagcaactgaataggatgaaaatgttacaactgggaagggactgtaaatatttgcatatctcccttattttgcaaatgagaaaccaaggctggaagtaggattgtgcctcattcaaggctatatctagatctcctggttctcccaagagtagggtcacgacggggacacgtagcctctcagtgtggtacatgctgagtgccctgcctaccaagcatccccttctaggggagttcagtgagtaggaaatctctcagctggtgcaaaagagggaagagcagtggcagccctggatgtccctcaaaagcaggaacagaccctatactctcacagtttgggcaggggagagccactaaaactgatcatgatatctgcccccacctctaacaagcatcatgtattcaatgacctgaaaagtgttttacatatctaatcctatgagaggtgtaaggagattatccagctactaaatgacatctccatagaatggatttactttttgggatatgccctggtggggaaaggatcagatggacatcctgtgagcccaatgtgtcattgtctttgactttttaaggacatatttaaaaaacaaaagtatagagacaatatgaataatacatttgtagtcaccatccagctttatgcagtcgtaatattttgccacacttactccaggtgctttttaaggaatgagacattatagataaagttgaagcccctgggtccctgctcagcctcgtttccctcccaaagagaatgaccttctgtatttgttcattattctcaataatttaatgctattcctacatatgtaggtatctataaacaatatgtagcattaattttattattttaaaatatatattaaactttatggtatattgtatgaattactatattataatacatacaatatgtgtataaagtatatatgtactacaacttgtgttttcacccattatatttttgaaatttgtgttgatcatttagctttaacgcatttatttgcattactatatagaattccactacataacttaatatattcattgtcttactgataagttatttctagctttcgcttttcagcaaagctcttttttttttttttgcccccagtcaaggtgaggactgtcctgtcccatgtgataattagttatcctcctctgcagagtgatttgaaaactctaggatgcctctcctagacttaccatgtcctctcattccttggcctcttccacagagctctaccaagagtccctttggatggcaacagacattctcctttaaaatgaaacaattcttggccgagcgtggtggctcatgcctgtaatcccagcactttgggaggctgattcaggcagatcatttgaggtcaggagtttgagactaacctggccaacatggtaaaaccccatctctactaaaaatacaaaaattagccaggtggtagtggcctgtgcctgtaatcccagctacttgggaggctgaggtaggagactggcttgagcctgagaggcagaggttgttgtgagctgagattgtactactgcactccagtctgggtgacagagtgagaccgtgtctcaaaaaaataaacaaataaataaaaataaataaaatgaaacaattcttaaaaagaaggaatcacaaaataagaatcccaggggttattaagttatggtatctctttcccatgtgacaacaggctgagaatttcagggtgctaaagaatttcagttttaggagaggacagagatggggatgatgacagccaagtgttcaaggagtactggcttctggtctccaaatctgggactcagcctgctggtccatggcaggaaccacgagatggggtgagaaagcaagaaactgaagtgtgagacacccaaggctctcagttgactaccttcttgcccaaatgctttggaggctcctgtgttgcaggcataccaggtgtcagaactgtttcatattttcaactagtgggaacttaactcataaagcaacatgccgcatgagaaagtagcctgcagatgctgcacaatgagcccatgagtgcctctcatgcccctcttccagccctgctgaagcatcctcttgtctgtccctcccaacaggtgataaagaattgatccaagaagtcctttttgacgcggtggtgagtgcccccattgaagcgtattggaccagcctggccctcaacaaatctgagtaagtggttgcacgtgtcctcgtttcatggccatttcctcaccaacactccgaaatatggttatggtttaaagaactaaactgttttaggaacctggtgttaaagttctttaattttcccccaagctccaaaccacaagagctagagcagattagcggctcgggcttggatggcaagctcctggctttgacatataatttgtttgagttttaacgttacatgaaatttggtacgctgaggtagggtgacacttccgagagagagggaggcggaagggaacttcgttgcctgcctcgccacagctctctctactttgcagtcttgggggagcttgggatctgggccaggttaggttgtgagtaggatggagaagtgagagctcagtttcatagggtgttagatataaccctgtggttttatttctgaagtggagggtggagggctgtggggaaggccgtggtagttgatatcaaagactaggatgagaactgctttagcagcttattattatttctttaccattattactttaagtagactattaaagattaaaaagaaaaggaagaaccattccttttcccttatattttcatgtgttacatgattcatttctctccacttttctgttcttccttagttcattccctcattgtatcttcccttctatcctgtttctctccatttttctattcaatagttcattccctcattgtatcttcccttccatcctgacattcattctgttctcattttcattcattcactcatcaagtcttgactgtgtgtctgttatgtgccagactctgagcgaggtgttggggaaatggagagaaaccacacagatagagcccttaacatcatggcacctgtggtatatagtgtgctgtattattaagaatcataactgctttgaaggaaaagtaaagacacataaagtgtaacagatctaaagtggaggaggaagatgggaactagttcaaggtttgggcagcattccaggaacagcatgtacaaaggccttgagatgagaaagcatttgacacattggaggaatttaaagaaggtggacacagctgacatatagaggatagcctggaagatgtcagaggatgaggctgcagaggggccgcatggctcaggaccttgggagtcaggttaaggattttggattttatactcagagcagtggaagatcactgaaggattttaagaaggggaagaaaatgatcagattttcattttacaaaaagatctctctattgctgtgtggagaacagagggtgatggggtaagaacaatagtaaaggttcgtacagttttcccagggattcatgacttggacccgggcagtgggcacagagagaagaggtccacttgtggcttgcttcagaggcaaggtctccaggacttgatgatgggtttgttgtggagggtagggaggttgagccatcaaggatcattcccaggtttatatcatgagctattgggcagacggtgctatttgctaacacgagagacactgggggaggatcaggtttagggctgggcatggccagtctctcttctagacatcgtgagctgaaaatgactgaaagtctcccaaatggagatgtcaggtaggctgtttagtatgcaaatctggagccccagagagactgccattttcattattaggggtgtctttgaactgcttgccttcatggcatggatcttatttcctgggaagctggcaacgaattgagcctttcctggggtttctttctctagtaaaccttgtagtgtttcttttcggctctcatgaaactcaaaatcttgagcaaaggttgctgattcattcctaacacatactaaagatttccaaaatggtaacttgctttgtagtccaccatctgtaactgattggacagcctggctttccaatttggtgtaggctacaagcagaaatgcattgttttggtttttattcagcccttaaatacttaaaggtagcatccaccattttgactttcatcaaagatcaagtaaccaaatgaccttactttgaagataacgtggagaatactttggatcaaattactagtagcatttaggacagagaaacaagctcaagaattggtgttctcttcatacatttattgtaggataaaattatgtgtttgtggaccaggcatggtggctcacacctgtaatcccagcactttgggaggccgaggtgggcagatcacaatggcaggagatcgagaccatcctggctaacacagtgaaacgctgtctctactaaaaatacaaaaaataagccaggcgtggtggtaggcgcctgtagtcccagctactcggggggctgaggcaggagaacggcatgaacccgggaggcggagcttgcagtgagccgagatagcgccattgcactccagcctgggtgacagagccagactccgtctcaaaaaaaaaaaaaaaaaaagaaaaagaaagaaaaaaaatattatgtgtttgtgaagaaaggccatttgctttttgcataggagaaatataccttgcaaatctcctaaagaacacgctcaagcatatagaatttgccttggaagttgaaacaaaatgatatttagtgaatttttacattagttttccttgccaaggccgttcttagagttcctatgtgtagcctcctacagagctattggaagaagccatttctttacacatctctttggggttggtggtgagaataaggcctgtggtctggtagaagtgataagctggggcccccacaactgtgtggatgtcaaaaccaattccaactacgtggaattccaggctgtgggatgctgcaaacttggttccatggctcagctgctttaatggcagattccacaaatgatctcaagaccaagaataaacttggtagctttaatgcaaaaagcgagtcctaagccctaactggctagtccttcccattcttagcctgatctctttgaacttgcacccagaaccttgaaataaagatgtgtgtatggttggaagtagatttttttcacatgctgcttttgttggcaggaagttcttcatttttcctgcaagtattactttgaaaacttttgtaagggatacaagttggcaatctgtgctcgtgtgtgtgtgtgtgtgtgtgtgtgtgtgtgtgtgtgtgtgtttctgtatcttcttttaaagtttaagtttcaaaactgctatttggtaaaaacattctgtgagtcttaaaatgcaatgtattatctgcttactgtctagaggcctccccctgacgtctgttgttctgtttcagaaattctgacaagggcgtggaggttgccttcctcggcactcgcacgggcctctccagaatcaacctgtttgtcggggctgagcagctcaccaatcagtaagtaggagggatcctctacaggggcccagggagcttctgaaatggaacattcaaagggaagcttatttcatttcttgattccactactggtagaaacataatttaggccaccccaggcctattgagatttttcctctctgttctaccatgcgggccccagcatgtgctttcacctgcctgttagcccttccaccaccctttgttcctcaggcttgttggcttctgtccactgtcctggagtcctctcccgccctgatgagtcatttcagaactctgggaggtggtgcggctgctgggggagccgccagagggaggaaacactcatctcgtaacaaatggcttcagggtgttcagctgttctgcagctatgctgaggaattcctgcctgtacaaaagtcactgttccaagtcctgtttgtttacattttactaataaacctctgcctctgtgcttagcctgaggggctgcagagctccacacccaggagtgggccctctggggatgctggggtttgacagtgtctccttggacttccaaagagacgtggatagatggtgggcagagagtttccaggtctagtacccagatgctaagcccctgcatcttcagagaaccacgggcccttaactcatcaaactggtgtttcaccagggctagtaggtagactgtgaagtcttttctgagtctgttaataagttttttctatttcttttctctgaagcaagagcgattgttaagacatggacaaatgggtcccaagattcagaaagttagagagtggtttgcaagtgtgtgtgtgtgagttcagaggttaccacagaacattatacccccaaccttcagggtacctggaggtgaataaccaagccacagagtagctgccaatttgagagggattggctcatcaggggtccaaggaggcggtgcttccttggagcttgacagtgctgtttgcctctgctaggtgaggccctgacacccaccatataaccttacaaaaccaagtctggtaaatgacagatcaatcaatgtttaggtattttaagagattggctttgaattctgttccaggactttgaccttcttgatactcacatttatcatctatgaagtttgattatagttgcaacttgatttttaacgacttttttaagcgtttttcccccagacaattgtttttccagagggcgagttcctgggaaggactagaggtgctgagatacacattgccttctcctgttaggatccagataggcaaggggagacaagggaattcattttctaatactcattgagaaagtctgctgctggcattgagactgaaacaagcaaagctgcaaaacagtaacaataaaacatgacaccttgctggtctgataactgtgttattgtgatggatttaaaagacaaaggaccacagtaaggatgctgggaggtgtacctggcttatctcacttgggtatcttcattctgtcctcctgaaaagtgagagcgatgatctcttttggttactgtgaagatcaaaaaaaattatggatgagctgggcacagtgactcatgcctgtaatcccagaactttgggaggccaaggcaggcagatcacttgaggtcaggagtttgagaccagcctggtcaacatggtgaaaccctgtctttactaaaaatacaaaaattagccgggcatggtggcacacacctgtaatcccagctactcaggaggctgaggtaggagaatcacttgaacccgggaggtgaaggctgtagtgagctgagattgtgtcactgcactccagcctgggcaacagagtgagactctgtctcaaaaaaactctttttttttttatggatggaaaatttctttgggaagctaaaaattcctacaactgtgtgttctattctttgtggcattacgtgacccacagagtgggtactcattgacaatttgaatggatgaaatctgtcttcaagaaactcctgtcattgcttcatatagaggcaccttgacatctattgtcttagggtcttacctgcctatcccctcccatcaaatggtatttgtcaagatccagctatttggatacactctctaagccaggcttagaaagtttttagcatttctgacttttggtttagtttttgcttttgactagggcatgaaaggcagagctttaagtattgggcagagaacttgataatataaagttgctaccctgcaattatctcatactatcatcagtctcctacactgagatttcatcccatacccccgccacctgcatttggaagtaggtcgattatactgaaacttggccgtcacccccaatagttataatacattctgtgccttcagtacgacttctcacatcacatgcatatagcatccagtgatgttagccttcacagcgtacagccttaagttaagaagatgaccactttacccctgccctttcaaccaccaagaacaaaagagctcttgggctttaagaatcccatatatttgttagagcctgttttcagtgtccataacactctttcacatatggtgttatgtaattctgatacaaccctggtaaagtgcagcgtttttattgttcccattttgtagatgagtaaatgggggtcggagactcaattactcactcagagtcacccagttcttcccagaatctagaccagcctgacacaccactgcaatagctcctagtatccaggaggagactttcaccttacccagaaggatctttcttcctgaagaacatttttgggattctgtaaaatcaggttgctccttcctgtttcctccagaattgctgcctagtagttggcagaggcctccagggtttcccggcaactcagtcctttcgcagtgacaccagggctaatggggatcaagtgctgcaggctcctgctggctgccctaggtgccagcactgtcccgggcagcagggcactggacacccagatgtgcagcattccagatctattgccagccacccccaaagcctgaatgtcactgccttaagtgaggaccacttcataccttctaaccaagccaccatctcatctaccatgactctggaaaaaggtcccctgtgggcatcattaacctgtgctgcatagacagggcacctcttagctgtaatgaccactgaacagacctgctgggagtgcgaacaccttctgctcagtcgtggctgcacctgtgacccagggtagagagtagcaatgcatcctgccatgggccaggcaacagaggctcctcctcacaccgtccaggtcaggtttatgaagaatttcatgtctagcgaaagaaatgaaaaggctaaaatttcagtattcctgaagcctgatgacttttagattaggaaacattaccactgaatacaagcagcacaaagaagagcttgtctaccaagatgagcctggaagtcctgatctccagcattctagatagcacaggggatctctgcactttctcagtcttgcacatgactccaaagttggccttagccttctgaatgagagaagagtgctttgtaaaaatttttcttttaaacacttttaatttctggagagtcattttgtcagtaagagtcaagatcaaatgcaagcagctatgctatgtcagaccgtttttgacctacaattacctagttctagtagcacaaaattttatagcagtattaacaaagtagagcacttatgaagacggccatagaaaggaatttaaacaaattgagaaattttatttttgaagatataggaaattgtgtttaatactggaagagctcttatctggatatgagattagatttttcttgtgatcattaagcatacaccaagcgcctgctgagagccaggccctggaaatattgggaggaggaaggtcccagaccttagaaaggagttaggacatgctagtacaagttacagggaggtagattccagagctatctaagaacctggagggtgtcctcgaagggcatgggcctcctctccaaaagtgggcactccatctttggtagaggtgaagggaaccctggttagacacaccctgcaactactgaatgctttcctgaactgggtgccaagttcaggaaaccaaccagttacaacttagcatgaaaatttctctccatggtccttgtgatccaactctctgctgcaaactgctgggttgaaagtggtgccatttctgcttcaactcatggccttttccctacctatatgttgtcccttgattggtctcccttccagaaaaatgtctgcagcagactgtggcctaaccaggcggtcatccccccaccgcctgagttgcaccgtatcagccaagatgaggcgcttcaggtgctggacagcacatgtgactctccagagggaatgtcaggtcaataatcatgcactgggacttgaatatgcttaaggctctgtgaagagtgcacaaatgtgaacaaatctcctgtcctcagagatcttgggaggtctggggaggggatatgatgattgtgcaggccaaaaaataaataaaaggctatatgaaagttaccaagattgtgggggcccagggtgtggcaaaagcttgcatgtgtttctgtggattcatggggtagatggtagatgaggcgcactttgaaaatgagtgtgattttgaaaggaagagatagaaagaagactgcacctagccttcccgatagacaagctctctgcgcagaaggcagggagtcagtggagggcggggatgcacacagggggcatgagcaggcctgtttgtccagcgaggaggcaggtgagggaagaaggtacaaagatctcagtgtgggctcacatttacttcctttgcacttcttctgagaagcgtgtttaccttctttacacttgctctaagaagaatgagatctacttaaggagttgattctcccaagggtatgagtatatgtgtgtgagtattaaagccagacaaagctttcttgtttagaggggacatccttgggttttctgataggatttctgtaggctttgtttgcttggcttcagactttaagacaattagttcactagatatacaaggaaaaatcattttacccactcagaatttgactcccagagctctgcaagatgtttttgagtaatctggggtgcacagtgttaagtgaggccccctctatactgagaaaggcaagttggggttctaaaagtgaacactggttttacctgatgaaggctgtcggggtgctccaggcccacctttactctgctgagtgatgcatgttcttctgattcttttccacttcaagggacttcctgaaagctggcgacaaggagaacatttttaacgcagaccatttccctctctggtaccgaagagccgctgagcagattccagggagcttcgtctactcgatcccattcagcactggtgggtgcccttgttggaggcgggctctgtctgtctggtccagtgggtctgggcattgtgtgcagggtgttggggagctgcctgaatgctgaaaggaaccaagttcaaccctcagagccagtgctgaatattgggtcagccctgaaccagtgaccagttccataagagtaatagcctcaaagaaaaggaaggtttttcctttaccaaattatgtaaatgtatttcaggaagcagggctgatgttttgcatcctatgggattttaatagaaacttgtcagtcagtttttttaaatgtagtcatggccccacttagagaaaattcaagcatcccttgccagaaccttcagtgagtcacatccctgcagaggtccactgttccccatttgaactgaattgatttaaactgatatgccggactaaggactgactttgtataaccatgtgctctcttgacaggagcctgcagttaccaatgacaggcatgtagccgattagtttttcagtcctaagagtttatgatatgatagtataaaaaattaaagtcacctgcctccaaaaagaactgaatgatgtcttatttccaccagttttggaagcaaaacatactggaaatgcttcagttttcctcgtattttttttttctcttgcctcatgcatctggtattttgggtgctcactctatactgcttattgcagaaacttgagagatgaaggaaacctagttctgtaaacttgggttgctctggaaagttcaatctgtagttatattttacatatatcagttcctttcatattaatcttctacaaatattcctaactcaatcctaagggaagttctccagggtttgtgcccaatccccctccctaaggcttggtgctttgtcatttccatgactgaaaatattttcagaaagggtgcttttgaaatttgtagaaagcaaagagtgctcttacaattggttgaatgggctcattaggaagacagtccctcatcaatggacatatttaaggagaggctgaatgttattgatgagattctttgctgcttgggatttcagactagattatctgttagattcttttcaggtctaaggttctttgggtctgtgctcctttgctgatagacctgtgtgtatgcctgcctgtagttgtgtgtgctttctcaaatgtaaatttccaggtgtccgaagctcgcttgcttgcttgcttgcttgctttcttccttccttcctttctttcttttttctttctttctttttctttttcttttttctttctttctttctttatctttcttttcttttcttttcttttcttttcttttcctctctctctctcttctccgccccaccccgtcttttttttttttgagacagagtcttgctccgtcacccaggttggagtgcagtggcatgatcttggctcattgcaacctctgccttctgggttcaagcgattctcctgcctcagcctcctcagtagctgggattacaggcacccgccaccatacccagctaatttttgtatttttagtagagttggggtttcaccatgttggccaggctggtctctaactgctgacctaaagtgatccaccctccttggcttcccaaagtgctgggaccatgcctggcctgaagctctttctttgtgcttgtctgcaccacactttgttgctgaaaatatcaagagacagtgaactttttcattctgctgcagacctatgaataataacattgtcttctgtcaagcaatctcttaagacttccttgtcacaatcctctaaagaaaaataatagaacttagcttgctgttcttctgattctggaatcatcgagttaactaaagctgttgttggattggtttttggtaactgggattttcaccaaactttcaatgtaatggtataatgaagtgagtttaccttgttcatgacaaagttacagatgacgtaacatcttaggacatttcataacccccttagagtccgggaaaatcttaaaaatcaccaactgcaagtctctgtggtggagctctctctgattttctctgctatgtgttgaatacctgtacaaactagaaaagaaactggtttttattgctgcttaaacttgggccaggagaaaatttctcattactttggtcctaagtgtattcatattcaggtttgacttttccctgcttctcaattcaattggatttcatccaactcactttcattgagcaccttttagcaggtgggcattggactaaattattaactccaggcattcagaatttgtgctcagtatcttttaattcgtggatattggaaccattgctggtaattgaaaatctcttaatactaatgccatattgttaccagaataataatagtttggagtgaagattatgctctagctctatccctgtttagaataattttgcccagaaaaactgggctcgaaattacaattttatagatcagtaaagatttaaccaatgaatcagagctaaagttgccaacttgtaaaataatttcaaagccctcatacagctcttcatggttatatttagacaggcagtgtaaatatgaccactgacacaagtaaacactgcaatttgaaaccacagattaccaaaaaatgtggtccctcgatggtggtcaatggtttcgatgtgaagaggctggatgttccccagtgcactggtggtcataactcaactcgccaattccttcagctgggaggactcgcagcactgcactcatggcctggcagcgtaggcagagcatccacacctcagaggactctggggcctgggaccaagccccagaacaatttgcagaattggtgactgtagaccgatatgattactctcttaacgtgtacactgtaattatcttcatttttgttgtggtgttttttcttttcacaggaccagtcaataaaagcaatgtggtgacagcaagtacatccatccagctcctggatgaacggaaatctcctgtggtggcaggtaaataattgattgaatccatgaagacaaagtaagcatggcgcccattcatccggccagtgggctacttctgtgaggcacgcttatcctccaaaaaggttttcaaaggagaaaacaattttaaattacttccttctcagcttggtgtcatctccttcaaaccaagactctgacagctggtggtggttgatgtgaaaacagaaaactttcccagcgtttctatccttaaactctgagccagtaagaaattgtcagtacttgccgaggagaatttcttgatggtaggtagcatgttcattcaaagtaaactccagatctccagcttctgtgtcattaggatgacagtgggcatacaaggaaattgcaggtttgttttaggcaaacacaaactgaaatgtgcccttctccagagagactgagattttcatccccctaatccccctggggaattagagttagctgtatctgcaggtgctgtgtttgggaccaggggaaagccaaaatattatatgactgagagtcttgaattgtcaaagaagtcccgtttctggctttttccatttctctcactttttaggagtgtcagcagctgtctgtggatggctaggggctttcattggtggcatttggcctaaagggctggcaactaccaaaaagccctctttgaagacagatgctgacataaaaacaaggcccgagggtgtgtctggcacatggtttattctgatcactttggagccattggttgatgggtgggtgatatgctccaagcaccatcctggtattggctgggtttactaaagagagcgatttttgttttccagcagtctccctcaataagttgtactttagggtgacttaacatccacttctgtgtcttcacacactgaatatttgtgggaaggagtataaatggagcagatggaggagacctgtttgaagtggttgttctttggcgaggaaatactgcttttttccccccactttatttcttacttggcctgtgtataattgtattagtagggttgaaagatctgggggtagttgccctggttattcctgagttactgggtgtgacaaggatgacagccttatgtatctgacctgtggctcatcttgaactaagcagacctattcttaatcagccaggagatatgggctctgaggattcacagttgctgtcttcaaattttgtcacttaatgtctcatgttccttgaggaaagtgggagacgggatcatttaactcaacaagatttacttatgcttaaaggaggtcaggcttgcttacctccaggctggtccagcgagctaattctgaaggcatgttgtctcccgggagctgaggccacatgcagcagctgtcagtgacatggtctggccagaatatctggttgtctgtttgaaatttctttttaaaaccctttctttgggtttctagtttagtcatcatgaaggatgagccctaaggtcactgtgcctgtcccagccacctctgtccaagtttacaaactatgctcacatgtttccaaatgccttacatttcataaatgcctgtttggctgagtataggtgaaacgtggtctgagcctgaacactgtgtatccagtctagagaagaacgtgcactttccaaatgctatgccagtctattgtcgagttgcatcgctggccatagaccacaggcaggtcacgagacacagtttggtccaccctgagtgggtggagaaggcaccctcctatttactgcttctctgtgtatgccaaatggcccccattttcagaagataattacagagcaaggccaagaagcaaggtcatttaaagaaccgtatttagtccttaccttttagaattggtgactgttaccctttttcaaactttggtagacgtaagataaaacagaattgcttggttttgatgttgaagactgctgtggatgcagccccacgaaggcagtgacctcaagaagacctctctgtctccaaaaatagagcggcctcttcagcaccccctccccaagttttcctgactctgactcaaccatcatatcactgtgtgattaggtttggtaactttcctctgtgtattttcctcaaattaagtagacactgtttaccactctaaaattaaaaaggccattttaattggggaagaagccttgttttggcagatgaagatgaatatgtgagcaggcttttctcccatcagtgtgccccaacagcagatgggagacagccgactggcaggaatgttaggtctcaatgaaatccttgtgttaaagtggaactcttctgaaagaagaggtgtacaactatgcaaataattatcaaggactccttggaaaggccagcttcgctcccaggcctgacctggtcatctcatgttcattggctatatatgtctggggtagaaagaggtttttttgtttcattttcttgttttttgttttattctcttctttctcttttgtgtgttttcttttttaaacaaaaacatttagatactcatctgtcaatgacacctttgaagaaaggccagtcagactgggcaagattccatttgtacgccagccttggtgcataaatgggccccatccatcttcccggcctatgacattgcttacagtccttctcttgagaagcctgccaactctccagctgccaccagtgtgctgcattttcttaattgctttcccactgcacaggaagaagtggtgggactctccctttggcctaccaagtctcatcctagccctggaaccttctgttgtgtcaggtccctcatccattgcattgttgtcactggaaatgcagatcttggactgtaaggtccacgcagtttgtcattcactctataacttgctaaatgtgtggtcttgggtctctaaagttctatctaaaataggcttgggattattacctcccttgccttcctgtgtgtcaattcagggataaaatgagaaaacaaacaagaaaattcttggataagagagaagaataaaaatgctagagtttagcataacccgtttttatctaaaagttggtggcatattcattcattcaataaataaatatttcctgagcctctgcttttgccaggcactctagctataaataaataataaccagtgtcttaatccattttgttttgttataacagaataccacagaatgagtaatttttttttatttaactttattttaagttcaggggtacacgtgcacgtttgttacataggtaaactgtgttatgggggcttgttgtacagattattttattgcacaggtattaagcctggtacccattagttatttttcctgatcctctccctcctcccaccctccaccctccattaggtcctagtgtgtgttgttcccctctctgtgtccatgtgttctcatcatttagctcccacgtataagtgagaacatgcggtatttggttttctgttcctgcattagtttgctaaggataatggcctgcaattccatctgtgttcctgcaaaggacctgatctcattctttttttatggctgcatagtattccatggtgtatatgtaccacattttctttatccagtctatcattgatgggcatttaggttgattccatgtctttgctattgtgaatagtgctgcagaaaacatacacttggatgtgtctttatgatagaatgatttatattccttcgggtatatacccagaaatgggattgctgagtaggatggtagttctgtttccagctctttaaggaatcgcaacactgttttctacaatggctgaactaatttacactcccaccaacagtgtataagcactcctttttctctccaacttcaccagcatctgttattttttgactttttaataatagccattctgactggtgtgagatgatatctcattgtggttttgatttgcatttatctaatgatcagtgatgttgagctttttttcatatgcttgtgagctgcatgtatgtcttcttctgagaagtgtctattcatgtcctttgcccactttttaatggggctatttgttttctcttgtaaatttgtttaagttccttatagatactggacattagacttttatcagatgcttagtttgcaaaaattttctcccacagaatgggtaatttatacagaaaataaatttatttcttacagttctgcaggctgcaaaccccaagatccaggtgcccacatctggcaagagccttcgtgctgtgtcatgttatgacagagggcagaaggtagaagggcaagagagcacacacaagagaagagaaagggcaaaacctattttgccttaacttacttattgttgacttgagttttataaattacgctgatcgtggtggtgattctttactttgttctccctggagagacctggcccactagtccagcagtcataggcaccgcatctaccatatcagggtagaaatgacctggtacaaagaaatacagggaggcagaattgaagcaagatggaaggtgtggccctgcaggagacttcttcccctcctcaaatcgtctgtctgacttccctgtttatcttctagaccctccctctgacaaatacaagatactcaatcccaatatttgttaacaatttcagacttctagagatgtgtaaaatattaaataatgaaatctgaattatgtgcacttgctttaaagtgtaccttttaacataccaaaatctaaaattgctcctaaaaatgtttcattttgatttcttagatagttttgaactctttaagggcaaagacccaattatctttttattcccagtgccaagtacaagggctaacatacggtccatatgggagcgatactggataaatacatgattcaaggaagacgggcttcattttcaccttctttatgtaggtacatatttattgaccagatagtggaaacatagtacttgactaaaactctaagacagataatcactcagtagctaaaactccagtccatactatagtaatatgatattgatcaatatgaatattttaaggaatagaaaattgttttgtgtcccatcccaaaagcaaccttgttggaccagtagttatctctgcatcagtagatgtcttttctgaggtccgggcatctaaggtgatgcttagaatagctaatctgatcacatcagcagataaaaaggagtatagacaccagagacattggtttcttatagaaactgctctttttaaacagctttattgaggtaggatttatatatctttttaaattataaaattcaatgaattttagtaagtttgggagttgatttgcaagaaacacagaacactttagatctgttactggagaaatttgaaaatgtgggttatgtggtctcatttgcataactcagggcagtgtaatgaaggggaagatcccatttaaccagctaattaggaaagggattgattaacatcagtgatcattaactgttgccaagtatgtggtatttaatctgaatgcagtatttactatgggcccttcattagagttaggtgaataatgctggcaaaatgttctaggcaaaaatttaacttgtgaacattcctttggtgggatctcacatatttggtatgtaggagttaactagtatgtcagaaagtgtgtatcaagtctgcctggataaacctctagtttttaaaatctgagcaaaggaactgttttattttggcaaaaatgaaaacttactgattaaaccagtagtttccaaccgggggtgattttgccaccaggggacatttggcaccatcaaaaaacatttctgattggcactactggttaggaggatgctactggcatctagtgggtagaggtcaggaatggtgctaaacatcttgcaaagcgcaggacagcctccacaacaaagaattatgtggttcacatgtcagtagtgctgagattgagaactgttgggttaaactgacaggtaaacttcaactcagtgctttcaaattcagtgtttttccttatagactaacaatcttgattcatttctttatttttaattaactcattcaataaatatatatattgcacctacagtgttcctagcgctggggatacagctgtgaacaagtaccccagaaggcactgtggagggtgtcaggcgattgtcaattgatgacaagggcactgttggcatcgatgtccagagactgagatgacagcttcccaatgaagaattgttccacacaaatgctgcagcaacctctgagaatgctgagcatggccaagttgctgccaatggagagcttccatttgtgtggcagatacacacaagtattgcaggaatgagagacaggaagggaaggaagggaagaagtgaaagggagggagggaggaagaaggaaggaaggaaggattgatttctagtagtggtaaatactctctagaaatggagtaggattaagagatgaaatgtggttggcagtggcaaaggggagaggaagtgcgcagccatgtgcacatgggtatgtggtggggcaatgcctttccaggttgggggtggtttgagaaggcctccctgatgaggtgacatgaatggaggtctgaatcatgagacgcagtctgcagtcatcatgcaaagatatacaggaagagtatatcccatatacaatgggaactaatgcctccagtaacctgcaatgagattcctcatccatgtgtccatattccacgtgggtgctgtgagacctgaatgagtctcttgggttttgggggtagttaccaggttctacaaccagagctgatgagtaggtgggtagctgacccagggaaagtgggcaacccaaggcaagtctttgctctgaatgtcaactatgagatgggactttttatatgtttgacatttttattaagctaacaaatgagtactatgcagggacagaagcaggtctaagccagtaggactgacaacagcaaactttatagaaatgggttagtgatgtagctataggtcacactttatttaaagtctacagcagagtttgagagtgagagctggacattagagcagctgctctgcataccacacagtagccagtgacaagggcatgttgaggattattgccccaggaataaaaatagcccagagttttgagaaactggatcctctgtgctcactctccaggacacttgctcccaagagttactgtccctttctaaactcctcaaaagccccaacgcgccctccactcaaaaatgagcagcagaattttggggtgacacatcctcttacctgcttgtgtgttctaaatcagcaagttaagccacttcttttagaggtcatggtgggatgtggacataaaagacagtgtgaactgagtatttatgagtgagcacaggccatccccttccccaggcctcacccctgtgccttccttttcacatgtgtaagaggaggttgtttggtgcagaggttggatctctaacagcctcatttttaaaaggtggacatttattttaccaccagagaaaagggaaggaattaaccaatactggaatatgtcttagacccagattcagtcttgcgtttgggggagtgtctgattcctgttgagagaaataagtttttatgtatataaagtttttggtaaatgcttacatctgggtgggtaataatcattagctgctaaattattattgtcgccctcttcattaagaattaccatatgttacgcccactgctgctcactagtcagtgctgtttcctgtattatgttattttttctgaaaacttgcatatcagaagattatattaataatatcttgatatgttttgtattaaaactttgaaactcacactttcacatacctgtgcctcagagctgaggttcgcaaactacagctctaggaaaccactcgtgtgctttctctatggatttgtctatttttggacattccagataaatggaatcatgtaatatgtgcccttttgtgacaagcttccttcatttaacataatgtttttatgatccatctacattgtagcctgtatcagtacttcatttttaaattgccatataatattcccttgtatggatagacaacatttagcacatccattcataagttgatggatgcttttttagctgttagtaatgttgatatgagcatccatgtacatgtttttgtgcagacctatgtttttatagtctcttgggtacatacctaaaagtagaattgttgggtcatatggtaactctgtttggtatttggaagaactgcaaaactgttttccaaagtggctgcaccattttacaacaccaccagcaacatatgaacattccaatttttctacatcctttctaatactgtctgtcttttttattttagccatcctagtgggtgtgaagtgatttctatttccctaatgacttagcatcttttcgtgtgcttacttgccatttgtatattttctttagagaaaggtctattcagatcctttgcccatatttaaattaaattaggttgtcttcatattgttgagctgtaagagttgttcatatattctggatataaataccttgtcaggccgggtgtggtggctcatgcctgtaatcccaatgctttgggaggctgagtcaggtagattgcttgaacctaggagttcaagaccagcctgggcaacatggtgaaacaccacctctacaaaaaaatacagaaattagctgggcaggctggcaggcacctgtagtcccagttattcaggaggctgaggtgggaggatagcttgagccaggaaggtcaaggctgcagtgagccgagatcatgccattgtgctccagcctgggtgacagagtgagaccctgtctcaaaacaaaagagaaaaagcaaaaaatcttgtgagctctccactgcctgtttttgtagaaaaagttgtattgaaatgcagccatgcccatattgtctgtgaataccttcttgctaaaatggcagagctgagtagatggaggggtagagaccatagaaactgcaaagccaaaaatatccactacctgctccttcacagaaaaagcttgccaaacccaacttcacatgaaaatatgtcacatattctatttaaaagaacaacgaaaaaggctgatttgttcactcacctatttaaacatgtttctataaaaatgaagtagatatttaaatcagaggttatgtaagtggatgccgaagacagagctttgtgtatcagaggttgtgcatcggtagtgcctaatgtttttgtctgtgtggttacacagaaattccaatcaaagatcctaagctttctaaaaatatatgttttcattgtaagtcaagacagtgatttagttaatcttcactctagcttataaatctctgaacagtgcaatcagcataatgcttggtagaacattgaaaatgccctcacatgctttggtggaaaacagtttatgggatttttttttttttccaacatggctcatgagagatttggggatttatttaaccgcctttatccaggcaaatctcctagtgaccttgttgggattttgatctcagttaagactagaatatatgtgactcatgctaagtaaagggcccacagaggatagatgagctgacatgaatttccctcccttgggaaaaaagggacgggcatgagcagaatctgcagcagaagagtccaagcttgtccaacctgcagcccatgggctgtgcagcttcaaatgcagctcaacacaaattcataaactttcttaaaacattatgagattttttttgtgatttttttttttttttttttttagctcatcagctatcattagtgttaatatattttgtgtgcaacacaggtggagaaccctggggccctgcaacatttacaagtcagggagatgagtgaatcagcaaatgagacctaggagggttggacagtgaggtcggctaagaaccaagtaaagggagacttcaaggagaaagtgatcagcgtggtgaagaagacaattcttcttcttccagtgtggcccacggaagccaaaagattggacatccctgcctaaaccctttgacttgactgaaagtccagtacatggactttcttgcctgaggaaaatgctttgatcagtgtctggtgggaaagggacagtgctgatcaaaggctttttattcccaatgtctcccaaagtttgcacttaccaagaactcctgggttctcttctgggtgagaagatgtgcaggatgttaggatcaatgcctgaatgtcatggtcacctcaaggccaaagtacacaattatacatgacacagctcaggcagatggtagtaggtaattgtctttcaaaataaaatttcagaatgaaaacatcgtgtatggtcatagtatatgctttaccattcttccaccaacttccagattttatgatatagtcaggtttttaagtcaaaagtattctgttacattattttatttgtgtgatgcattactcattcttttatgctatatgctcctctgccttgctgttttccattttctctggaacccactccacaatgaaatattcctcatgaaggtcaccagtaatttcagtaacttccattgttcttttgtcgtggcctattagcagtgcttcaccatgttgatcactttctccttgaagtttccctttacttggttcttagctgacctcactgtccaaccctcctaggtctcgtttgctgattcactcatctccctaactagtaaatgttggagggccccagggttctccacctgtgctcctatttactctcaaggctttgaacactgttcataaactggtgattcccaagccacacttctcttacttgaccttacttgcctattcagtgtctctactctttccccaataggcctgtcaaattcattagatgccaggctgaagtcctgattgcattcacaccctccccctccaccctttctccatagccttgataatttaaaatccaactcaataattctcattttctagttagtccaaaacctttggagtgattcatttatttttttaaacaaagcatgtcatcttggataatattgaatgtactcaaaagtagacagaaaaaaatacaatgaaattccacgtatcttgtgcccaatcccagtagccatcaacccttggccactgtgtccttcaatttgccaatccacaaccacccctcccatattattttaaatcaaatcttagtcattacatcgtttcattcataaatacgtcagcctacatctttaaaagataaggacttctttggattttaatatagcaatacaattacctaaaaataattcctaaatctattacctagtcagaatgtaaattctagttgtctcaaaagtgtcatttattttttacaatttgtttgaatcaggatcttcttcctcttcttctttttctcttcttcctcttcctccccttccccctccccgcttctcctcctccccctccttctttgtcgtcttttttttttttttttttttttaaagagatgggggtcacacgtttttccccagactggtcttgaactcctgggctcgagtgatcctcctgcctcagcctcatgagcagctggaactacaggcatgtacccctgtgcctggctttgaatcaggatctggaagtcattcttgactctttccttttcctcctacctacaaccaatctgcctataaatcctgttatttctttcagttatgtacagagtctgaccacttctcagcacttccactgttccctcagtgggccgctccactttcatctctgccctggattgtcatagaagcagcagcttctaccgcttcccctgtcttctcccaaccttcacctcttcattttattcttcatatgagccacagaaatcatgttaaagataagtaatatcatgtcactcttctatccaaaactctctattgacttcccactttactcagagctaaaagccaaaattctcacagaggtccaggtattagttatcttatgccaaagcttaatgccttaaagctacagacattgtagctacagacatttactattgtacagtacctgtgagtcaggactctgggtgcagcttagctgagtcctctggctcaggatcttccatgaggctgaaatgaaagtgttgttgagggttgcggactcatctgaaggctcaacagaggaaatgctttcaccgtcactcatgagatcattagcaggattcagttagctccttgtggtttgttggccagagacctctcttacctccttgccacataggcttctccgtagggtagctcatagtgagctagtttactttgaataggacaagcaagagagagtgagcaagatagaagctggagttttttgtaacttaatcttggaatggatatcttattacttttcccatattctgtttgtttgaagcgagtcactaggtccagcccacagtcaaggagagagcatgagttccaggaggcaagaatcattgagagttatcctaaaagcacctgccacaacctgtaagtcctacatgatttgacccctattaccctctaatctcagctccttctacttcccttttgcccactcaaccacagccacactacctccttgttcttcagtcacaccaaccttgctgctacctcagggcctttgcacctgccatgccttttccatgggacatttttcctccagataccttcaccactggttccatcatttccttcaggtctctcctcaaatattttctcagcagggaccttccttatcaccacatgtaaaataaaaactcttcctcttccatatccccagcgttctctcctcttcacatctgcttgttcaccacctgatatgatttgtatttctttatcttctccctctgctagatgttaagtttcatgggacagatattttatatttcttgttcactcctttagccttaatacttggaaaaggagaacatcctcctatatgccacattgtagacggtcttcatctttaatgaatgaagacagtggggtctcaatgggaggtattgtagaagttaaatgtcctcagataccctacatacaggacagcatgattcctctctgatttgtttttaaactcagggtctcagtggaaggcatatcagcataggatgggctgtacagactattgctctcgtccttgacaccccactcatctgtttcaaggtcacacctctgctctgttttgttttgtgttgtttttttgagataggatctcactcggtcactcagactggagtgcagtgactggaatgaatcactgcagccttgatctcctgaactcaagcaatcctccctcctcaggctcctgtgtagctgggatcataggcatgtgccaccacatctaattaatttttgcattttttgtagaaacgggattttaccatgttgccaaggctgcacttctgctttagatagtagatattcctcctggagacttagctatccttgagcagtattcctaatttccgtggccctcgtaactttctcctcttctgtgtattaatgagtatttcaatgggaaatacttattggctagcatcttaatctagactctaaatttcccatttttctcaaataatttcaagagagtatgactgagtttcttcccctctcatttggagactgccttttccagcccagtagagccatagattatgaaagggttcttatttccccattttgccttggctccttcagccggcctcctggttttagtagtaccagagctctggcagtgtcctactggttggtggttgggtttctttgccctgccatgctttaaggtaagtgttggcagtgccaggaaaggatcctaactctgacttcttcgaacctgtcaggtcctgaaaagtgcctgggtgttggccttgggaagagttgcatccagattcccactccaccatttactagtggtgtgacgttgagcaaatgacctaagctgtctgtgtcttcgtatgtaatgtggcagtacaatacccacgtgttttggttactatgaggcttagagaaaattaagtattatgcttggaaaatacatggcacgaaattgggtgctcagtaaatgctgataatggtgttgtaattgcccttatccaaatacttagtataataatgtcatagttttgatattgtgattcaccactaaatgaacaaagaatggtgaggatcgtgttgtgttatctatgctaaccccatctcctgcaactgcatttataagtctgcagttaattctgtgcatgacttgtgtaatgttgctttcctttccatgcttccatttcttctgtaaaataaggacatggaactatatcagagtaacaaataggtttaatctcttatgtcaactccagttgatcagtaatggatacctggaaaacagattaaaaaaaaaaattatgaggccttgtctgggctcagcagataactttgtcatgatctattagcaatgtctgcaatggatagaaaggctggtggcagctattctgaaattctccaggcctggactaaatgctctctaagacccttctcagatccccagtcctctgatttgttatcaaggtcgtcttgatgggcctttgtagctggctgacatcctatcctgtccacccaaatgaatattcagtgtgattggagtaaaacgtagatatgagtagtccagttaagaatctgaaagggattatatatcagtaaaaataaataaaaattaaaataaaaaagaatctgaaagggaagtggttgattaggcagctgcttctctgaatggggtaggggtttctttgagactgcattgcaatttgagtctaaaaaataaagcattttaatcaaaagagcaaaaggatggttccctaaagtcatgcatgcagatcatagcccagcaatgccatgtggagttggaatataattttgtgtgggtttctgtcaatagcatttagcaatggatacagggatgggttttcccaaactggaaacagtaatttcctgacctgcaatagaaagttataggtttctaacggttgttggataattatgtgaatgtgtgctacagatagattattttagaaattagtttaaccacttcctttgatatttaggatctaagataaaggtgtcttgtttcaggggtacttggttaactcaagcaaggagatttgatttgcacagaccttcaggaagaaatctgtgtgtgcatcactttttagtcttgccatttttataaggaaaaatgaaacccttagtaatccactggcattttataatcttaagcaaaagattcttcctgtggggtcagggatatttgccttatttgtaaaagcttttcagatataaagttgattctaggtcttccttctccaaaatctctatggcagagtacattcttcatgccccctttttttatgcctcactacagacagctacaatatctgtgaatttatgatccctggcaaggcaaaaatcacccgtctgtagccatactgttctactaaatatgacgaaagaactatatttttagttttctcagaaacaatcaacactaaacgtgatttttgtccacagtgtaccctcagcaaggcttctatgacagaaggacatttttataagggaatctatgaatatgacagcagcaataaacagctgaaaataatctatgaggcgtttgcaaattacccctcatgagctgtagtggttgtgaaagataatttgtggttctcacagaataccctgcaaattgggtctttcatctgcaatgttttttacagttaaaacatttcatttctcatattaacaaatgataactctgcatttgttaatgtaaacaatttgatttatatttttttctgtgctgagaagctgttgacatttcagggtaagtaattattttcattgccaactgctgtttgtggtgactgtaggcaaaagatagaaatctgaatataagtatgcatcattttaatcattttccttaaagactgcccataaagcaggaagtctgtttgcctgagttatcatctgtacttagaaatctaaaaggatataagtgttgacaagcaaggattctagtcacgttcagggttttctgtggtggatcagaaactccctcatgtaatctctgtgggtagggggactgggttgacctccactgtcaccaaacctctggcagggcccagtgcacttgctgactgaaatcactgcattaaaacgaagcatgcgttattgacctcagtagctctcagctaatgtaatatccgttcaagtggctcatggggtgggtgtcaggattacacaagaacgccttgcactgtgtctggtacacggtacacggtgtgagctctggaaacatttggtgaaactgggacaaggtataaaaacgtataattcctttctcacactgccttcttggccaagcatcctcagtccagggccatggaaagaaaggttttttcacttggaaagtagtcactacgtccataaagaaggatattgagccatgtccactgagtggcccatggagaggaggtgccagggcctgggacagagctgatgggtcagcaggctttccttggggtctttctttgatctacaatttaaggtatttcagtttctttcgatattcagaaaaaaattaccatcgaaatttaaactttgtcccctagaaaaatcatctagcaaaattgctgctccagaaaggtggtccatctttagcctctgggtgtgtggggcccacactagctatgaagcaccatggcaggtgtagattgtctctgtgattattagaggtgcatccgtgtgagacctgcacagtaggaagtgataggttcacccgtttccctgcatctatcccatacacatgtgaaccttccattcacatttcagttagagaatggactactgatttaggatccaaaccaatcattacatggcctgaaggagtgaatgtagagccagtaccctgagtagcaaatgtgttttatcctttgaaccaactccagttgattagttctggttgcctacagtgctgtcttaaggcatctgtggtgctgagctaggaagagtgctgagattgattagcaatgtctgtcatggcctctggagggacagctggccctatatttgccattctctgcttttaacatgtccataacttctctgtcctctcttcttgtgtaaaatgattttaatactaacaggtgactgtgagcatcatgagagagaacaggtagattccactttaagaaaacctagcatgagaaaatgcaaaatttacaaaatgcataaatctggagccaattatttctattacagaaagattccatgaaaggttcctttaaatagccagctcccctactgcattaaaatgatgattcaatttacaaaaattcactttgcatgcaactcttcaagaccatgtctgtggagtaaagccagccacacctgattttttaaaaccatggcctaaataacattgaggatagctgccgccacctatcttgagtctcttggtaattcccactctctgcagtcttccttcttactcctatcccagtgtggggagtagacaatctgggtggtggacaacagctgctggcttccaccctgacacggctgcatttcattagtgggtaaactgattgctcagagtatgtttatgtgtgggtgtggttgtacaactctatgcactctgtgcgctatgtatgcagatacagatacacaaaagtcattatctcgctctcagcccaacctaaattcattcctgctgtaagagttataaatggaaggttccaatcccttggtggatatggccttttggtaatatctgccccaaattctggctccccatcctctttgtgtttgtttatatgttatttacccttgcatcagaaaacttccccagactcagggcctgagtcctattatccggacatggaatcttcttcttcctctgaggcctagaaagccccaaatggttttctgatttagaaaatgaaatagactttgactcttgtggcaagctatgaaattcccaaccaacagcttccactaaatttataacatatacaacatctaaaagtatcactgatctagcatgaactcgaattatagaggcattcaatgcccatcgggtaagatcaccagcctcttcccaagcactcaaaattgggcagttttccagtggaccataaagctcccaggaatgctgattggcatgtgtgtttgaatttctggtgctttgtaaaaggaacttaatccacagaagagtacctggaagagatggcatcttccctttctctgtgtgtgtcttacccccacatagaatcgtcgtaataacttcccaggcccagagcacaagtatcatctttattttacctatagtattttaaaaatcgcaacataaattcctccccagaaatattttttacagacacatcttttttttttctttttttttttttttttttttttgtcttttggcaaaagcaaaatcagactaacaggaaacacatcagccctactcagacactatcttctggcctgcaatgaccaatcctatttgagacaaaagctctcaggctggtgagctgtcaaatcgctctttttcttccaccttcccaggatcattggtttgagccaagggtcccccatggtactgggctgtgattgccgcataggtgcagccatagatggcagctgccaacatcatgagacacacaatcccacacacaacgccagtgatgatgacagtggcaatggcatgacgcaggttggccggccttggcttgggtttgagctcgcactccaagagttctcgctcccccgcgttgtggttctcaggaggcctcaggaccacaccgtgggcagagccgggccactgagcctgcgaggacactggatcaggagcaggaagagggcagggctggtacagctcatgagggatcctaaggaggtcctttcccttccaggtgtctggtgattcacagatgatgccgtctgttagtccccctttaaaaaacaaaagcaaagaacaataacaaagccttgatacaacagagttccaaaatcctctgcctgcaaaaacttaggcagatggaatttatgaagtaccttttttttttttaaatcctggagtcaaagaatttaacaaccatattttatgattttaggattcctaaattggctaaatactaaaaatgccacacactaaattggcaattacttatgaccaagaattcattagaagcccagtaaccttcatgttctctaaatgctcagagaaaacaatgcaaaagctgacaagaaggcacgctgggggccgatggtgagggcacagctgcccactgcattcgtgccacgcatggtcctagtgagccccacagacaagaaaacttttgtaccagattcccattgaaaatctaaggaaaaaataaaataaatgtgcattgttgtgatgttatgtgtttattacaaagatcctgtgtgtctcaacactgttcagtgatgccaaatggagaggtggaatggtcttggagtgatctgtggatttgacaatactggaagtttagttcctggaattcggtaccatgaatgtgtctcctcaggcctcagaacatttacggctttgaatactgaactttccagtgggttattaaacccagtttccattacctgtaaggtgattgatatcctcaggtgtgtagactgctgttggtcgggggaatttgggtggtcggtcattctttcctagagagagccctgagctagcagactgaagtctagtctagtgtgaccactgatttactctttgactttgggaaaatgtgcttcgctgacttaattttctgccatgaaaacatgctatttgtatccaacttgatggtttacaaagcactgttagataagtcctaatactccactcttgtaggtaactcttgtccagactcacagaggtcacgagtggatgaaacaacatccaaacccagttctccatgctcagtccaagttttttccactacactcgctgcctcgccacatcctcctctcaggagcgttgtgaggtcagaggagtgggcaggatggccctcggcactgtctgctaggaagccttttgattggacagaactgccccatgacctgcaccttggccctctcaggctgccataagcacctcccctaggccagccgaaaagactggcactgcagttagcaaagttagattggaggagattcttagtacacacagtaagtgaattaggaaattataccagaaagacatatgtagagggcatcacttcaacattattagcaccctccattgcatggcacttcagagttttaggaatgctttcacatttactctctctaagcttactacaagataagtcataagtggccctgtaagtagatagggcctatcttgcagtgcaaggattatcaggtggccccaacacaccagggtgagtggcagtggcaaaattcaacccatgtcctttttgttgccactgcttaaaactgaatcacccaccaccagagtgtcttgggttcctcctggcttctctagcaatcctttgaggaaacagtcctcaccctaaagcagaaagataaaaggggaatttcttccttttttgagccactgattttcctgaggccagaggttcagagcagctgctccagatgagttcaaagtgccattgagattaaggattcttgcctcatggaccatttcattcctctgcacctgaccataggagcctctgccaggaagttggttgcaagacaaaaaggtcagagagacagaaatgaagtgatggggctttgagaagtagtcgtgatatttaatccagccagagagcatggagacttctatcaggggaagcaagaccacctgccagggggatggacaggttcatcagctgacttccaccttgactagggtggtttacccaatcaccccagacttaagaactgtgtttctccagttccagactttctgttgttcggtattaaggtgggagccacagcctctggacccagagccaaggaaatacccagactggagcctgggacatagctggaaggcaggggctatggctgccaaatgctctgtggtctcctgtgcaggtgatcctcagccgggatgcaactcccactctccaccatttcatgggccatgaccccctcgtcaaatctgctgattacagcttgagggtcccacatccttctagattaatgtaactgacaatgcaagaagctccagcttgccaagcactcattgttctctatctgatcactagtagctcttcacctctgtcttgggagaaactagattcaaatcttgagtctgaacattacgtagctgtgcagccgtgaaaaactcccttgaccacgttgtgcctctgcttgctcatctggaaagtgggagatgaggataattaaaattcacttcccaagattgctctgaggactcagttggataaaatatatcaagtatttagcataatacctagctcagagtaaatgtttagtgaagtgaagatgacttgtttactagtaaatagagagaaatattaatcatacaatctgtgtgcatatttctttggaggagatattattatgtattcaccaaagcacatctttttgctcttaggccagcaggaagactaaattttcccactttttgtggtctatttgaggccatgtgattgaattctggacaatggaattcaattaattgaattaattaatgccacctccaggccataaagcccccgtgtaatccgccatgcattttgttcccacttggggatgaccttagaggccacgtgataaacttggcgacatcacaagctcgaggggtcttatgtccctaaatgactgcatggaatgcagaccatgcccccatttcctttgaactctgccatgaatgagcaacagattttattgcatatataactaaagtctgggctagtctgttatgtcggttagcctgccctaatacctgtagtgtttgcatttgtttatatatctttttttaaaagaagatcttgactcatatctgttcccttattttgcctgtattcaatatatctataatcagactgtctcccatgtttgacacatatttggatttttcctagttatgttgggacatccaggtcttattaccccaaatcaatttctgccttcctccgaagaaaagctgtgatctgtactcatgcagctctgttgtgacggcgtgttgaaatgcgtcacagaatctgaggactggaatgggccgtaggaactccctgacttaaaactatcagtttccctctggtgacactgagtgctagggaagtgtactaattttcccaaagaccaccagcaagtttgtggcagagtagggcacatttcatcccatcccaggttgcttccagtgccctagtcctgggaactttttttttttttttttaatcaagaaatgttctttaatgaaaactatctttctgtgttggctggcctgtgcttacaatttaatccacaatacaatagttcaagccactttacctgtagacgtaaacaattttatttgtaacctcttataaggaagatgttgccatagtatgtggctcctgttgctggttggcttgaatgtcgactggatattgattatgtaatttactattacattgttgagaaggatttattcaatatcgtacgttttaacccatgttgtattcaccctaacctcattcccgctgagaaccgctacaaccatgcagacactgttgacttccctaattcatgtctgtagctccaacatcttcctgagcttcgggcttaaatatacaacctccaactcaacgactccccatggatatgtacagaacatctcaaacttgacatgccccaagctgaagtcctaattgaccacctccccaacacactcactcactccccccagtcccctctttgccccttgtcagctgaaggcatcaccatttacttgattaccactgcaggacaaatcaaaatagactttcccataattatggtcttctcttagtcatccactccaacccattagcaatgtctgccagttcagtattccaagtatctcccagcattgatcatgtctcaccaccctggtttgggccaccatcatcttcgctggctgactgaaatcatcttctccctcatctccctggttcttcttctgcagcctttcgtcagttctcccaagagtctacagagtgaccttttacattgtaatcagatcctattgttcccttgactaaaactcttcaagagctttccatctcacttaaagtccaagcatcttggccttctctgcacacttctgcatgatctgacccccaagtactggtgttgtcttgtctgtgtctactcactcccttcctctgcactggccactgtcttgtccctctttttgtcctgcagccaagccaagttttccccctcatcaagccctttgcgttcactattccttcccccagttatctcatggctcattcctcctcagtctttgggttctgctcagccatgtcacctccttggagacatcttcccatccatcctatcaaaaatgagacccacattctatcactctccccttcccctgcctcattgtttcttagcactaactgctattctaaacatgtatctttatttatcatcttatttaacatctgtttctactaccagaatggaatctctgtgatggttaggcactgccatcttctcagtgcctggcatacaaaaggcactcaaatatagaaatgaatgaatcatgctgagagctaggaagagtgaagcactgtgaagtggaggaaagaatgtcgggtcaagacccaaaagccatgccttctgttctcacctgggcttctgctctgtgatcttgggcaagtcactgaacctctctgggactctgttgcccattgacaacaggggttggcaaacttttctgtaaagggccagatagacaatacagcccctgtcacaactactctgcttttatagtgcaaagcaaccactcactcattatataatgaatgggcatggctgtgttccaataaaactttatttacagaaacgggagatgggctgtggccctggggctgtagtttgctaaccctgggtggtttccagagtccctcatctttaatagtctgagatctcttgctttgctgttgtcatcatgttaaagaaattgtgagtaactttagagagaggccctgttgcacccaatttcagtgacattggtgtttgctaaagcagaaaggacaattttagaaaagaattacagttgtcaaatgggtagaagcagacaaagagagaaaaatatcccagagagagataaccatacccacaattggatcagacttgataataagaggttggtgttatttggggttgagcagttattcaggtggtgattgaatgtcctccttcttaatagcatactcccagataagtaacttcttgttatattaattaaacaagtgaaagttatctccatgcaacatatttgtagattaatttcgaacctgaatttaaacaccttctaatgactcacttgactcttttgccataccgtgaaatggcaccgatgtgtaaaagcccaaatccaccccttacacactcctccacattctttctaatgcagagaacagatgagattcatcctaggctggtaacacacagatggggggttccaaatagacatgactgacctttatagacaaatttctccagccagagtttaagaccgagcaagtggcaattgcatttccagaggttgtccttgagaagtaaaagcctcacactgggcatggattccaggagcgctcgatcaagctgctgaagctggttttgttgaaccgcaagtatagttaggttctcccaagtctctcccaaggatgtgggaaggtggcttatgttgtttgatgacaaatcaagctccctcagctgagggagggaatggaaaagtctgctttccagggaaaggagtgaattc

SEQ ID NO: 139 - protein, 443 aa, Homo sapiens
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKGNCTHPEDMKLCTVIMKSNGSFPVNRRRVEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 140 - DNA, 300100 bp, Streptomyces coelicolor
acgcaacggcgcacgccccgctcagcgagaggggtgcgccaccggcggctgagaggggtttgttcgtgcatgctttcccacacggcaccacagcgacaccgaccgcgatcgcagtaccgccatcgctccgtctcccggtgatcgaggcggcatttccccggcaactgcacccgtattggccgaagctccaggagacaacccggacctggctgctcgaaaagcggctcatgccggcggacaaggtcgaggaatatgccgacggtctgtgctacacggacctcatggcgggctactacctgggcgcccccgacgaggtcctgcaggcgatagcggactacagcgcgtggttcttcgtctgggacgaccgtcacgaccgtgacatcgtccacggccgggccggtgcctggcggcgactgcgcggcctgctgcacacggcactggactcacccggggaccacctgcaccacgaggacacgctggtggccgggttcgccgacagtgtgcggcggctctacgccttcctgccggccacctggaacgcccggttcgcccggcacttccacacggtgatcgaggcgtacgaccgtgaattccacaaccgcacgcgcggaatcgtgcccggcgtggaggagtacctcgaactgcgccggctcacgttcgcgcactggatctggaccgacctgctggagccgagttcgggctgcgaactccccgacgccgtacggaaacacccggcatatcgccgggcggcgttgctgagtcaggaattcgccgcctggtacaacgacctctgctcactgccaaaggaaatagcgggagacgaggtccacaatcttggcatcagtctcatcacccaccattcactcaccctggaagaagccatcggagaagtccggcgtcgtgtcgaggaatgcatcacggaattcctcgccgtcgagcgggacgccttacggttcgccgacgaactcgccgacggaaccgtacgcggaaaggaactgagcggcgccgtgcgggccaacgtcggcaatatgcggaactggttcagttccgtctactggttccaccacgagtccggccggtacatggtcgacagctgggacgaccggtccacgcccccgtacgtcaacaacgaagcggcaggtgagaaatgaccgtcgagtccgtcaaccccgaaacccgcgcacccgcggcaccgggagcaccggagctgcgcgagccgcccgtcgcgggcggtggcgttccgctgctcggccacggctggcggctggcccgcgacccgctggccttcatgtcccagctgcgcgaccacggcgacgtcgtgcgcatcaagctcggcccgaagaccgtctacgccgtcacgaaccccgagctgaccggcgccctcgccctgaaccccgactaccacatcgccggtccgctgtgggagtcgctggagggcctgctcggcaaggagggcgtggcgaccgccaacggcccgctccaccgccgccagcggcgcaccatccagccggcgttccggctcgacgccatccccgcctacgggccgatcatggaggaggaggcgcacgcgctcaccgagcgctggcagccggggaagaccgtcgacgccacctcggagtccttccgggtcgccgtgcgcgtcgcggcccgctgcctgctgcgcgggcagtacatggacgagcgggccgagcggctctgcgtcgcgctcgccaccgtcttccggggcatgtaccggcggatggtggtcccgctcgggccgctgtaccggctgccgcttccggccaaccgccgattcaacgacgcgttggccgatctgcacctgctggtcgacgagatcatcgccgagcgccgtgcatccggtcaaaagccggacgatttgctcacggcattgctggaggcgaaggacgacaatggcgacccgatcggggaacaggagatccacgaccaggtggtcgcgatactcaccccgggcagtgaaaccatcgcgtccacgatcatgtggttgctccaggcacttgccgaccatccggaacatgccgaccgcatacgcgacgaagtcgaagcggtcaccggcggacgtcccgtggcattcgaggacgtccggaagctcaggcacaccggcaatgtcatcgtggaggccatgcgtttgcgtcccgccgtatgggtattgacccggcgcgcggtggccgagagcgaactcggtggctatcgcattccggccggtgcggacatcatctacagtccgtacgcaatccaacgcgatccgaagtcgtacgacgacaacctggagttcgatcccgaccggtggctaccggaacgcgcggcgaatgtgccgaaatacgccatgaagccgttcagcgcgggcaagcggaagtgccccagtgaccacttttcgatggcccagctcacgctgatcacggccgcgctcgccacgaagtaccgcttcgaacaggtggcgggctcgaacgacgcggtccgggtcggcatcacgctgcgtccgcacgacctgctggtcaggcccgtggcgcggtgacgacccggacgggtcaggcggcggcctcggggccccggaaggtgcgccggtaggcgtgcggggtggtgtccagggccctggtgaactggtgcctcagggccgccgccgtgccgaaaccggcgcgccaggcgatcgtgtccatcgtctcgtccgtcgcttccagcagccgctgggccagcagtacgcgctggcgcaggatccagcggtagggggtcgtcccggtctcctgctggaagcggcgggcgaaggtgcgcggggacatgtgcgcccggaccgccagctgctcgaccgtgacctcctcgtcgaggtgctgctccatccaggccagcacctcgccgacggtgtcgcaggaggagcgcggcagcggccgttcgatgtactgcgcctgcccgccgtcccggtgcggaggcaccaccatgcgccgggcgatccggttggcgacctccggcccctgctccttgcgcacgatgtgcaggcaggcatcgataccggcggcggtcccggccgacgtgaccaccgggtcctcgtcgacgtagagcacgtccggcgcgacccgggcccgcgggtgctggcgggccagctcggccgcgtggtgccagtgcaccgcgcactgccgcccgtccagcaggccggcggcgcccagcacgaagacgccggagcacacgctcagcacgcgggtgccccggtccgtcgccctgcgcagggcgtccagcaggtcgggcgggtactcccggcggacgaagtcgctgcccgccggtaccgcgatcaggtcggcctcctccagccgctccagaccgtacggcgtggagacggtcagcccgccgacgtgagtgcccagcgtggggccctccgcggagaccaccgcgaagtcgtacaccggcaggccctcgtcgctccggtcgatgccgaagacctcgcagaccacgcccagttcgaagggatgcgcaccgtccagcaggacggccgccacgttccgcagcatgccgccagtgtgcctcgctggtggcaggaaatcgaggccttacggcagtcctgccactcccggtaaggagtctccggcgcgacagtggtgtcatgaccggaaaccagatcgaagcccttgtcggaatgctcgcgaccttcggactcctcgtcctcatgatcctcccctcggcgatcggcatcgtgcgcgaccggcgcatcgaccgccggatcagggaggcgcgggaggacggggagacccggacccgctacgggaaggagacccggagcactcagaagtcctcggacaggtcgaccgtgccctccaccgccacctggtacgccgaggggcgccgctcgaagaagttggtcaactcctgaacgccctgcaactccatgaaggagaaggggttctcggagccgtacaccggggcgaagccgagccgcgtcagacgctggtcggccacgcactccaggtactgccgcatcgagtcggtgttcatgcccgggaggccgtcgccgcacaggtcgcgcgcgaactgcagctcggcctcgacggcctccctcagcatgtcggtgacctgctcccggagctggtcgtcgaacagctccggctcctccttgcgcacggtgtcgacgacgtcgaaggcgaaggacatgtgcatcgtctcgtcccggaacacccagttggtgccggtggccaggccgtgcagcagaccccggctgcggaaccagtagacgtaggcgaaggcgccgtagaagaacaggccctcgatgcacgccgcgaagcagatcaggttgagcaggaagcggcgccggtcggccttggtctccagccggtcgatcgactcgaccgagtccatccacctgaagcagaactcggccttctcccggatggacgggatgttctccacggccgcgaaggcggcggcgcggtcctccgggtcgggcaggtaggtgtcgaggagcgtcaggtagaactggacgtggacggcctcctcgaagagctggcgggacaggtacagccgcgcctcgggggagttgatgtgcttgtagagggtcagcaccaggttgttcgcgacgatcgagtcgccggtggcgaagaaggccacgagccggccgatcaggtgctgctccatcgggctgagcttcgcgaggtcggcgacgtccgagtggaggtcgacctcctcgacgtgccaggtgttcttgatggcgtcccggtagcgctcgtagaagtccgggtagcgcatggggcgcagggtcagctcgaagcccgggtcgagcaggttcttggtggtggggtgcgcgggggtctcggtggtcattactggcaggcctcgcaggactcggggttttccagggagcaggcgaccgcttcggggtccggggcggcctgcacggggacggtggtggcgcgggccgcggcgcgggcgatccgggtcgccgggcgcgagcgcaggtagtacgtggtcttcaggccctgcttccaggcgtacgcgtacatcgaggagagctttccgatggtcggcgtctccaggaacaggttcagcgactgggcctggtcgaggtacggggtgcgggcggcggccatgtcgatcaggccgcgctgcgggatctcccaggcggtgcggtacagcgcgcgcacgtcctcgggaatccaggtgaagccctgcaccgagccgttggcctcgcgcagcgcctcacgggtgcgcgcgtcccacacgccgagccgcttgaggtcgtccaccaggtacgagttgacctggaggaactcgccggacagcgtctcgcgcttgaacaggttggagacctgcggctcgatgcactcgtagacaccggcgatggaggcgatggtcgcggtcggggcgatggccaggagcagggagttgcgcagcccggtcgtcgccatgcgcgcgcgcagcgcggcccagcgctccggccaggcgggctcgacgccgtagtggtccgggtgcagcacaccccgggccgtacgggtcttctcccaggccggcagcgggccgttgcgctcggcgaggtcggcggaggtctcgtacgcggcgagcatgatccgctcggcgatgcgggtggacagggccttcgcttcgggggagtcgaagggcagccggagctggaagaagacgtcctggaggcccatcgcgccgaggccgaccgggcgccagcgggcgttggagcggcccgcctgctcggtcgggtagaagttgatgtcgacgacccggtccaggaaggtgaccgcggtgcggacggtggcgtccaggcgctcccagtccatgtccccgtgcgccgggtcgacgaacgcgccgaggttgaccgagcccaggttgcagaccgcggtctccccgtcgtcggtgacctccaggatctccgtgcagaggttggaggagtggacgacgtggccgggggtcgcggtctggttggccgtgcggttggcggtgtccttgaaggtcatccagccgttgccggtctgcgcgagggtgcgcatcatgcggccgtacagctcacgggcgggcagcgtcctgcgggcgagccccgcctcctccgccctgcggtaggcggcgtcgaactcctcgccccacaggtcggtcagctccggcacgtcggcgggggagaacagcgaccaggtcccgtcggcgtccacccggcgcatgaactcgtccgggatccagtgcgcgaggttcaggttgtgcgtacggcgggcgtcctcgccggtgttgtcccgcagctccaggaactcctcgacgtccgcgtgccaggtctccaggtagaccgcggccgcgcccttgcgccggccgccctggttcacggccgccaccgaggcgtccagcgtcttcaggaacgggacgatgccgttggagtgcccgttggtgccgcggatcagcgaaccccgggcgcggacgcgggagtaggcgatgccgatgccgccggcgtgcttggacaggcgggccacctggtggaggcggtcgtagagggagtccagctcgtccttgggggagtccaggaggtagcaggacgacatctgggcgtgccgggtgccggagttgaagagggtgggggaggagggcaggtagtccaggcggctcatcaggccgtacagcgcggcgacctcgtccgccgcgcgcaccgtgtcgtcctcggcgagtccggcggcgacccgcagcaggaagtgctggggcgtctcgaccgccttgcgggtgatcgggtggcggagcaggtagcggctgtagagcgtacgcaggccgaagtagccgaagcggtcgtcggcgtcctggtcgatcagcgcgtccaggcggtccgcgtgcagccgtacgaaggcggcggtgcggtcggcgatcaggccctcgcggtggccggtggcgacggagtcggtgaaggtgacgacgccctgggaggcggcctcggcgcgaatgccgatggtcagcaggcgggcggccagccgggagtagaccgggtcctcggagatcagaccggcggccgcctcggtggccagctcgcgcagctcggcctcgtcggcgcgggcggaccggccgcgcagtgcggcggcggccacccggccggggtcggcgccggggaggtcggcggtcagcccggtcagggtccgcagcagggcggcaccgggtccgtcgggttccccggtcgccgtcaccggggtcgctgaagccggatcggctggcgcgatggtcacgtggagcactccctcgctcggcacggggcccggcggagggagggcagggggcagctcacgagcgcacgcggcgtcgcgtccaccggcccactccgcgaggcccggacgtcatggcacccgggccagggcggccgggcgcactgtcggcaggtcctcggactggacaggcgtgcgcgcacgtgcgaagacgtacggatgcacgcaagtacaccgttgcgggacagttccggattcgcaccggattcccctgcggcgacagcgagcatgagcatacatcttgtgccgggggacgcgagcacccccagatgttgtgtcccggcgcggtgccgtgacggtgtgccgcggccgtgtcagagcgtcagttcgtaggtgagcagcatgatgtcgtccagctccggcaggggattccagtcgcggtcgggcgtgcggacgaagcccaggcgctcgtagaggcggtgcgcggtgcgcatggcggcctgcgtcgacagcacgacgcccgtgcaccccggcacggcccgggcgcggtcggcgcaggcccgcacgagggcctcgcccgccccgcggccgcgtgcctcccgggcgacggcgagcatgcgtatctcggcctcgccggggcgcgctatgtccgccatggggccgccggacggcacgaaggtcgcgccgccgagcaccgcgtcgtcggccacggcgaccagcacctcggcggccgccgcccgcttggccacgtcgcgcagctcgtccaggtacgagtcgctctccccgaagtcgaggaggccgtcgcgcaggtaggcctgcgcggtgatctcgccgagggtgtcgtactcctcggccgtcgcccgccggatcacgaagtccatgacgccgagtgtgcccgacgggtacgacaacgggccgccggatttctccggcggcccgcctcgaaccagggatcagtgcgagctgcccgccgtggccggcggcagttccacctggacgcccgggtcgccggcgtccgccgtgtagtcgctcggcctggtctcgtcgacgccgtcgggcgccttgaccgccctcaggacgaaggtcaggaccacggtgaccagcacgttcagcacgaaggcggtgaggccgatgtagccgatctcgccgatgccggggatctcgtcggaggagccgccgaagtgcttctgcgtcggcgaggcgacaccgtaggcggcgaccgtgccgtagaccatgccgaccgcccagccgccgagcagcgcccagcggtggaaccagcgggtgaacaggccgccgaccagggccgggaaggtctgcaggatccagatgccgcccagcagctggaagttgatcgcgacggtcttgtccatgcccaggacgaagatcagcgcgcccaccttcaccaggagcgacaccagcttggagaccttggtctcctgctgcggcgtggcgtccggcttgatgaagtccttgtagatgttgcgggtgaagaggttcgcggccgcgatcgacatgatcgccgccgggaccagggcgccgatgccgatcgccgcgaacgccacgcccgcgaaccagtccgggaacatgttctcgaacagctgcgggatcgccagctggccgttgtccaccttgaccccggccgcgatcgccatgaagccgagcagcgcgagcaggcccagcatcagcgagtacagcggcaggatcgtggtgttgcggcggatcacctcacggctgcgcgaggacagcgtggcggtgatcgagtgcgggtacatgaagagcgccagggccgagccgagcgccagggtcgcgtaggtccactggccccccgcgtccggcaccacgccacccttgcccgccgcggtgaacttgtcgctcgccgacgcgaagatgtcgtcgaagccgcccagcttgatcgggatgtagatgatcgccaccgcgatgacgatgtagatcagcgtgtccttcacgaacgcgatcagcgcgggcgcgcgcagtcccgacgagtacgtgtacgccgccagcacaccgaaggcgatcagcagcggcaggtccttgacgaaccagttggtgtcctcgccgccgccgacgcccatcacgtcgaggacggcctggatgccgaccagctggagcgcgatgtacggcatggtcgccaggatgccggtgacggccaccgccagcgacaggcccttggagccgaaccggccgcgcacgaagtccgaggtcgtcacgtacccgtgcttgtgcgagaccgaccacaggcggggcaggaaggtgaagatcagcgggtagaccaggatcgtgtacggcaccgcgaagaagccggacgcgcccgccgcgtagatcgccgccgggacggccacgaaggtgtacgcggtgtacaggtcgccgcccagcaggaaccaggtgacccaggtgccgaacgagcggccgccgaggccccactcgtcgaggctgtgctcgttctcggcccggcgccagcgggcggccaggaagcccatggcggtgacgaggacgaagaagaagatgaagacggcgagtgcgacgccgttcacgccgtcgttcacttggtcccgccttcccggcgcccgcgctggtcgcgctgccacagcttgtacgcggtcaccgtcagcagggtggagatcagcacccaggccatctggtaccagtagaagaacgggatgccgatgaaggccgggtccgtcttggcgtacgaaccgacccacagcatggcgacgaacggtgcgacgagacagaacccgatgacgacgcgcaccggcgtcaccaccggttctctgctcacttctgtgtcttctggcatgcgcggctccgtcccctcgctgatcacctcgtgcagtgcgcacgaaatgtaggtgacggtgtcaagacagcggaagacctcgtccgtatatcggtcctcaaccgcaatctggggccgggtgagcgggctctggtctagtcctggggccgcttgaggcgggccacgaacttgtagcggtcgccccggtacaccgagcggacccactccaccggctggccggtgcggtcctgggagtgccgggagagcatcagcatgggcaggccgacgtcggtgccgagcagaccggcctcgcgcggggtggccagggaggtctcgatggtctcctcggcctcggcgagatggacgtcgtacacctcggcgagcgcggtgtagagggacgtgtacttcaccagggagcggcgcagggcggggaagcgcttcgcgctgaggtgggtggtctcgatggccatcggctcgccgttggccatgcgcagccgctcgatgcgcagcacccggccgccggccgtgatgtccagcagcccggcgagccggtcgtcggcggtgatgtagccgatgtccagcagctgagaggtcggttcgaggccctgggcccgcatgtcctcggtgtacgaggtgagttgcagcgcctgcgacaccttgggcttggcgacgaaggtgcccttgccctggatgcgctccaggcggccctcgaccaccagctcctgcagggcctggcgcaccgtcgtgcgcgaggtgtcgaactcggcggccagggtgcgctccggcgggaccggtgtgcccggcgtctgggtccgggtcatgtcgagcagatgcttcttcagacggtagtacttgggcacgcgcgcggtacggacggtcgccccaccctcgttctccgcactgctgacgtcggtgctcatgctctgccttcccggctccgggtgccgaagcgaccgctatccctgtcggccacggctcacatcgtggcacggcttcgtgccgggatggcccccgcacgctccgtgatcccttctgtatacccgggggaacacccttggtctagtccataggtgggtcggacgccgctggtacgcgcgttcgggggcgtccccgcacgtcattcgatggggggtggtacacccggtcccggtccgcccgaactgtcgcttgcgcaatgaaaggtccctgcatatctcggtcccatcacggaggcgacgactgggtttgaacacccttgacagtcctattggtctgggccaagctccccgtactggtctacaccattggtccaggtcccggccccatgggcggtccgcgtcgacgagcaaccgcggggaggcaggggggttgtgtggcatccctgaggagggttggcgtgaagcgcaagcttatagccgcgatcggtatcgcgggcatgatggtctcgatcgccgcgtgcgggggcgacagcgacgacgacggcaagaaggccggcgccgacggctatgccggtgagacgctcaccgtgtgggtgatggacggctcctcgccggacgactggcaggcggacctcgccaaggacttcgaggcgaagaccaaggccaaggtcaagttcgagatccagaagtggaacggcatccagcagaagctgaccaccgctctctccgaagagaacccgcccgacgtcttcgagatcggcaacacgcagacccccgcctacgccaagaccggcggcctcgcggacctgagcgacctcaagggcgagatcggcaccgactggtccgagtccctcaacaagtccgccgtgttcgacggcaagcagtacgcggccccgtggttcgtggtcaaccgcgtcgtcgtctacaacaagaagatctgggcggacgcgggcatcaaggaactgcccaagacccgcgacgagttctacaacgacctcaagacgatcggcgagaagaccgacgccgagccgatctacctgcccggccagaactggtaccacttcgtgggcctggtcatcggcgagggcggcgaactggtcaagaaggacggcgacaagtacgtctccaacctggccgacccgaaggtcgccgccgccaccgagacctacaagaagttccaggccctgtccaaggcgcccaaggacaaggacgaggccaccccgcagcagggtgagatcttcgccaagggaaagaccggctccttcatcggcatgggctgggagggcgccaccgcgatcgccaccaacccggcgatcgagaaggacctcggctacttcaccatccccggccccacggcggacaagcccgagggcgtcttcctcggcggctccaacctggccgtcgccgcgggcagcaagaagcaggacctcgccaaggagttcctgaagctcgcgctctccgacaagtacgagggcgggctggccaaggccaacggcgtcatcccgaacaaggaggcgctgcagagcaacctgaagggcaacgccgccgccgaggccgccgcgccggccgccggtaccggtgacaccacgccgctgatcccggagtgggccgccgtcgagaacgacccgaacccgatcaagacgtacctgacggccgtcatgaaggggaagtccccggccgacgccgccaagcaggtcgagggcgagttcaacaagcgcctggcgcagcagcagtagcaccgggtgagccggggcgggggctgacacacgacggcccccgccccggcgtcgaggtgaacaggtcgagaagagagagaccccgagcatgaccgtgcagaccgaacggccgccctcaggcccgtcggacgtccgcaaggcggacggtgggggaaccggcgggaccagagcgagagccgcgtcgcgcgccggcgcgctggccccgtatctgctgctgctgcccgccgccgcggccaccgtgctgctgctcggctggccgctggtgaaggacggcctgctgtccttccagaacctcaacatggcgcagctgatccagcacgtcaccgagtggaccggcttcgacaactacaaggaggtcctcaccggcgaggacttctggcgcgtcaccgtccgttccatcatcttcacggccgtcaacgtcgtcctcaccatggtggtgggcggtctgatcggcctgctgctcgcccgcctcggcagggtgatgcggttcgtgctgatgatcggcctggtcctggcgtgggccatgccggtggtcgccgcgaccaccgtctaccagtggctcttcgcccagcgcttcggcgtcgtcaactgggtgctcgacaagctcggctggcactccatggccgacttcagctggaccggcagccagttctcgaccttcttcgtcgtcaccgtgctgatcgtctggatgtccgtcccgttcgtcgcgatcaacctgtacgcggcgaccaccaccatccccgacgagctgtacgaggccgccgccctcgacggggccggcatgtggcgcagcttcacctcggtcaccctgccgttcctgcgcccgttcctctacgcgacgacgttcctcgaagtcatctggatcttcaaggcgttcgtccaggtctacacgttcaacggcggcggaccggaccgtctcaccgagatcctgcccgtctacgcctacatcgagggcgtcggcaaccagcactacggcatgggtgcggcgatcgcggtcctgaccatcctgatcctgctcggcctgaccgcgtactacctcaggatcgtgctcaagcaagaggaggacgagctgtgaagcgctcgctcttcggccgcgtgtggcccaacgtcacggccgtcgtcctgttcatcggcctcgtcttccccgtctactggatgttcgccacggccttcaagccgaccggggacatcatctcggagaacccggtctggttcccgaccgacatcaccttcgagcacttcaagaccgcgaccgaggccgaccacttctggacgtacgtgagcaactcgctcatcgtcaccgtctgcgcggtcgtcttctcgctggtcatcgcgctggccggatccttcgccctggcgcgcatgcggttcaagggccggcgcggcttcatcgtcggcttcatgctcgcccagatggcgccctgggaagtcatggtcatcgcgatctacatgatcgtgcgtgacgcgtcgatgctgaacagcctggtgccgctcacgctcttctacatgatgatgatcctgcccttcaccatcctgacgctgcgcggcttcgtcgccgccgtgccgaaggagctggaggagtcggcgatggtcgacggctgcacccgggcccaggccttccgccgcgtcatcctgccgctgctcgccccgggcctgatgtccacctcgatgttcggcttcatcaccgcctggaacgagctgccactcgtcctggtcgtcaacaaggaggcggagtcccagaccctgccgctgtggctgaccagcttccagaccgtcttcggcgacaactggggcgcgaccatggccgcctcctccctgttcgccatcccgatcctgatcctcttcgtctacctccagcgcaaggccgtcagcggcctgaccgccggcgccgtgaagggatagcaccaccgatgacgaccctcgccagggccaccgacaccctcacgcgcgacgcgctcgccgtcctccagcccggcttcgccggcaccaccgcccccgactggctgctgcgccggatcggcgaagggctggcgtccgtcgccctgttcgggcgcaacgtcacctcgcccgagcaggtggccgccctgaccgcacagctgcgcgccgagcgcgaggacctgctggtcgcgatcgacgaggagggtggcgacgtcacccggctcgaggtgcgcaccggttcctccttccccggcaaccacgccctcggggcggtggacgacgtcgggctcacccgggcggtggccgcggaactgggccgccggctcgccgccgcgggcgtcaacttcaactgggcgccctccgccgacgtgaactccaacccggacaacccggtgatcggggtgcgcgccttcggctccgacaccgacctggtcgcccggcacaccgccgcctacatcaccgggatgcagtcctcgggcgtggccacctccgccaagcacttcccgggccacggcgacacgggcatcgactcccaccacgccatgccgcgcatcgacgtgggcgcggacgtgctggccgaacgcgacctggtccccttccgcgcggccatcgccgccggcagccgcgcggtgatgagcgcccacatcctggtcccggccctggacccggagctcccggcaacgttgtcccggcgcatcctgaccgacctgctccgcggcgagctgggttacgacgggctcatcgtcaccgacggcatcgagatgaaggccatcgccggcacctacggcatcgaacgcggcaccgtcatggccatcgccgccggtgccgacgcgatctgcgtgggcggcggcctgcacgacgagggcaccgtacggcggctgggcgacgcgctggtcgaggccgtccgcgcgggcgaactgcccgaggagcgcctggccgacgcggccgaacgcgttcggtccctgtcccgctgggcggcggagaaccgtcccgccgacggggcttcggacaccgcggacggcgacgtcggcctgcgtgcggcccgccgtgcgctgcgcgtcaccgtcgcgggggagcccgcgccgctcaccgaggcaccgtacgtcgccgcgttcaccccggtggcgaacatcgcggtcggcgacgagaccccgtggggcgtggcggccgagctgggccgtctgctcccgggcacggagaccggcagcttccacggggccgacgcgggccgcgaggcgctggccgcggcgggctcccggcgcatcgtcgccgtcgtccgcgacgagcaccgccacccctggatggcggcggccctcgacgtcctgctcgcggcccgccccgacacggtcgtcgtcgagatgggcgtcccgcgtgcggagccccgcggcgccgtccacctcgccacccacggcgcggcccgcgtctgcggccgagcggcggcggaggccatcgcgggcgtctgacgatcacccgtcgctgaaggcgccggtcccttggcgggccggcgccttcagcatgcggggccgcgcggggctccggccaagggcgggcgtgcgggcccggagggtgggcgcggcgggccgtcgccaggcgggtgcggggcgagtgccggcgccgacgggagtacgggcacgggggttggtgccccccgggcggtgaggctgggacgcgggcgccgtgccggtggtggtgcgggtacgacgaaggcgccggggccctgtgacgggatccggcgccttccgcgcgcgtgggcgtccgccccgcggaccgggggcgggacagctcagatgccctgccagtccggcttgtgggcgtaggtgtgccggaagtagtcggcgagcttgagcttggacgcggcggcctcgtcgacgacgaccgtggcgtgcgggtgcagttgcagggcggaggccgggcacacggccgcgaccggaccctcgacgctcgcggcgaccgcgtcggccttgccctcaccggtggcgagcagcaccacgtgccgcgcctccaggatggtgccgatgccctgggtgatcacgtggtgcggcacctgctcgatgtcaccgtcgaagaagcgcgcgttgtcgatccgggtctgctcggtcagggtcttgatccgcgtccgcgaggcgagcgaggagcacggctcgttgaagccgatgtgcccgtccgtgccgatgcccagcagctggaggtcgaccccgccgctcccgcccagcgccgtgtcgtaggcctcgcacgcggcctgcacgtccgcggccgtgccgtcggggcccatgaacgcgtccatgtcgatgcccagcggttcgagcacctcgcgccgcagcaccgagcggtacgactcggggtgctcggcgggcagccccacgtattcgtcgagctgggcgatccgtgcctgcgcggtgtccacggcacccgagcgcaccttggccgccagcgcctcgtacacgggcagcggcgtcgagccggtggccaccccgagcagggcgtcgggcttgcgccggagcagctgtgccatggcttcggctatgagttcgccgcccgccttggcatcgggaacgatgacaacttccacgctggcctgccgtttcgaagagaggactcacccggggcccgggactggctatgtggtttagaccaatctaacagagcggagccgcacggtcgcgctgaaacggtcgggcgagtggtggtgtgccggcggcggtgtcaggtcagtgaacctcccgtggcgtccacccagctgcccgtgacccaccggcctccgtgcgaggcgaggaacgcgaccacgtcggccacctcggccgccgtccccaccccgcccagagcggagaacgccgcggcccgctcccagccgccctcgctcccgtgcagcatcccggccgtgttgtccgtgtcgatgatgccgggcgccaccgagttcaccgtgatgccccgggtgccgagcaccttggagaggtcgcgggagaacacgtccagcgcgcccttcgtcatcgcgtacgccatgttgtccggcatcaccgccgtgcgggccaggcccgacgagatgttgacgacccggccgccgtcgcgcagccgccccatcccgtgcttgaggatgaagaacggtgctttcacgttgaccgtgaagaccgcgtcgtactccgcctcccctatctccccgatggggcgggtgttgccgatccccgcgttgttcaccagcacgtccagcccgtcggcgtgtctgtcgaactgctcccacaaggcctcggcggcacccggagcgcccaggtcggccctgatcgtgaacgccgagccgcccccggcctcgatcgcggcgaccgtctccttcgccgccgcctcgttcctcccgtagtgcaccgcgacccgagcgccgtcgcggcccagccgctccgcgatgccccgcccgatgcccctgctcgctcccgtgacgagtgccgtcctgcccgcaagcacgcccattccgacgccccctgatttcgctagtggtcgctacagaaatgaccgtacaacggtccggcgacttttttctagtggtcgctataaaatgcactccatggtgagcggtgagaagagtgaacggtccggggcgcctgctcggagcggcgcggccaggagccgcggccgcccgcgctccttcgaccgggcgacggcgctggaggcggcgctgctggccttctgggagcacgggtacgaggccacgtccgtctccgacctgacgcgggtcatggacatcggggccccgagcctctacgccgccttcggcgacaagcggtcgctcttcgaggaggtcgtccaggagtacggggtgcggtacggctcgttcggcgagcgcgccctcgccgaggagccgaccgcgcgtgcgggcatagagaggatgctgcgcgaggccgccgccgagtacacggcccccggccggccgcacggctgcctcgtcatccacgcggccgccaactgctcgaccaccgaggtggaggagtccctgcgggagcggcgcaacgcgaacatcgccgccatcgagagccggatcggcgccgacgtggacggaggcgtgctgccgccgggcacggacgccgccgcgctcgcccggtacaccggcgcgatgatccagggcatgtcccagcaggcgcgcgacggggcgagccgggcggagctggaggcgctcgcggaaattgccctggcggtctggccccgaggttgagccaacggggttaggcttctggcggctgcccggacggcggtgcggtcggcacaagtaccaacaacaaacaacgtccaccgcatggacacggttagtggtctagtccacaatggttgctgaggaactgaccgtgttcatcacgcaaggtgatcgtcaggcttccgccctccccgcacaggaggacggaccgaggaaccggtgctctctgccctgactgctccggctcctcatccttcggccgaccgggaccgcacaccccacggccgatgttgctccgggctgcggtgccgagagggctgagggtccctctcaggcgccgcggcccgcgggtgcttccgggggtctcgccggccgcttcgcaggcggagggcgctgtggagcgtggctggtttcgagcgctgtccgtaccgccaggtacgctcggccccgtgccctccatgaacgaactcgtacgccagcacaccgcgctcgacgactccgacctcgagtggctccatctgctggtctcggagtggcagctcctctccgacctctccttcgccgacctggtcctgtgggtccccacccgcgacggcacgcgctacgtctccgtcgcccagatgcggcccaacaccggacccacctcgtaccaggacgacatggtcggccacctcgtcccgcgcggccggcgccccatgctggacgccgccctggacgagggccgcatcgtgcgcgagggcgaccccgagtggcgcgaggaggtcccggtccgcgtcgagtccatccccgtacgccgccagggccgcgtcctcggggtcatcgcccgcaacaccaacctgctcacggtgcgtacgccgagccggctggagctcacctacctgcagagcgcctccgacctcgcccagatgatcgcggccggcgccttcccgttcgagaaccagcaggtcgacatggacgcctcgccccgcgtcggcgacggcctgatccgggtggacggcgacggcatcgtccagtacgcctccccgaacgcgctgtcggcctaccaccgcatgggcctggccgccgacctggtgggccatcacctcggccgcaccaccgcggaactcgccccctcccgcggaccggtggacgaggcgctcgccaaggtggccagcggctgggcaccgcgcgagttcgagatcgaggcgcacgacggggtgatccagttccgcgccatcccgctcaaacccaagggcacccgcatcggttcgctggtcctcctgcgcgacgtgacggaactgcgccgtcgtgagcgcgaattgatcaccaaggacgccaccatccgggagatccaccaccgggtgaagaacaacctccagacggtggcggccctgctgcgcctgcaggcccggcgcatcgagtccgaccggggccgcgaggcgctggaggaggccgtgcgccgggtcggctcgatcgcgatcgtgcacgagacgctctcccagaacctggacgagcgcgtggagttcgacgagatcgccgaccgcgtgctggcgatggtggcggagatctcgccgggcaaggtcaccggccggcgcaccggacgcttcggcatcctcgacgccgaggtcgccaccccgctgtccatggtgctgaccgaggtgctgcagaacgccctggagcacggcttccgggacggcgacaccggcacggtcgaggtctcggcggtccgcggcggcacgaccaaggaggcccggctgctggtcaccgtccaggacgacggggtcggcctgcccgaggacttcgacccgcaccgctccggcaacctcggcctgcagatcgtccgcaccctggtcgagggcgagctgggcggcgccttcgacatggtccaggcggcggagcgcgggtgccgcgtgatcctcgacatcccggtgcccgccgagaagtagcgcgagaagcagaacgagggacgagaagcggcgcgagggaacgacaagcagcgcgacaagcggaaccgggacagcggcaccggaagcgggcaagcaaaaagccccggaccggtgaaggtccgaggccagtgctcgtgcgatacatcgtccgatgcgcatcgggggtactgcgcgctgcggctcgggagcgggggatgcgtactcgctgtacgcgccgccaagctgaggctgtcagtaggggtgggttgtcaggcggaggcctgacgagcccggttgcgggcggcacggcgcttcattgcgcggcgctcgtcctcgctgagaccaccccagacgccggagtcctggccggactcgagcgcccactgcaggcactgctccatgacggggcagcgacggcagacggccttggcttcctcgatctgcagcagcgcgggaccggtgttgccgatggggaagaagagctcggggtcttcctcgcggcaaacggcgcggtgacgccagtccatggctgctacctctccttggtattacatgctgggatgcttgtgaatgtgaacgctttcacgaatccctcaacaagggaagggcctaccgccaggttcgctggcgtggtcctgtggtttgaagaggggttccggtgatctgtggatgccggtcctgcgggctgtcccgatcgccaagaagagactcgcaaacctcggcgacggatacaaccccttccggaaagttttttttgattcttcggtgtcgactaggtcacagccgtacttccatggggtggatcctggtctaaacgttcgagtgaaaggactttcgccccttctgctcacacaatcacacgcagtgcacggcgtacgcctgtgaacgtcacgctggtccgcaaccccaggtggtcaccgtccatctgaaggggcaggggcaccttcgaatgcaaggtgaactccgtcagatcgtgcagggagaccgcgtggcggccccgcggcccgcgctcgggggacgaagtgagcaactgggtgccataccgggcaaccgcggccgtcgacagccggctcaggccgaacacgtcgagggcggtgtcgaacgacgcctcgggagaggcgtagatcgggcggttcccgaggaacgtccaggggcaggtgttcgaaactatggacaggaccagatcggtgaccgggtcctcgcccgcccgctccagagtgatcgtcccgctgcggcggtgcggctcgccgatgagctgacgcaccacctggcggacgtagagggcgtgcgtggacttcctgccgcgctcgcggtgctgctcgacacggccgaccaccccggcgtcgaaccccagaccggcgttgaaggtgaaccagcgggccggaaccgcttcgtcctccgaaccgggcgtacccgacgccagcccgaggccgacggtccgctcgctgccctcgcgcagggcgtccagcagggctccggtggcctccaccgcgtggttgggcaggccgagggcgcgggcgaagacgttggtgctaccgcccgggaccaccgcgagaccgggcaggtggtccgggtcggggcccgcgtgcagcaggccgttgacgacctcgttcaccgtgccgtcgccgccgagggccaccaccaggtcgatgtcgtcgccctgtgccgcctgccggccgaggtcgcgcgcgtggccgcggtactcggtggtgaccgcttccagcttcatctcgctcgcgagcgcgtggatcagcacgtcgcgcgtgcgcgcactcgtggtggttgccgccggattgaccacgagaagtgcacgcatggtgtgcagggtacctactgggtggtactcggcccagaccgaggtgaagatggtcaccggcggacggcacgcgtgatacgggggacaccgcggcggacacgggggcgccgagggctaccctttcggggtgagcagtgagcagacccccacccccgcctccgcaaccgccgaagagacgacccctcgccccggccggctgaccgccgcggccgcgatcgccgcactggaggggctggcgctcgtcgtcggcggcggctggatgctcgtggagggcctcaccggacaccccgacgaccggacctcggccgtcaccggcggagtcaccctgatcgtcctcgccctgctgccgctgctcgcagcccgcggactgatcgcccggcggggctggagccgggggcccgccgtgatcacgcagatcatggcgctgccggtcgcctacaacatggtgcgggccgacagcctggccgtaccggcgggcatcgtgctcggtgtcgtggccgtcaccgcgctggtgctgctcgtcaatccgacgaccacccaggccctcggtatccgggggcccggcaacgccgggaagcagccgtaaggcacccgccgaccggcggttactcctcgacgagcagcttctcccgcagctgtgccagcgtgcgggccagcagccgggacacgtgcatctgggagatgccgacctcctgcgcgatctgggactgggtcatgttgccgaagaagcgcagcagcaggatgcgcttctcccgcggtggcaggtcctcgaggagcggcttgagcgactcccggtactcgacgccctccagggcctcgtcctcggcaccgagggtgtcggcgaccgccggtgactcgtcgtcggtgtccgggacgtccagggacagcgtggagtacgcgttggccgactccaggccctccaggacctcctcctccgagatcgacagcttctcggccagctcgtggaccgtgggggagcggccgtgcagctgggacagctccgccgtggccgtcgtcagggccagccgcagctcctggagccggcgcgggacccgcaccgcccagcccttgtcccggaagtgccgcttgatctcaccgacgaccgtgggcgtcgcgtacgtggagaactccacgccgcggtccgggtcgaaccggtccaccgacttgatcaggccgatggtggcgacctgggtcaggtcgtccaggggctcgccgcggttgcggaagcggcgcgcgaggtgctcgaccagcggcaggtgcatgcggaccagccgattgcgcagctccgcgtactccgggctgtccttctccagcgtgcgcaactcggcgaacaggagacgcgccccgctgcggtcctgcgggtcgtgccgtgtgccctgcgtgccccgtgcacccggcgcgtggccgtcggcgtgtcgctcgtgctcgctcatcgtcccgcccgtcgccctttcccgagccctcgcctccgctcggacgggccggacgggggtctccccggtccgctgcccctcgcccggaacggcggccccgggcgaggtctcgtcctccggatgcggccgggcctgctcggggatgccgtcgatgccgtccgccgtgcgtcgcgcctcgttcggagaacgtgtgccctcggccggcagctcccgtgtaccgcgctcttcgtcccgcaccggcccgtccccgtccctcacgtcggcccgggtcccgcgccgcgctgtttgtagaggctgatcgaaacggttttgtcctcgtccacggcggaggagaccttgcccgcgagggcggagagcaccgtccaggcgaaggtgtcccgggacggcgcgtggccgtccgtggtcggcgccgagacggtgacctcgagcgagtcgtcgacgaggcggaagacacaactgagcaccgagccgggcacggcctgctgcagcaggatcgcgcaggcctcgtcgactgcgatgcgcaggtcctcgatctcgtcgagggtgaagtccaaacgagctgcgaggccggccgtcgccgtacgcagcaccgacaggtaggcacccgcggccggcagccggacttcgacgaagtcctgggtcgcgggctcgcctgcgatctgggacaccctcacctccaaggtggtacaagcgttacagggccgagggacgcccctcgggataacgcgacacgtggttcagcggtgacgttatcgcgctccgaagtttcctgtccccgagaccccaaccccgtgctgtcactcatagtaaacacgcgaacacgcacagtggctagggggtcggcgggcccaaatcggaagagcgcgcgccgggttgacgtacccagacgtcagacggtcgaaccgtcccgggcacaggtcacaccaggacgtgatcgacgaagcaccagcgccagctctccccgggttcgaaggtcctcatcagcgggtggccgctctccttgtaatgcgccgtcgcgtgccggttcggcgaggagtcgcagcagccgacatgaccgcagacgagacacaacctcagctgcaccgggtccgtgccctcggccagacactcgggacaggtctcgccgcacggctcgggttccgggtgcggcagcgcgtcggcgtgcgtgcactgtttcatgattgccaggttacgacgggcgtgcggacgaccgcgcggaaaacgagggcgggcgaggacgatggacgtgatgccgctgctgttgctggtggcgggcagcgccgcggtcgccgcggcgggacggcgcgtaccggtgccggtgccgctgctcctggtcgcggccggcctggcggtgagctatgtgcccggtgtgcccgactacaccctcgacccgcacatcgtcctgcccctgctgctgcccccgctgctctacacggcggccaccgacagctcctacctggacctgcgggcgcaggcccggcccgtggcgctgctgtccgtgggctacgtcctgttcgccaccttcgtcgtcggctgcgcggcgtacctcatcgtgccgggcctgccgctgaccgcggccctggtcctcggcgcggtcgtggcgcccccggacgccgtcgcggccacggcggtcgcccgccgcgtggggctgccctcccggatcaccacgatcctccagggcgagtccctggtgaacgacgccaccgcgatcaccgccttcaaggtggcgctcgccgcggccgtcggcgagggggcgacctgggccggcgggatcggcgagttcctcatcgcggcggtgggcggcgtcggcgtcgggctggtgctgatggtgccgctgcactggctgcgcacccacctgacggaggcgctgctgcagaacacgctctccctgctgatcccgttcgtcgcctacgcggtcgccgagcaggtgcaggcctccggggtgctcgcggtggtcgtcgtcgcgctctacctcggccaccgcgcgtgggaggtcgacttcgccacccggctccaggaggaggcggtgtggaagatggtcgcgttcgtcctggagtcggcggtgttcgccctcatcggactccagctgcccgtcgtcctcaaaggcctgggggagtacgagggtgccgacgccgcctggtacgccctcgccgtcttcctggtggtcgccgtggcgaggttcgtgtgggtgtacccggcgacctacctgccccggctgtcggcacgggtacgcgcgcgcgagggcgagctctcctggaaggggccgttcgtgatcggctgggccgggatgcggggcgtggtctccctggccatcgccttctccatcccgctcaccgtgcacgggggcgagccctttcccgagcgcaacctcatcctgttcctgaccttcaccacggtcatcggcacgctggtcgtccaaggcgtcagcctgccgccgctgatccgcctgctgaagttcccggcgcacgacgtgcaagcggagacgctggcggaggccaacgcacaggcgcaggcctcacgggtcgcggaactgcgcctggacgacctgctcgccgacgagcgcaacgctcttccggcgccgctcgccgaccgcctccgcatggtcctggagcgccgccgcaacgccgtctgggaacggctcggccaggtcaatcccgtcaccggcgagaccgtcgacgacacctaccggcgactctcccgggagatgatcagcgccgagcgcgaggtcttcgtcaggctccgggacggccgctacatcgacgacgagatgctccggaccctgctgcgccggctggacctggaggaggccgccgcgtaccgggaggcgacgtgagcgggcgcaggggcacgcgggcgcgtcggggcggcggtcccgacccgctcaggggaagggccggccggtgacgaccgccgccagggtcgtcccgcgcgggaaggcaccctcctcggtgagggtgagcagggcgtacagcatcttggcgacgtagacgcgctccacggggaggccgtggcggtgctcgaaatccgcggcgaaggcgtccagcccgggcgtcgtgcgggcatagccgccgtggtggaagcggtcctcaaggctccagtcgccgcgcggcccgccgaacgcgcgctcctggagccgccgtatgtcaccctccaggaagccgcccttgagcacgggtatgccgagagcccgccgcccccgggggagcccggcggcgaggccggcgagcgtgccaccggtgccgcaggcgacggcggccacgtcggcgtgggtgcccagctcctcgcccagggcacggcagccgcggacggcgtccgcgttgcttccgccctcggggacgacgacggcgccctcggcgcccgccgcgcgcagcagggccgccagggtctcgggttcggacttgcgccggtacgtggagcggtcgacgaagtgcagccgcatcccgtcggcggcgcaccgggccagtgaggggttgagcggcaggccggccagctcctgaccgcggaccacgcccaccgtgggcagtccgagcagccggccggccgcggcggcggcccgcaggtggttggagtaggcgccgccgaacgtgacgacggtgcgcccgtcggccgtggcgagattcggtgccagcttgcgccacttgttgccgaccagctcgggatggatcagatcgtcccgcttgagcagcagccggacaccgtggcgctcgaaccgtccgtcggccacctcgtgcagcggagagggcagacggggccgcagggcggcgagctgacgcgtgtcggtgccggtcaccccgccattgtcacgccaccgggcgtcccggccacctcacgccggcgcgctccgggcacctcggccggttccggagcacctcggccggttccggccaccccggtcggtccgggtcacttcaggcggtcccggatgcggtttcgcatggatgtcatcgtgaatccgcgcggatccaccttgcccggctgccactccaggtggccgatgacggacctctcgttccagccgtggtggcggcacacggccgcggcggcccgctcgatcgcctccagctgtgccgccggccaggggtcgtcgccgtcgcccaggttctcgcactcgaagccgtagaagtgccggttgccgtcggtgttcgcctcgttgtcccggggcagcgccttctccgcgatcactgcgcgcagtacgtcgtcgtcgccgagaccggcgtggttggccctgccgtacccgaccaggtggaccttgccgtccttggtgacgaccccgtggcacagggggcccggcagaccttcgtatcccttgcggcagatgtccaccgtccgcgcgctgcccttggtgaccgtgtggtggatcatcacaccgtgcacgggaccccacgggcccttgtggttgcggttgtggtcccgccagtcgccgacctggacgacggtgaggccctccgccttcagtgccttgaggaaactgctcgcggacatgggtgaggccacggccgggctccttcacgctgcgcgacgaccgcccgacgcgaccgcctcgtacggagcttgtaccgaaacggagcaactcctattacttgttcggcccgtgtgcgagtcgtttcggacaatctcatcccggccagggggtgccgaagtcgaaacaagcccccatatctgccccggccgcgtgtgatccattcccgctcgttcgtgtaatagcaccggcacgctccgtgaggaaggctggtccacgcacatcgatgccgggcgcagccgtccggcatgaccgggagggcaattccttatgtcggtaggcgaagaggtccgcaccgagcagaccaggccgcagcagagcctcggcacggcggccgcgcggaacctggccaccaccaccaagtccgttcctcagatgcaggagatcagctctcgctggctgctgcgctcgctcccctgggtggacatccagggcggcacgtaccgggtcaaccggcgtctgaccttcgccgtcggcgacggccgcgtgacgttcgtgaagaccggcgaccgcgtcgaggtcgtccccgcggagctgggcgagctgccggcccttcggtcgtacgaggacgacgaggtcctgtcggaactcgcgcagcgctgcgagcagcgggagttcggccccggcgaggtgatcgcctcgttcggcgcgcgggccgacgaggtctacctgctggcgcacggcaaggtcgagaagatcggcaccggcccctacggcgacgacgcggtgctcggcgtcctcgccgacggcgcctacttcggcgaccaggcgctcctcgacggtgacgccatctgggagtacaccgcccgcacggtcaccgcctgcacggtgctcgtgctgccccgccaggaggtggaccaggtcgcggagcgggccgactccctgcgcgagcacctggagcagcggcgctcgatcccggagcagcgcaccaacaggcacggtgagaaggagatcgacctcgcggccggtcacagcggcgagccggacatcccgcacacgttcgtcgactacgaggcccggccgcgcgagtacgaactgagcgtcgcccagaccgtgctgcgcatccactcgcgcgtggccgacctgtacaaccagccgatgaaccagaccgagcagcagatccgcctgacggtcgaggcgctgaaggagcgccaggagcacgaactcatcaacaaccgggagttcgggctgctgcacaactgcgagtacgaccagcgcatccagccgcacgacggagtgcccggtcccgacgacctcgacgaactgctgagccgccggcgcggcaccaagctgctcctcgcccacccgcgcgccatcgccgccatcggccgcgagctcaacaagcgcggcctcgtccccgagaccatcgacgtcgccgggaaccgcatcccgacctggcgcggtgtgcccatctacccgtgcaacaagatcccggtcaccgaggcccgtacgtcctcgatcatcgcgatgcgtaccggcgagcaggaccagggcgtcatcggcctgcgggccaccggcatcccggacgagatcgagccgagtctgtcggtgcgcttcatggggatcaacgagcaggcggtcatcaagtacctggtcacggcctactactcggccgcggtcctcgtgccggacgcgctcggtgtgctggagaacgtcgagatcggccgctggcggtgacgtcactgtcccgaacgccgtgttcccgccctcccgggcgggtacacccccggggtacggacgggcccagggggaaggtgagtccatgacggagacccggcgcggcgccaccgcgacgtgccgtcccaccggggcgccggaaaggcacgggcccatcggcacacagcgcgagaaggagccgggggagccgtccgacgggcagggggaggcggtggtcgaagggcacgaggcggccctgctcctgagcgagtcacgagcgtcggtcgatcccgaactgcggtccgccatcgcgacgctgccggagtcgatgcgccgggtcgcgctctaccacttcggctggcagcacgcggacggcacgcccgcggcgggcaacgcgggcaaggcgatccgccccgcgctcgtcctcaccgcggcggccgcgctcggcggcccgggggcccgcgcggcggccgtccgtgccgcggcggcggtggagctggtccacaacttcaccctgctgcacgacgacgtgatggaccgcgacgccacccggcggcaccggccgaccgcgtggaccgtgttcggcgacgccgacgcgatcctggccggggacgcacttcaggcgctcgccctgcggctgttcgccgccgacccgcatccggcgtccgcggcggcggccacccggctcgccgactgcgtcatggagctgtgcgagggccagcacgcggacacggcgatggagcggcgcccgccggacgaggtgaccctcgacgagacgctcgtcatggccgaggccaagacgggtgccctgctgggctgcgcctgtgccgtcggcgcgctgtacgcgggcgccgccacggaggacgtcgaggccctggacgccttcggccgtgaggcggggatggccttccagctcatcgacgacgtcatcggcatatggggcgacccgcgccacaccggcaagccggccggtgcggacctggccgcccgcaagaagtcactgccggtggtcgccgccctcacctccggcaccccggccgccgccgaactggccgagctgtacacaggcccgtacgacgagaacaaggaggacctggagcgcaccgccctggccgtggagcgggccggcggccgggactgggcacaggcccaggcggccgaccggatggcgagggccatgcaggagctggcgcgtgccgtgcccgagccggaggcggcgggcggcctgctcgccctggccgagttcgtgacgcggcgcagcacctgagcgcagcacctgagcgccgccccggccccctcgcccgcccggcgtcgtggatcgccgggccggccacgcaagaccccggagcccgtgcagggccgtacggcacctgaccgacgtacggccgcaccgccgacggctccggtccggcgggtcccgcacttccccacggtgtgcggggcccgcctccttgcccttgcccgcctgccctcgcccccttgtccccgcgcccgcggacggcagcggcgcacgcaccggccgcgactcagcggctaggctcaaccgccgtacggatgtgcgatgttgagccgccggtgacgaggctgaggggcgaggtatgggtgtggtgatccgcacggcgggggaggacgaccgggaactggtcgtccggctgctggacgaggccttccaggacgatccggtgagcagttgggtcttccccggcacggagtaccgtcgccggacgcaccatcggctcatggccgcgttcgccgacgccgtcctcgcggacggccgcgtcgacctcaccgaggacggcgccgcctgcgcgctgtggctgcccgtcccggcgggcgagcccgcgggcgacggaccgggcgcagagcaggggtccgagtccggggagggcgccgaggacggccccgcccggattcgtgcggccgtcgacccggagaacgagcgcgtggagctgatagcccggctcacggacgggatccacccctccggccgggcgcacgcgtacctgtggatgatcggcgtggtcccggagcgtcagggcgagggcctgggcaccgcgctgatcgggaccgtcctcgaccgctgcgaccgcgagggcctgcccgcctatctggaggcgagcagcgcccgcgggaaggcgctctacgaacgtctcggcttcgagttcaccggccgggccctggatctgccggacggcccccgcatgtggccgatgtggcgcgagccgcggactccgtgatctcgtaatccgctccccaaagaactacacgcggagtactgtgaacgtagtggtcaacatgagagggagaccggtttgcgcaaactcacgtacttcgtcgcctgctcgatcgacggcttcatcggcggcccggacggcgacgcgtcgttcatggtcccgttcgtcgacgaggagttcttcgagttcctgaagtcggagtatccggagacactgccgacccacggccgtcgtccgctgggcatcgacgacctgccgaacaagcggttcgacacgatcgtgcaggggcgcgccagctacgacctggctctcaaggagggcgtcaccagcccctatgcccacctgcgcgaatacgtcgcctcgcgcacgctcacggagtcgcccgacccgaacgtcgagatcatctcgacggatctggtcggcagggtccgggagctgaaggccgaggacagcgccttcggcatctatctgtgcggcggatcggccgtggccggcgaactggtcgacgaggtcgacgaactggtcgtcaagacctaccccgtggtgctcggcaccggcatgccgatgttcggctccggcttcgaggtctccgcattcgtgccggattcggtgcggaccttcggcaacggcgtcgtggtgcgtacgtaccaccgcaagcgctgagccgcctgccgctctaacctgggggtatggacagcgacacgtacgcctgtcccgtgtgcggacagccagtcgaagcggtcgtccggcgccacaagacgctgggcatatgggtaccggaatgggccccgggcccgtgcggcaacccgaagtgcgaggcgggtcccgggaagaacgccggggccgccgaagccgaggcgcggcccgggaggccggagcactcccgggaaacggtcaccgagaacccctgaccacgacaacgccgaaggggcccggccaggatggcgccgggccccttcgggctgccctgcggcctgcgatggtgcaccgatcgccggccccgggatgctgacgtccgtcaggccttcttggtctcccagaagatcttgtcgatctgggcgatgtagtccagggccttctggccggtcgccgggtccttcgagcccttggcggccgacagggccttcagggtgtcgttgaccagctggtgcagctccgggtacttctcgaagtgcgggggcttgaagtagtcgctccacagcacggagacgtggtgcttcgcgagctcggcgcgctgctccttgatgaccgtggcgcgcgtctggaagtgcgggtcgtcgttgccggccatcttctcctggacggccttcaccgactccgcctcgatgcgggcctgggcagggtcgtacacgccgcagggcaggtcgcagtgggcgctgaccgtgaccttgggggcaaacaggcgggaaagcatgaagcgttccttcctcgtgatcgtcttctcaggggggacattactccctgggagacctgatttcgcgggtgcccccgtgggcttaggacaaaagtccggggtgagactgagactggtggaggaaagaccggggaggtgccgggtgatgccggagcaactgtcgcaggagaccgagcgcgccagaggggcgttgcccttcgggccggccgaggtgaccgggccgtcgatggtgcccacgctgcaccacggtgacgtgctgctcgtgcactggggggcccgggtccggccgggtgacgtggtcgtgctgcggcaccccttccagcaggacctgctcgtggtcaagcgggcggccgaacggcgtggggccggctggtgggtgctcggggacaacgcgttcgcgggcggggacagtaccgactacggggtggtcccgcaggacctcgtcctcggccgggtccggttccggtaccggccgccgcgggcgggtcagcgttcgccgctcgccgtggtccgctgggcgctgtcggcggtcaggccggtgccggccgaccggtccgcctccaggcgcttgcgagcgcggtaggccgccacgttggcgcgggtggcgcagcggtcggagcagtagcgccgggagcggttggtggaggtgtccaggtaggcgttgcggcagggggccgcctcgcacaggcccagccggtcgaccccgtactcggtgaggtggaaggccaggcccatcgccgcgatggccgcgaatccggccgtcgcgttggaggggtggtccgccaggtgcatgtgccacagcgggctgccgtcctccgcgcggtggtcgtggccggagatctgcgggctcaccgggaactccaggagcagtgagttcagcaggtccacggcgagggtctcgtcgccgccgtcggccgcctcgaagaccgcgcgcagccgcccccggaccgagcggaaccgcgtcacgtcggcgtcggacgcgcgccgggccgccgactggttggcgccgaagagctcacggacggcctccaccgaggtcagggagtcctgcccccgcgacggttcctcggtgttgacgagacgtacggcgtaatccgagtaataggccagttccacttgtagtccttacgacggggctctagggtcgtgcctgcggtcgggtaacagctgatcgtgcatccagggtattacgcgacgcagtgcggaggggctcgatgacgaacgcggacacgaccacggccactacggccggcaccacggccacgaccaccgccacggccggtgccgactggcaggcctggcagcggagctgggaccggcagcaggagtggtacatgccggaccgggaggaacggttccggatcatgctcgacatggtcgaggcgctcgtcggtcccgcgccgcgcgtgctggacctggcctgcggcaccggcaccatcacggcccggctgctggaccggttcccggacgccacgagcaccggcgtggacctcgaccccgccctcctcgccatcgccgagggcaccttcgcgggcgacgaccgggtctcgttcgtcgccgccgacctcaaggaccccgactggccggcgaagctgccgtacgacgcgtacgacgccgtgctgaccgccacggccctgcactggttccacgccgaacccctcgcggatctctacggccgggtcgcggagctggtccgcgacggcggtgtcttcatgaacgcggaccacatgatcgacgaagcgacgccccggatcaacgcggccgagcgcgcgcagcggcacgcgcggatggacgcggccaaggggcagggcgccctggactgggccgagtggtggcagctcgccgccgaggacccggtgctggccggacccaccgcccgccgcttcgagatctacggcgagcacgccgacggcgagatgccctcggcggcgtggcacgcgcgcgtgctgcgcgagaagggcttcggcgaggcgcggccggtgtggtgctcgccgtcggacaccctgctcctggcggtcaagtaggaccacgcgccgaggaccacgcgccgaggggcggtacggagatccgtaccgcccctcggcgcgcgatcgtgcggtcggtcagaggaccttggacaggaacgccttcgtccggtcgtgttgcgggtcggtcagcacgtcgcgcgggttgcccgactcgaccaccacgccgttgtccatgaagaccaggctgtcgccgacctcgcgggcgaagcccatctcgtgggtgacgacgaccatcgtcatgccggactccgcgaggtcgcgcatgacgtcgaggacgtcgccgaccagctcggggtcgagcgcggaggtcggctcgtcgaacagcatcagcttcgggtccatcgccagggcccgcgcgatggcgacccgctgctgctggccgccggagagctgcgaggggtagttgcccgccttgtcggccaggcccacgcgctccaggaggccccgcgcacgctccctggcctgggcccggctcatgcccttgacctggaccggcgcctccatgacgttctccacggctgtcatgtgcgggaacaggttgaagcgctggaagaccatgccgatgtcccggcgcttgagggcgacctcgctgtccttcagctcgtagagcttgtcacccttctggcggtagccgaccagctcgccgtcgacgtacagacgtccggcgttgatcttctcgaggtggttgatacacctgaggaaggtggacttgccggagccggaggggccgatgaggcagaacacctcgccctgcttcacctccaggtcgatgcccttgaggacctcgacggcaccgaaggacttgtggacgccctcggccttgaccatggcggtcatgccgcacctcccgtcgtgctggagcggttcgacagggagaacaggttggccctgatcttctgcatcggggtgggcggcagactgcggctggagccgcgggcgtagtagcgctccaggtagtactggccgacgctgaagacggaggtcagcagcaggtaccaggccgccgcgaggaacagcatctcggccggtgcgccagaggtctggccgatgtcctgggcgactctgaacaactcggcgtactggacgaccgacaccagcgaggtcgtcttcagcatgttgatgacctcgttgcccgtcggcggcacgatcacgcgcatcgcctgcgggaccacgatccggcgcagcgtcttggtgtggctcatgccgagcgcgtgcgccgcctcggtctggccctcgtcgaccgcgagcaggccggcgcggcagatctccgccatgtacgccgcctcgttgaggccgaggccgagcagcgccgtcaggaacggcgtcatgaagtccgaccactcgtcgcggtagaacgggccgaggttgatgtactcgaagaccaggccgaggttgaaccagaccaccagctgcaccaggaccggggtgccgcggaagaaccagatgtagaaccacgcgatggacgaggtcaccgggttcttcgacagccgcatcacggcgagcaggatgccgccgacgacaccgatcagcatcgcgaggacggtgatcaggagcgtcttgcccatgccggtcaggacacggtcgtcgaagaagtagtccgggatcgcgccccagttgatcttgccctgggagaaggcgtagacgaccgcggccagcagcgcgatcgcgacgaccgcggagacgtaccgcccgtagtgcctcaccgggatggccttgatggcctcgggcggggtcggcggggtgccggccgggccgcccgccgtcttgtcgatgtcaacagtcacggatgttgcctttcagcgcccgccgcgcggtcacttgccgccgttgacggtggcctcggtgatggcgccttccgacacgccccacttgtccatgatcttcttgtactcgccgttcgcgatcaccgcgtccagcgccgccttcagggcgtcgcgcagctgcgtgttgtccttggcgaccgctatgccgtacggcgcggcctcgacctgctcgccgacgagctcgaagtccttgccgccgccggaggtcttcacggcgtacgccgcgaccgggaagtcggaggaaccggcgtccgcgccgcccgcgcgcaggcgggtctgggcctgctggtcgttgtcgaagggctgcatggagatcttcttgccggccgggcacttctcgttctcggccttggcgaggtcctcggagaccgtgccgcgctggaccacgagcttcttgccgcacaggtcggaccaggtcttgatgccctggtcgtcgcccttcttggtgtagatcgagacaccggcggtgaagtagtcgacgaagtcgacgccctggccgaccttcttgccggtgtcgccgtcgatgccctcctggcggtccttggtgtcggtcatcgcggacatggcgatgtcgtaccgcttggagcgcaggccggtgatcagggtgtcgaaggtgccgttctcgaactcgaacttcacaccgagctgcttgcccagggcgtccgcgaggtcggggtcgataccgaccgtcttgccggagtcgtccttgaactcgacgggcgcgtacgcgatgtccgagccgaccttgatggtgcccttgtcgcggatcgactgcggcagcttgtcggccagcggagcaccgccggcggactgggtgtcgctgccgccggagtcgccgttctcggtctggtcgccgcatccggtgagcagcagggcgccggcgaccgcgatcgcaccgaccgctgctagccgggagtgcgcggcggtcgtacgacgggtggagcgtgcggtcatggtggttcctccggcggatgagggagttgccgatggggacggtggagttccggtgggacgggacgccggccggggtccggccggtgccgtgggtcgacgagagcacacaccttcgagtgccgcgacctcgtgtgattacggcatcttgccattcggactcggccattcaggggggccgtcatgtcaaaatcggataacgggtcaccccccgaaccgcaccaggtcggtacatcacgaccgaacctttgcgggaatctgcccttccggccggaagatctgcggaatttctcgttatccgaccatggatcgcgggcgagcaggggtgttgaaggtgtcgtgcgcgggcctgtcaaggggtcgggagaggttgtccggaagcctggctatgagccatgtcaccgacatgcggcgttcggggtccggcatgtgagcttgcgcttatcggactcgtcgccgggggcgtccgtcgggtaagaaggttctttacacccctcatcaggggctcagggcgcgtgtgcggcgcgcccgtcgcgcgggggccacgtggcccagacagccatctccctgtgcggtgcccgcccattcctcaccaggagtggacaaaccctcaaaccatgaactcttaaggggtaagacaaagtggcagcggagatcgtcaatcctcgcagcgacagcgaagccggtgcggagcaggaggcgggcgccgagccgctcgactccttcgaccccgcgttcgcgctgcaccgcggcggcaagatggccgtgcaggccaccgtgccgatccgcgacaaggaagacctgtccctggcgtacacgcccggcgtcgcgaaagtgtgcagcgcgatcgccgagcagcccgacctcgtccacgactacacctggaagtcgtcggtcgtcgcggtcgtgacggacggcacggcggtgctggggctcggtgacatcgggcccgaggcgtccctcccggtgatggagggcaaggccatcctcttcaagcagttcggcggcgtggacgcggtcccgatcgccctgaactgcacggacgccgacgagatcgtcgagaccgtggtccggctcgcgccctccttcggcggcgtcaacctggaggacatctcggcgccgcggtgcttcgagatcgagcgcaagctccaggagcgcctggacatcccggtcttccacgacgaccagcacggcacggccgtcgtgacgctggccgccctgcggaacgcggcgcggctgagcgggcggacgctgggtgagctgcgggcggtgatctcgggcgcgggtgcggccggggtcgccatcgccaagatgctggtggaggccggcatcggggacgtcgcggtcgccgaccgcaagggtgtcgtttcggccgaccgggaggacctgaccccggtcaagcaggagttggcctccttcaccaacaaggccgggctctccggccccctggaggcggcgctcgcgggtgccgacgtcttcatcggcgtctccggcggtacggtgcccgagccggcggtggcctcgatggccgagggtgccttcgtcttcgcgatggccaacccgaacccggaggtgcatccggaggtcgcccacaagtacgcggcggtcgtcgcgacggggcgctcggacttcccgaaccagatcaacaacgtgctggcgttcccgggcatcttcgcgggcgctctccaggtgcgggcgtcgcggatcaccgagggcatgaagctggcggcggccgaggcgctggcctccgtggtgggggacgaccttgccgcggactatgtcattccgtccccgttcgacgagcgggtcgcgccggccgtgacggcggcggtggccgcggcggcccgggcggagggggttgcgcgccggtgacggtgtgacgcccccggtgtgatcactgcggtgtggtgagcggtctcgtccctggtgggcggggccgcttgtcttttgggtgccggtgccggtacgggtgcgggtgggggtgcgggtgcgctggtgctgggcgggggtgggggcgccggccggcgctgggcgggtgccgctgcgcccacccgtgccgccccagcggcacgactgcccgcagctggggggagggctggcaggcgcgactgtccgcagctggggggcgctggcaggcgtgactgacccagctgggggccggggtggctggcaagagggggtgtgtcacacggggctgcggttccggttggggggtggggaacctatcgtcagggtcatgttcgctgtctatgccgcccgaatcgaccgcgaccagccgttggccggcctggagttgggagagcttccggctcccgaggcccggccgggctggagcgtcgtcgatgtcagggccgcctccctcaaccaccacgacctgtggtccctgcgcggcgtcggcctccccgaggaccggctgccgatgatcctcggctgcgacgccgccgggatcgacgcggacggcaacgaggtcgtcctgcactccgtgatcggccagaccggccacggcgtcggccccaaggagccccgctccattctcaccgagcgctatccggggacgttcgccgagcaggtcgccgtgccgacctggaacatcctgcccaagcccaaggagctctccttcgaggaggccgcctgcctgccgaccgcctggctgacggcgtaccggatgctgttcaccaacgccggggtgcgtcccggtgactcggtgctggtgcagggcgccggcggcggggtcgccacggccgcgatcgtgctcggcaaggcggccgggctgcgggtcttcgccaccagccgggacgaggccaagcgcaagcgggcgctggagctcggtgcggtggaggccgtcgagacgggtgcgcggctgccgcagcgggtcgacgccgtgatcgagaccgtgggcgccgccacctggtcgcactccatcaagtcgctgcgtcccggcggcacgctggtcatctccggtgccaccagcggtgaccggccctcccacgccgaactcacccggatcttcttcctggagctcaaggtcgtcggctccacgatgggctccaaggacgagctggaggacctgctgtccttctgcgccgccaccggtgtgcgtcccgtcatcgacgaggtacttccgatggaccgggcccgtgacgggttcgagcggatggcctccggggggcagttcggcaagatcgtgctcagcaactcctgacgcgttcccccagacacggcgggtccggttctccgggcccgccgttcgtatgtccccgccgtgcggtaccgccggcacccatgtcaaccagggttgacaagcgagtcatgtcaacctaggttgactgtatgagtgaagcgacggatctcgccacgcgtgcgggtgaccgtgatccccggatcgggctgcgagcagtcaccgccctgcggaagctggtggagcaactggaagccgtacaggtgcgcagcgcccgccggcagggatggtcgtggcaggagatcgccacggaactcggagtcagcaggcaggccgtgcacaagaagtacgggaggcattgatgttcgagcgattcacgaaggacgcccgcgcggtcgtgcagggggcggtcggacacgccgaggaggcgagggcggagaccgtcgagcccgaacacctgctgctcgccttgctcgaccgggagggcagtcgcgcctccttcgcgctggcggccctcggcgtcggcgagcaccgggacgcggtacgccgggagctgggggacgcgcgacgtcgtgcgggtctgtcgcagtccgagacggaggccctcgccggactgggaatcgacgtcacggagatcgtcgccagggtggaggaggcccacggtgtgggggcgatgtccgccgacgaccgcaagcgcgggcgccggtggtcgggacaccggagcttcagtcgaggcgccaaggaggtcctggagaaggcgctgcgggtcgccgtcgcccgccgtgaccggcacatcggggacgagcatctcctcctcgccctggccctgcgtcccggagtgcccgccgaggtgctcgccgaccacggggtgacccacgcgtcgctgtccagggtgctggacgagggggccgggaagtcctgcgcctgaccggtggtacggcggctcaccggcgcgcggcgcccctggggagccgggggcgccgtgccgtgccgcgctcaggccttcggcgtacgcaggatcgccccgatgtgcgccgctgcctccgacagccggtggcgggtgtcgcgcaactggtcggacgtcactccgtggtcccgggcggcgtcgcggatgtcgtcccggaagcggtcgagcagccggtccaggtcgcgcgccgggtcaccggtggattccgcggcgtcctcgtgggcccagctcggcgcgtatccggcggggaagtcctcgggggtgacggagtactcggggtccggggaacgctccgcgcgcgaggcggggctcccggtgtcggtgcgtccgaagccccagtccttgccgaactccttcccgaagtcctttccgaagtcgccgacctccttggccagttcgctcaggccctcacgcagtcccgtcggccagtcgccccgcgagaagtggtcctgcacctgttcctgcacgcgctgggcgatgcgctggacctcctcctgcgcctgggcccgggcccgctcctgggcctccttggcctggcgccgggcccgctgggcctcgtcgcgggcgcggcggctctcgtccttggcgcggcgggcttgctccttccactcctgcttgacccgccgcatctcctccttcgcggcccgccaggcctccttctcgtccccttccccggcagtggaggtggagccgtccccctcgtcatgcgcccctgaggcgccccggcgggccgccgtggccgcggcccgcatctcccgccgcagatcgccggccgcaccccgcacatcggcccggatctcggcggccagctcggcgaccgactcgcggatctccagctccaggtcggccagctcgccgctgcggtcggccagctcggcgcggccggcgtccgtgatggcgtacaccttgcggccgccctcggtggtgtgggtgaccaggccctccgcctccagcttggccaggcgggggtacaccgtgcccgcggacggggcgtacaggccctggaagcgctcctccaggagccggatcacctcgtaaccgtggcgcggggcctcgtccaggagcttgagcaggtagaggcggaggcggccgtgggcgaagacggggggcatgtcagagcaccttcttgtcggtcgtgccgtcggaaggggcgtcggtggcgccctggtcccggacggaagcggaattgtcccccgagccgtgccgtgcggtgcccgtcgggccggattcctccggctcccgctcccacggggtgtcctccgtcgccggacggcgcagcagagcgatcgagccggagaccgtggtggccttcagccggccgttgcccgcgccgagccgtccggtgatgcgcttggccccccattggccgccgacccggaggtcctcgaaggcgctgctgaccatgccgctggccgtgttcgcctcgacctgggcgtcggccggctggggcagccggatggcgatctcgcccgagacgctgttcaggctgatgtcggtggggcctccggttgggtccaggtcgacgatcatcgaaccgctgaccgagtcggcccgcacggaggagcccgcctccaccaccgtcaggtcgccggagacggagttgaagcggaggtcgccggtgagggcctgcgcctccacgttccccgagacggtgtcggcgcggacggggcccgcgaggctcaccagagtggtgtccccggatacgcccttgacctcggcgggtccgtcgagacccgagaccacggccgcggcgctgaccgcccccacctccacccgggtgccggtcggcaccgccagggacaccaccgcactgcggcgccagcccttgcggtccagccacttcaggaagcccttccagggcaggtcctcgtaggccaccgtgagcacgccgtcccggtgggtcacgatcagcgggggcccgtcgatctcggacacctccaggcgggcggaaccttcgtccgtgcccaccacgttcactgttccgctgacgatgcgtacgtggagccgggtcacggactcgtcgaaggtgagcttcctgggctccgcgacggaccactcggacatggtgcagacctcctcgaccgaacgcgccatatcgcgtccttcgaaattcacgatatatcgcgggcatggaaagtcaagacacccgttccggtgatcaacgatcggcgaatggggcgatgtgtcctatcttgtcgatatgtcgaccgaagagtcggtttccgctcccactcccggcgccctgctgctctgccgggccgagccggattccgtcgccgcggtcgctccgctgctgggcgaacggatgccgctggtccgggccggtgcgcagtggagcgcgctggtgccggagggcgggccctggcgggacgggcgcgaaccggtcgaccgggtcgtcgccggctgggccgcggcgctcgccgtcggtgccccctggcccgtactcgccctgtggtgggacgccgaccgggccggatacgtcctggcgtccggattccgccgcccggtgggctacgtgtggctcgcggacggcacaccggccggcgaggacgaggcgatgcgcactttcgccgcccggctgggcctggacccggtcctggacgtgcagtcgctggaccggctgacccgggccgacccggacgccgagcgcgaattcggggccggagccggtgcccgggccaggctgcggggactgctggcggtgctcgcgcgcgggggcatcagcctccccgcagggctcgaccccggggaaggcgccgcccgcctcggcgcggccgcccgcgccctgcccggggtgcgccggaccgagtccgccggacttcgcccgaccgtcgacgagagccctcttgccgcctggatgccctggacgggcggtccgggcgcccgcgtcctggccctgacccaggtggcgacaggcctgccgctcacagtctggggtctgcggcgacgcagcggaggctgggccgcggcgggggccctgctcgtcggacacggcgcgctcggcgcggcctacgggctctccaggcacacctgacggtccgccgcgacggttcggtccgacggtgccggtccgccacgacgatccggtccggcggtgcgggtccgccgcgtcggtccggtccgacggtgccggtctggtccgacggtgcgggtccgccgcgacgatccggtccgccggtgccggtccgccgtgtcggtccagtccggcggtgcgcctcgatgcttccgcccggcgcccgtgcgtcgccgcctgcctcccggcgcagtcgcctgtctccccgcgtccctactcgtcctcgtcctcgtcgtcgtccagccgtgccagccacgtggccaggcgctccaccggtacttcgaagtccgggttcaggtcgacgaacgtgcgcagctgctcggcgagccactcgaaggtgatctcctcctcgccgcgccgcttctccagctcctcgatgccgcggtcggtgaagtacatggatcgtgctccgtcgggtctttgcagggttgagagcctcccgggcgggaagaaacctgtgcctgcagggtggagagatggggtctttccgtcagttgtgaagaagacagcacaaggataggcgcccacggggccgtgccttccggggccgtcgaggggcgcggggacgggggaatcgcatgggacaggaagcgacgcgcgtcacacgcatcgtgctgccggacgggacaccggtctgggcccggatctcgggcgcggccgagctgccggcaccgtccggacagctgtcgtacagcgacaccggcttcaccgagcggatcgaggcgagcgtggagagcctgaacgcgctcgtgaccggtgtcgcccgctcgctggcggaaccgctgcgctcggtgcggccggacgaggtgagcgtccagttcggcatcgagttgacggccaaggccggcaaggtcgtgggcctcctcgccgacggcgaggccaaggcgggcatctcggtcaccctcacctggcacggcggcccgccggatccgtccgcgcccgacacgcgcgccccgggtggtgagccccccgaccccaccgcggacgcgtccgcccgcgccccggggcacggcgggagcggtgccgccgcttccgggagcggggcatgacgcacggacgcgcccccggcgcaccgggggcccgggacgcggcccgccgtgcgctgcgtggcctcgtcatggcggcgaccgttcgcattcatcggccggacgccgggtatgccctcgacgaacccgggacgttcctcggcagcggctacttcatcgccccgagctgggttctgacctgcgcacacgtggcatgcggcggtgaggggggcgaggtcgtggtggtgtacgagcccgcaccgggccgcggcatgtccgcggtctcgggccaggtggcggcggcccttcccgagggcgccggacgcctgcccgggaactggcctgcccccgacctcgcgctggtgcggctgagcgagccggtcgaccacgagtgcgtgtacctctccgagcgcccggcggcctacttcggcgagggcacggtcctgtacgcgggctggacggtggtcgacggacgactgaggatgctcgacggcaccctcaccgtgcagggcacgatcggcggctggaacgcggacgtccagatgcggctgggggacaacgacctcccggacggcgtctccggcggcccggtgatcgatccggagcgcggcgaggtcatcggcgtactgaagtcgcgctccgaccacgcgcgcgggggcacctccaccgggctcgaacaactgcggacgctgcccgtgcccgccggcgagctgaagagcgaacccgacgacctgtaccaggcggtggtgcacgcccacgaccgctaccaccgcgaccggcagcgccatccggacgcgcgccgtcacacgtgggcggacgtgcagggccagctcggggcccggcccggtcagacgctgagccccgacgagcgcgtccagttgctcggacgcctggcggacctgccgccgcccgccagcacccgctccctgctggatctcctcgactccttgcaggacttcgaggcaccggctccgctgcccgccccgcgcggctggcgcgacggactcggtgccctgtacgagtacgcgcgcgacgacggcgccctctacctggtgctcgactacgcggtgcacgccatgaccgcggaccgcccgttcctcgcgcccagtacgccggccgccgaggaggccctgtgggccggggtctggcaggccgcccaacggctcggccccggccgccggagcgccctcgtcgaacggcggatggccaggatgacggcgcgccggcccgccccgggcccggccgccgggccgcgtggggcgcccgccggtggtccggaaggcgcggccgccgggcagtcgtccgtgctggtggagatcgtgcggcggggctgggaaccggaccgctgcgactggtcggtcttcgtcgtgcgctccgacggagaggcgacgcggctcaaggaggtccagcgcgtcccactggccgacctctccgctcatctgtccgcacccctgaaggaggcgttccggcagtgcgacacgccgggccggccggcggtactgcaggtggcgacggaggcctcgctgctggcactcgacgtggacgaatggcggctcggccccgaggacgagcgactgggcacacagcgcccggtcgtcctgcgctgctccgaccgcgaccagctgaccgagaacggcgagaaccccgagtacggcgagaacccggagtacggcgagacttccggacacggtgcgtaccccggacacggtgcgtaccccggacacggtgcctaccccggacacggcgcgtaccccgcacaccgcgcgtacggcgagaacggtgaccaccgcctggacatcgacgaggaacgcagggcccgctggcgctggctgcacgcccacccggtgacggccgcggtcctggactgcgacgacgggctgcgcaaaccggtgccgcccgtcgaggagttgcggggcctgtcgcacggcacggttccggtgctgtgccgcttcgacgcgcacggcgtccagggcgacgcggaggggctcgcccggctcgtgcgcgggggcttcggcgtggcgctgtggcgccgcgggtacgggctgccggagacggtctgcggcgagttccaccgcggcaccctggaccagatcgcgggcccggccggagcccaccgactgcccgaggcggtgcgcgacctgcgccacagactgcgatcgggacggccggagaccttctgggcccacggcatagcgctgctgtacgacgacccgcaccagcccctgcccggcgcgggcgacctgctggaggcaccgtgaccgcggcccgcgcgggtccgcgtggaccgcgcgccctggcgtttcaactccccctgacgaggcaccccttgagcgatgtgcctcttaccagtcccgttcaggatcgataccgtgatggacgccccacgacgacagcgccccccggacgagtgacgacgaggattggatcatgagcgaatccagcgagtggctcatctaccggggcgcgggcgaaccccacgacggcgtcgaccgccttcccgacccgcccccgtggcgggacttcacgagccgggacgcggcgggttccggcgacgggtccgaggatcgcaggctcggcgcccaccggcacctggccgagctgcaccggccgggcgccgaggaactcgagatgatcaacgccgcgctgtacctgcgccggccgctcctcgtcaccggcagccccggcgcgggcaagagcaccctggcccactcggtggcctacgaactgggcctgggcaacgtactgcgctggtccatcgtcagccgctccgaactccaggacggcctctaccactacgacgccatcgcccggctgcaggacgtgcagatcgccgcgcaggcggacaacggcccggggtccgggacgccgggcgcggtcgacggcatcggcggctacatccggctcggtcccctcggcaccgcgctgctgccctccgacaagccgcgcgtcctgctcatcgacgagctggacaagagcgacatcgacctgcccaacgacctcctgaacgtactggaggagggcgagttcgccatccccgagctggaacgcgtcgcggaccggctgccggaccgcacggccgaggtgctcaccgcggacggcgtgaaggtgccggtgcgcgacggccgcgtgcgctgccgcgccttcccgttcgtggtgctcaccagcaacggcgaacgcgacttcccggccccgctgatgcggcgctgcatccacctggagctgggccgccccgaccacaaccggctcgccaccttcgtacgggcccacctgggcgacgaggcggcacgcgcgggcgacgacctcgtcacgcggttcctggagcggtcccgcagcgagctgctggccacggaccagttgctcaacgcgatatacctcaccgacgccgccgccacgcccagccgcgaccgcctggccgacctgctcatccagcggctcgatcgcccgaggtgacgcgatgcccgacgagacggcgcgccacggtcccggccaccacggcacctccggcggctccggcacctccggcggccccggtacccccggcggctccggcacctccggcacctccggcggctccggtggcgagggttccgagacagggcgcgccgccgtgcccgccgacgacccgctcgcccgactcgtcctgaggctgcgggagagcggcctggatccggacgccgagcagctctgtgacgcgctctggctggcccggtggacccgctccgccgacgccacggacgctgagcccgccccggacgcgcgcgtggcgcccgcggtggtccggccgcccaccggacccgtgtcgctgccatcggaccgggcccggccgcccgcgcccgagccgcccgccgctccggccgcccgccgcgtggccctctacccgctgccccccggcgacgggcccggtgcgcacggagccggcccggcccgcgcactgccggtgggtgtgcccgccgcccccgtgctgcccgcgccgctcgaactccagcgcgccctgcgccccttgcagggataccgcagtccggccacacccctgcggtccgagctcgacgaggtcgccaccgcggaggtgagcgcccgggctggcggactgatcctgcccgtccgccggtacctgtcccgccgggacgcccggctgcaactggtgctggactcctcctcctcgatgcgcgtgtggggccggctgttcgccgaactggcccaggtcttcagccggctgggagccttctcggacgtccaggtcagccatctgcaccaggggcccgacgggggcccggccgtcagccgcagcgccgacccgtacggtgcgccgctgcacgccgccgaccggctcagcgatccgaccggacgccggatcgtcgtcctggtcagcgactgcgccggcccgctgtggcacggcggccacgcccaccggctgctccaccacctgacccggcagggccccgtcgtcgtgctccagccgctgccgcagcgcatgtggaaccgcacccggctgcccgtcaccttcggtggactgtcgcgcggtgacaccctgggcggcggcgccgtgctgcgggtgcgcacggcctccggcgccgccgaggcccgccgcggtgcgctggccgtgcccgtgctgccgccggagccggtggccctcgggtcgtgggcacggctgctggccggtgccggtccggtgcccggcgccgtgggctgggtgcgtgccgaccatccggccgccgcggccacccgcccggaccgccgccgcacgccgttggagcgggtcagccggttcagcgccggtgcgtctccggccgccgcgcgcctggccgtctatctcgcggcgaccccgctctgcctcccggtgatgcagctggtccagcggacgatgctgcccggctccggcccgtccgaactcgccgaggtcctggtcggcggcctggtcacccgggcccgcgcggaccagggcggcgacggctcccagtggtacgacatcgaccccgaggtgcgcgaggccctgctgtcccggctcgggcgggacgaggccatgctggtcctcaagcactgctcggagtacatcgaacagcacttcggcaagggcggccccaacttcccggcgctcgcgctggcccagctcggcgacggcggccccggacgcccgcacccgcacccctccggcggcgagcccgggtacccgggcgagaacggcggcgacgccgggaccgccccggtcccgcagcccttcgcggaggtcgcggcccggatcctggagcggttcatgccgttgcccgagcagttcgcgacgtacgacagccgcaccggcccgcaggtcaccgcggagcggcccacgcaccgggcggtcgtccgggcgcgcgccctgctcgcccggttcgacggcgagggcatggttcaggacgtcatcgacgccgtgcagctgctgcgcggcgccaccgagcaggaacggccggccggcgccgacccggagctgtggggcgagtacgcgcgctgcaccctgcggctgtgggaggtgcagggcggtaccgcgctgctgcgggaggccacccgggccgccgaacgggccgccgcgtcgccgcacgccctgcgcgagcgcgccgtcctcgcacgcgtactgcacgccgccgccaccgacgcgcgacggcgcggagaccggtccggcgcactcgacctgctgcggcgcgccgaccgggagtacgcggtcgcctgcgcggcacccggcctggacgaggcggaggcgctgcggctcactctggaacgggtcgcctccctggaggcccagtggcgcctgggcggcgacagcgcccttctgcagagtgccgtcggcatgctggaggcgttcgccgacgcctggcccgaccgcggcgaccgcccctctcagctgctgctggcccacggccgcaccctgctgcgcctgtcggaggtgacggcggacccggtccaggtccggctgtacgcggagcagtcggcgcggtcgctgcgccgggggctggaggccggcccggcaccggagaccaacgagtccgtccgtgaccgggtccgggtgctgatcgacctcgtcgacgcgctgctgtcggcgggcggcccgctggacgaggcccaggccaggaccgacgaggccctcggccgggtccgcgagcaggggcagcgcgcggccctgctggtccgcgccgggcgggtggccgtcgcacgctacgccgagtcgggggagccgcccgaactgcacggggccgccgaccggttcgcacaggcggcgcactggatgtcccgggacgcgcccgcgcacgcggacgtgctcgccgagtggggcggcgtactgctccggctggccacactggagcccgccgaccggcgccagggccagctgtcccgcgcgatccgggtgctgcgggactgccggatggagactccggcgggcagccggcgcgtcgcccaccggttgctgctcctcggacaggcgctgatggtccggtaccaggcgcgcggcgaccgggtcgacctccgggaggcggagcatctcttcgggctcgccgcggccgacgcggaggacccgttgctggcggcacgctgccgactggagctcgggcaggcccagttcgaggcgttccagagcctgggccgcgcggcgcgcctggacgtggcggtcgaggccttccgggcggccgccgagtcggcccgccgggcagaggaagaggccgaaaccgagcgtcggcgccaagaagccgtggagctggccgcacaggcgcaccactggcggggtatgtccttcgaggcggcggtgcggccccgcgcggcccgggaggcctacgcggcggcgcgggcgcagtgggaccggttgccggacgaccggctggccacgggggaaccgaccgcacggcagacggcgcagcggctcgccgacctggagtgagcggaggagaggaacggggcatggacatacgggacgaggccggggcggagcaggcgactgcgggcgccggggagccactgcctgacctgctggaactggacctcgcacagctgggcaccgtcgaacatccggtgctgcgggaggtgctgggggaactgagggcgcgggccgcggagccgagcgagatgctgtggggcttcgacaactccttctgaccggccggccgcggtcaaccgggcgcatgaagacatgtgaacaggacaactttcgcggcgccgagttttgggcacccgccgcgccgggaatgcggcttcgtgcggcacggtgccgtggcgccgactcgcggcgacgccggcggaccgtcacggcatggggggtgctggagtgtcggaacaggccatgaccgatcccgctccgggcacacccggtcggcggaccggccccgaaggacccattcccttccggcagttcatagtcaagatgcacggccgctgcaacctcgcgtgcacctactgctacctctacgaaggccccgacggcagttggcgcgaccgtcccgccgccgcctccgccgccgtcctggaccgcaccgccacccgtatcgccgagcacgccgagcggcacgcgctgcgcgacctcgccctggttctgcacgggggcgaaccgctgctcgcgggggccggcccgctcgccgaggtcaccggacgggtgcgggagctcgtcccgcgagggtgtcaggtccacgccaccgtgcagaccaacgccaccctgctcaccgaggaacgcctcgccgtcctggccgacgccggcatccgcgtcggcatcagcctcgacggaggcaccgccgcccacaaccgacggcgggtggaccacgccggccgcccgtcctggcccgccgcggcacggggagcccgcctggtcgccgagcgcttccccgagtcgtacgcggggctcctgacggtcgtcgacccgacgctggacccggtagagacgtacgagtcgctgctcggcctgcgcccgcccgcgctggacctgctgctgccgcacggcaactggaccgcgccgccgccgggccggaccggcgtccggtacggcgactggctctgcgccgtcttcgaccgctggtgggccgccgggcggcgggaggtccgggtacggctcttcgaggagtgcgtggcgctcctgctgggtctgcccgcggccaccgaagctctgggactcgctccgttcgacgcggtcgtggtggagaccgacgggtcgatcgagcaggtcgactccctcaagtcggcgtaccccggcgccgcgcgcaccggcctcgacgtgttccgccacaccttcgacgacgcgctgcggcacccgggcgtcgccgctcggcaggccggcaccgcgtcgctcgcgggggagtgccgggcctgcccgctgctgcgggtctgcgggggcgggcactacgcgcaccgctaccgcgccgggcacggcttccggaacccgtccgtgtactgcgcggacctccagcgcttcatccgccacgtgtcctcgcggctcaccgccgccgcggggggaccgactccgggcggcccggccgcgagcggtctgccggggggtggttcggccgcgaacggttttccggaggatggttcggccgcgaagggcccgtccgcgactggcccgtccgcgacggccccggcgtcggtcggtctgtcggtcgtcggaccggcgtcggctggtccgtacgccgtcggcccagtgccagtcggtccgtcggcgatcggcccagcgccggccggtacctctgccgccggcccggcgtcgaccggtacctctgccgccggcccagcgtcggccggtcccgcagtcggtccagcgccggccggaccggctgcggctggtccgtccgtctccgccccggcgtcggccggtgtgtcggtcgtcggaccggcgtcggccgattcctccaccgtcggtccagcgccggccgggccgacggtggccgctccagcggcgaccgctccggcgcccgctgggccggcgtcggctggttcgggcgcctcggccggtcccgcgtcggccggcgcggcctcggtgcggccggttgtcagcggttcggctgccgccgggacgggcccggccgaagggggcgcctcgtgatgtttccagtcgttcccgagcgggcccttctcgaactcgcccggaccgagggcggatccgacaccctgacgctcctcgtgcgggaccaggacacgcggcggctgctcctgctgcgtgccgtgctcgacgcggccgagggggcggagcggtccgtctgcaccgccgcgcagaaggcgaggctgcgcgcggactgggcgctgctgaccgaggcggaccggcccccgtcgccgggcgcgccgacctcggagcaccggcccggccgcgcggcaacgcgccgcgaccgcgacgccccgcccggtgcgcggggtacgagcgccgtcgccgacgccccgaccggtgcgtggagtacccatgccgccgacgacgcgccgaccggtgcgtggggtagccgggcgggagccggtgcggctccggccggtggcgacgcgcggttcgcgaacccggcgcgtgcccgtctgttccatcccctcaccggcccctgggcgcgctcctgtctgcgtggcctcgacgccgccccggggccggcgggcggcgagcgggagcggcggctgcggcgcgacctcgcgcacttcagcgcgatcgccgcggtggtcgccgccggtgccggcatcccgttcagcacccggctcacggcccgcgccggagtcctcgccctcccctcgctcggcgccctgcacacggcccggtccggcgacgtacccgtcgacgtcacctgcaccgaaggccggttggtcctgcgccaggccgacgcccccgacgtgaccgtccacctggagagcggcgtcggcgcctggtcaggcgccctcgcctggacgcccgcccacgcgctccccggcctcaccccgacggcaccgcccctgccgctggacgacctcgacccgtaccgcgagctgcccgacggccccggccacggcgacctgcgcacaccgctcgccctcgacgacgcggaacgcaaacgctggctgcaggcctggtccggcacggccctcgcgctccgcacgggcggcgcgcaacgcctcgccgaagcgggcgcgctgctgcgctgcctcgtcccgctggagacgccccccgacgtcggcaccggccgcggcagttgcagcgccacccgccgtgaggcgttcggtgccctcctcagcagcaccccgcccgaccccgtgaccctcgccgccaccctcgtccacgagttgcagcacgccaaactcgccgctctcagcgacctggtgaccctgcaccgagcggggcccgcggcgcggtacttcgccccctggcgcgccgatccccggccctacgacggcctgctccagggcacgtactcgcacctcgcgctggccgcgttccaccagcgccgggcactcgtcgacgggctgccggaccgggactgggcgtgggcccagcacgcgcgctaccgcgcccaggtcggggccgccctgcccgccctcgtcggctcgcccgacctcaccgtgcggggacgccggttcgtcgacgagatggccgccacccacgaacggatggcggaacatcccgcgcccaggggccacgtcgcacgcgcgcaggcgtacgtggcctccgcgcgcacactgtggacccggcgtcacgcctccacgctcccgccctctaacggatgaatgcccacgcgcggcggccgggtacggaaagatcgtccgcacagggggtgttgccgtcggtcggcggacttacgcgcgacgctccggggtcctaggattttgcggtactacgtgctggaggccactgcatgtctggagctcgcaagccggtcgagacggccgagagggggaccgccaggcagacggtcacgatccacttcgcaggcttcaaccgcgcctgggcggcctggatcggggaccggctggagcggcgtggcgtacgggtggtgcccctgcgctgggactccccggccgatgtcccgctggtggacctgctgcgcgacctgacgctcgccgagggccgggtcctcatcatcgtcagcgagtggtacttccagctcggaccgcgcacccacgaggagtggaacgcggccctgcgcgagatcgtcgcccccgacccctcccggttcgcggccgtgtcggtcaccacggcggcggtcccggccgccgcggccgtactggcaccggtcgccctgaccaacatgggcgccgaggaggcggagcgccgcctgctggaccggctcgacctgccgtccgaggcgctcgccgagacctcggcggagtcacggcgagcgccgcggttcccggcggcgatgccggacgtgtggggcgtggtgccgcggcgcaacacccgcttcaccggccgcgagccgctgttcaacgaggcctaccacctgctccagagctccgagcccggcgccggtgtgctgaccctgcacggcatgtccggggtgggcaagacccagttcgccgccgagtacgcacaccgtttcgggtccgagtacgacgtcgtctggtgggtgaacgcggagaagcgcgtcacctaccggcggcaactggccgagctcgccccgaaactgaacctgcggaccggtcaggagtacggcgagcggctgcgcgcggtacgcgacgcgctccgtcgcggggagccctactcgaggtggttgctggtcctcgacggggcggacgagccggaccagatctgggacctgctgccgaccgggcccggacacgtcatcgtcacctcgcgcaaccccgagtggagcgagcacaacagcaagctgctcgaggtccgggtctatccccgcgacgagtcggtcgcgttcatccgccgccgcgccccccgcctgtcggaggcggacgccgaccaactggccgaggcgctgggcgacctgccgctgctgctcgaccagacggcgggctggctcaacgactccgacctgtcggtcgacgagtacatcgccctgctggagggcggtatcgacagcgatgtggtgaaggtgtcggcggacttcccgctggccttccagaccgcctggtcgatactgctgaacaaactccgggagaccgtcccggagtccgtcgacctcctgcgcctgtgcaccttcttcgcaccgggtttcatccccgtacgcctgctgaaggagatgcccgtcgacgagctgcccgagcagctcgccggactgctcaacgacccgctgctgtggaacaaggcgatcaaccagctgcgcacctactcggtggtccggctggagtcccacgaggcgtccctcgacgaaccggtgtccgccggcgaatcgctctacctgcaccgcatggtccaccagatcgtgcacaaggacatgccggacgccgaccgcagcgagttcatcgacgtcgtacggcgggccctcgccgcggccgatccgggccggccgaccgaaacccggctgtggcccggctacgcggagatcgtgccgcacctgaagtacgcggacgttctcaagagcaaggacacgaaggtccagcgcatggtcctgaactgcctgcgctacatgtacttctccggcgagtaccgggccggcatcaaactcggcgagcgcgccctcaccgcctggcgccgcctcctcggcccgacccacgcgcggatctgggagctgacctaccactacaccaacctgctgcgcgccatgggggactacgcccgcaccgaggccctcagccgcgacgcggtcgagcacctcagggaggaacgcggaccgcaggacctcgaccacctgcgcgccgccgcgggcctgggcggcgacctgcgcggcctggcccgctacgacgaggccctggaactctcccagtgggtcctggcggcctaccgcgaactcctcggcgaccaggactccaggaccctgaacgcgcagaacaacctgggtgtctccctgcgcctgctcggccgctacgaggagacgctggagaccgaccgcagcaccatggaggcgcgtcgccaactgctgcgcgcccgccatccgtgggcgctcagctccgagatcacgtacgccatcgacctccgcctgctgggccgctacgccgacgccgagtccctccaggcgaagaacgtgcgcgagaaccgcatcgtgatgggcccggacaacccgcagaccctcaaggccgagtacaacctggcgctgtgccggtaccgcctcggcgagcgggcacctcgcggcgaggagccgggaacgatgctgagcagtgtcctggagcgcggagaacgtgtactgggcgagacccatccgctcacgctgatcttcgcgaccggccagagctgctacgcccgcgaacacggcgacatcgaccaggcccgcgagctcagcgaggcagtcgtcgcccgctacgagatgatgctccccgcagggcacccgttcatcgccggggcccgcgccaaccaggcactgatcctgcgcaacgtcggcgaacgcgagcacggccacgtcctcgtcgaacaggcgctggccgagatgacgcaggccgtcggcgagagccacccctggacagtcggctgtgccctgaacgcctccgcgctgcggaacctggtgggcgacaccgagggggccgccgaactcagccgggacacggcggcgcgcgccatcgagtcgctcgggcggacgcacccgctcacgctgtcgacccgtatcgcgtacgcggcggacctgcgcggcctgcgggaccgccggcaggcggagaaggtcgagcaggaggcactgtccgacctcgacgcgacactgggcagcaaacacacgcacaccgtctccgcccgttcccgcaaccgtccgtactgggacttcgagccccagaccacctgacgtcgcgaaggacgagaccggccggtcaccttcgttgccccggggtgcataaccccccgcgccccggggaagaacacgggtccactcaacacacctgtaacacacacgagttgggccagggggagcgtgtggtgatcttattgggccccgtgccggaaggcgcggacgggcccataccggtcgaggtcgacgcgcacctcgacccgtccaccgccgacgggctcgacctcgtcttcggcgacgaggagacccgggacggcgccggacagcgagtcgtccgggtggcccgggacgtctacaccgacgggctggacctcgcccgcagatgcgccgcccaggccgtacggcgcttcggcgagctgcaggaggggcttcggccggacgagatcgagatgcagctcgccatcaagatcgacgccggggtggccaccctcgtcaagagcggggccgaggcgcagctccagatcacgctccgctggcagactgcccccgcttcctcccccgcagccgctcccgacggccaggggaccggcgcggcagacggggccggttcgtgagcggcgcggtgccggagccgcgcatcctgccgtactcccgtgtcgtcgcccaggacgagctcaagctggcactggagctccaccacgtcgtcccccgcatcggcggcgtgctgatggccggaccgcgcggcaccgccaagtcgaccctcgtacgggccttcgcgctgatggcccacggcgagctgccggtcaccctgcccatcaacgccaccgacgaccgcgtcgtcggcggctgggacctggacgcgcttatccggggcgagccgcggccgcagcccgggctgctggaggacgcggcggacaagggactgctgtacgtcgacgaggtcaacctcctcgacgaccacctcgtggacatcatcctggacgtcgccgccaccggtgtcctgtccgtgcagcgcgaggggctggacaccgccaagtacctgtcgttcggtctggtcggcaccatgaaccccgaagagggtgggctgcggccccaactgctggaccgtttcggactgatggtcaccgccgagacactggacgcgacggcacgacacctgctgctgcgcaccgtgctcgacttcgaactggagctggaacgcgaggactccgcgtggctctccgccgcccggcgggacgacgcgcgcacccgggaccggctgacggccgcccggcgccgggtccgtgacgtcgacgtccccgaccacgtcctggagctgtgcgcacgggccgcggaacggaccgaggcggtgggtcagcggggggagatcgtggccgtgctggcggcccgggcactggcggccctggaggatgccgaccgggtgacccccgggcacctgcgccgggtcctgccgatggccctgcggcaccggcggccggaagcggtgcacggcgacaccttcgactgggagccggacgacgaggcccgtctccaggacctcttcgaggtctgaccaggatggcagccgtcccgccccgcccgccgacgtcccccagcccacctccggagggcggcatcgccggcggagcggccccgcccgacgacccggcgcgccggctcggcctcgcgctcgtctgcgcggcggccgatccggccctctccggggtcctgctcgtcgacctggatccccggctcgtcgacccggtcgcccggctgttcggcgccgtcctcgccggagccgccgagccggcgagaccgccgctcgtactgggtgcctcggaccgggacgaggacttgtggacccgcatcaggatccgcggcggcgagcacggcatcaccgtccgcaccgagccgggccccctgaccgagggggacgacgccgacggagcgccgccgttggtcgtggtgcccgacctcgcgcggctgagcgtcgccgggatgcgcgccgcggtgcagttgctcggcgccgacgtcgtgaccgtcgaacgcggtggaccgcgccggacggtccggccccgggcccgctggctggccgtctgccgcagcgccgacgtggggcgggtcagccggcacctgctggaccggttcgccgtacggctgtcggcggcggggctgcggctgcccggtgtgcgcgaggcactcgcggagacgggcccgcgaccggaggcgggagcggcggcgggcgagggggaggcactgttcgcggggctcccggcagcctggcgttcggcggccgcgggaggcgtccggcccgtgcccgtcggcgacgcggcgatcggccgggcacgggagctgctcgggcccgacgccggggtccgccgggagctggccctcctgcgcctcgcccgcaccctggcggcgctgcacggccgcccgtcggcctcggccgacgacagcgacgccgcggcccggctcatcggtgtggccgtgcctcaggatgcgccgggccgcccggagagcggcccggagccgcccggtccggcgccgggaccgacgggcctgcccggcaccgtcccggaacgtcgcgccgccggcggggacggacgaccccggccgcgcgacggcgaccggggactgctggacaccggacccgccgagggaatcggcaccgcacccggcgccgcgccctccccggccgacgggagcccttacccggaggacgagccggccgcggcccgggacaccgtgccgctgagcggtccccggcggcgcagcaccgggccggtctccacccgcggcaccgtgatcggcacccgccgcgccacggacctccgggacatcgcccacgtccgcacggtgcgcgaggccgccgtgcaccagcgggcccggggcaccgaacggttcaccgtctcgcccgtcgatctgcacagcaacgtgcgcgccgccgcccccgagcgggtcctggtactgctcctggaccacacctgccggggcgggaccggggacggaaactggccggaggtcctcgcccccttcctgcagtgggcgtacacgagccgggccgcggtccaggtgatcgaggtcggcgcggcggacgcggccgacgagctgcgcgcggggtccttcacggcccgcggtgtcctggacccccgggtgccgggcgcgctgtaccggcgggcagggcgggcgacgccgctcgcccacggagtcgaactcgcggcgcacacgctgcgccggctgctgcgcaggcagggcaccgggccggcagaggcgtggctggtggtcgtgaccgacggccgcggcaacgtcccgctgcgggtcagccacaccggacggctcgccggccccgtggccgccgcaggggtcgaggacgcggtggaggccgccgcccggatcggcgccatggaccggacgcggctgcacgtggcggtcgtcgacccgggccgggaaccgtacggcgacctgccgtacgtcctcgccgaccggctcggggcgatcgtcgtcgacgggcgccacgcgcccggggcggaggccgccggtgagtgatccgcgccgtgggacccgcggactcccgggcaacggcaccgccggactccgggcggccctgccgggactgagggccgtggcccgccgccccgccgcctcggtgctgaacctgcgccgcgcccaagagccgcccgccggactcggcggaaccgacgcacggcccggcgcacgcctggaggacggcttcgccgtgctgcgcgtcctgcgcgccgacggggccgacggactgccgggataccggctgcagggctggtgcggcgacctgtcggtgacctgcgcggccgggcccacccgccggcccgctcccgccgtcagcctcgcccggctgcggcaggacggcgacgggcactacccctcggaggtgctgcggggcatccgcctgtggtcggacaaccagtacgaactcgccggctgggtcaaccggatccgcgcccggcacggcgacgacctgcggctggtcgtgtgggacgacaccggatacgacctgccctgggagctgctcctgctgcccggggacgccgcggccggcctggcgggcggcccgttgggcgcggtgatcgccgtcgcccgctggaccaccgtgcgtgatctcagccagggcggtctgcccgccgagaccggggactgccacggccgggtgctcggctacctccaccaggacatggcggacgacggccgcgtcttcacctcgtacgcgcatcggctgcaccggcgcatgacgcccttcctcagcgacctcgacacccaggacgaccgcaccggactggtctacctgggctgtcacggcacctacggcgaggccgtgccgggcctcacgctcggcgaccggacctgggccgagctgaacggcgagtcgatgtcggtactgcgccgggacggctcgctggtctgcctcaacgcctgcgactccggccggttcgtcgacaaccgggcccagggggaggaggcgctgcgcgggttcgcggagctgttcctgcgcaagggcgcgggcggctgcatcgtcagctccggaaaggtcggcgacctggaggcccgggcgatggcgcggcgcctggtgcgcgaggtggccgagcacccgcgccgtccggtggtgcggacgctgcgggacttccgggtgcgggcactggaggagttcgggtccctggcggagctgccccgggtccgcaacgatgacggacaggtcgacgtcgtgggccagaaacgggtactgcggctcctgtacgcgttcatgttccactactacgggcatccggggacggcgctgcggctcaccgcggtggacgcgctcggtaccgaggggggaggcggccggtgagcgccgccggacggccgtccgggcaaccgctgctgatcgagcccgtcgtcgcgtggccccggcaggcggaggcggggggcgactacctcgtcaccgtcgatctgcgcggccccctaccctctccggacggcacaccggcccagtggccccaccccgaggaggagttcaccttcaccgtcaccctggacggcgccccgcacctggactgctccgccctgggcgaaccgaacgtcgtcctgcaccgcttcggcggcacctacggtcccgcgcgattccgggtctccgcgggcacggacctcggccccgcttcgctgtggctgaccgtcagcaaccagtggggcgtgccggtccgcaaggcggagctgcgctgcgagatccacgcggccaccggtgccgcgggggtacgggccccgggcggaccgacgccgcagaacgtcccgcggatgcccctgccccgcccgtccccggccaccgtgcgacccgacccggaccggcggacggtcacgatcagcttcgccggtcccgaccgggcctgggcggcctggatcggggaccggctggagcggcgcggggtgcgggtggtgccgctgcgccggggttccccggcagatgtccccccggcggccctgctgcgcgacctgaccctcgcgcccgggcgggccctgctcgtcctgaacgccccctacttcggcgacggcacgcaccagcacgaggagtggaacgcggtcctgcgtgaggtcgtcgcccctcacccggcccggttcgcggccgtgtcggtcaccggggccacgctcccgtcggaggtctccctgctggcgcccgccgcactccacggcctgcgggccgaggaggccgagcggcgcctgctggagcggctcggcctgccgtccgagccggtcaccgaggaagccgaggccaggaccgggccccggtttccggcggacgcgccgggggtgtggggcgccgtgccgcgtcgcaacacccgtttcaccggtcgtgaggccctgctggacgagatccacgacctgctgagcggtgcgcggccgggcgaagggatgctgacgctgcacggcatgtccggagtgggcaagacgcagctcgccgccgagtacgcgcaccggctcggccccgagtacgacgtggtctggtgggtcaacgcccaggagcgggccgactgccgccgccaactggccgaactcgcccccagactgggcctgcggaccggccaggagtacggggagcggctgcgcgcggtgcgggacgcgctgcgccgcggcgagccctgctcccggtggctgctggtcctggacggtgccgacgagcccgaggagatcgaggacctggtgccgaggggcccgggacacgtcctggtctcctcgcggaacccggagtggggccgctacggcagcggactgctcgaagtccccgtgtacacccgtgacgagtcgatcgccttcatccgccgccgcgcgcccggtccgacaccggccgaggccgaccggctcgccgacgccctgggcgacctgccgctgctgctcgcccagacggtgggctggctgaacgactcggaccgttcggtggacgagtacctggccctgctggcggacggcgacggcaccgacggcgaggcgcggaacgtgtcggaggacttcccgtcggccttccggacggcctggtcgatcctgctggccgaactgcgcgagaccgccccggagtccgtcgtcctgctccggctgtgcaccttcttcgccccgggcctcgtccccgtccacctgctgcggagcatgccgcacgacgggctgcccgactccgtggccggactgctgagcgacccccggcgctgggaccgggccctcggtcacctgcggaggcactccctcgtccgggtggaaccggacccggcggaaccggagcgcgagaacctgtacgtgcaccgggtcgtccaccagatggcgcaccaggccatgccggaagagatccggcgcgaactcgtcggcgtcgtacggcgggcactggccgcggccggccgcggccggcccgcggcccccgaacagtggcccaggtacgccgagatcgtgccgcacctcaagtacgccgacgtcctcgcgaccaccgacgaggccgtgcagacactggtcctcgactgcctgcgctacctgtacctgtcaggcgagtacggagcgggcgtccggctcggcggccacgccacccggatctggcgttcgctcctcggcgaccagcaccccctcgtctgggaactgacctaccactacgccaacctgctgcgcgcggccggggacttccaccgcacgatggagatcgagcgggcggccgtccggcacctgagcgagcagcgcggggaacgcgatcccgacctgctgcgggccctcggcggactggccgccgacctgcgcggcctcgggcactacgcggaggcgctggagatctcgcagcgggtgcacggcacgtaccgcgaactcctcggcgaccaggacacccgcaccctgaacgcacggaacaacgtggccgtctcgctgcggctgctgggccgctacgaggacgccctgagcgtcgacctgcccaccctccgggatcgccgtcggctgctcggggaccggcacccgtggacgctgagttcggagaccgcgtgcgccgtcgacctccggctgctcggccgccacgaggaggccctgtcgaggcaggacgccaactggggactggtgcgcgacacgctgggcgcccacaaccggcagaccctgctcgccgcgcacaacctcgcgctgtgccactacgccgtgggcgacaccgacgaggcggcccaccacgtcggccaggcgctggagctgggtgagcgggtgctcggcgacagcgacccgctggtgctgatgctcctcgccggccggagctgcctcgcccgggagcacggcgacctcgacctggcccgggcgctgagcgagcgcgtcgtcggccgctacgaggagacgctcaccgccggccacccctacgccgcgggcgcccgcgccaaccacgccctgctgctgcaccgggcgggcgagcacgaccgggcacctgccctcgccgacgccgcgctggccgacatggacgccgccgtggggcgcgaccacccctggacgttgggctgcgcgctcaacgcggcgatcctgcacggggacgccggagacgcggaccgtgccctcaccctgagccgggacacggccggcacggcggcgcgcgtcctcggatccacccatccgttcacgctcttcgcagaggtggccctcgcggccgaactgcgcgtgcgggggcggcgcgggcagtccgacgcggtgcagagtcaggccctggagggactggtcgccgccctcggcccccagcacccgcgcaccctgtcggcccgtgcccggcgcgctccgttctgggacttcgaaccccagcgcacctgaccgggcacccgcgtgcgccggggaaggccgaagggcccggccccggagagttccggagccgggccctgcacggcgcggccgtggtgggtgtcagaggctcacgcctcgaacacctcacgcaccagctgctcctgctcggcctggtgccgcttggcggaaccgacggccggggacgagccgtgcggccgcgagatgcggcgcaggcgctcgccgtgcgggacgtcggcgccgaccgccaggtccaggtggtcgatcaggttgagcgcgatgaacggccaagcgccctggttcgccggctcctcctgggcccacaggtacttctcggcgttcgggtacttggcgatctccgcctggagctcggcacccggcagcgggtacaggcgctcgatgcggatgatggccgtgtccgtcaggccgcgcttcttccgctcggcgtcgaggtcgtagtagaccttgccggccgtgaagacgaccttcttgacggcggccgggtcgaccgagtcgtcgccgatgaccgggcggaactggcccgtcgtgaactcctccgccttcgaggccgccgccttgaggcgcagcatcgacttcggggtgaagaccaccagcggcttgtggtgcgggttgtgcacctgccaccgcaggaggtggaagtagttcgacggcagggtcggcatcgcgaccgtcatgttgttctgcgcgcacagctggaggaagcgctccgggcgggccgaggagtggtccgggccctggccctcgtagccgtgcggcaggagcagggtgacgccggaggtctggttccacttctgctcggccgacgagatgaactcgtccacgaccgtctgcgcgccgttgacgaagtcgccgaactgcgcctcccacatcaccagcgcgtccgggcgggccagcgagtagccgtactcgaagcccatcaccgcgtactcggagaggagggagttgtagacgttgtaccgggcctggtcctcggacaggtacagcagcggggtgaactcgtcgcccgtctcacggtcgatgacgaccgcgtggcgctggccgaaggtgccgcgctgcgagtcctggccggtcagccggaccggcacgccgtccagcaggagggagccgacggcgagggtctcgcccatgccccagtcgatcgtgccgtcctcgaccatcgccgcgcggcgctgcaactgcggcagcagccgcgggtgcacggtgatgtggtcggggatgttgacctgggactcggcgatgcgcttgacggtctcggcggtgatcgcggtgttcacggcgaccgggaactccgcctgcggctccgagggctccgccgacgccggctgcgagacggcctcgcggacctcggtgaagaccttctccagctggccctggtagtcctggagcgcctgctcggcctcttccagggtgatgtcgccgcgaccgatgagggactcggtgtacagcttgcgcaccgagcgcttcttgtcgatcaggtcgtacatcagcggctgggtgaaggccgggttgtcggtctcgttgtgaccgcggcggcggtagcagatgaggtcgatcaccacgtccttgttgaacgcctggcggaactcgaaggccagccgggcaacgcggacgacggcctcggggtcgtcgccgttcacgtggaagatcggggcctcgatcatgcgggccacgtcggtggcgtacatcgaggagcgcgaggactccggggcggcggtgaagccgacctggttgttgatgacgacgtggaccgtgccgccggtgcggtagccgcgcagctgcgacatgttcagggtctcggccaccacgccctggcccgcgaaggccgcgtcgccgtggatcgccaccggcaggaccgtgaagtccgtgccgcccttgttgatgatgtcctgcttggcgcgcgagacgccctccaggaccgggtccaccgcctccaggtgcgaggggttggcgaccagcgagaccttgatctgctcgccgtccagaccggtgaaggtgccctcggcgcccaggtggtacttcacgtcgccggagccgtgcatcgacttcgggtcgagattgccctcgaactcgcggaagatctgcgcgtacgacttgccgaccacgttggccagcacgttcagccggccgcggtgggccatgccgatgacgacctcgtccaggcgggactcggccgccgagtcgatgaccgcgtcgagcagcgggatgacggactcgccgccctccagggagaaccgcttctggccgacgtacttggtctggaggaaggtctcgaacgcctcggcggcgttcagccggcgcaggatgcgcagctgctcctcgcgctccggcttggtgtgcgagcgctcgatgcggtcctggatccacttgcgctgcttcgggtcctggatgtgcatgaactcgacgccggtggtgcggcagtacgagtcgcgcagcacgccgaggatgtcgcgcagcttcatcagggacttgccggcgaagccgccgaccgcgaactcgcgctccaggtcccacagggtgagcccgtgctcggtgatgtccaggtcggggtgcttgcgctgctggtactccagcgggtcggtgtcggccatgacgtggccgcgcacccggtaggagtggatcagctcgaagacgcgggcggccttggtgacgtcgtcgtcgtgcgaggcgtcgatgtccttgagccagcggaccggctcgtaggggatgcgcagcgccttgaagatgtcgtcgtagaagccgttctcgcccagcagcaggttggcgacctggcgcaggaactcgccggaggcggcgccctggatgacccggtggtcgtaggtcgacgtgagcgtcatgaccttcgagatgccgagcttgttcagggtgtcctggctggtgccctggaactccgccgggtagtccatggagccgacgcccaggatgaccgactggccgggcatcaggcgcggcacggagtggacggtgccgaggccgccggggttggtcagggagaccgtgacgccggtgaagtcgtccatcgtcagcttgttgtcgcgggcgcgacggacgatgtcctcgtaggcctgccagaactcgaagaagttcagcgtctcggccttcttgatcgccgcgacgaccagctggcggtcgccgttgggcttgaccaggtcgatggcgaggccgaggttgatgtgggccggcttgaccagggtcggcttgccgtccttctcgccgaacgagtggttcatcgtcggcatggccttgatggcctgcaccatcgcgtagccgatcaggtgcgtgaaggagatcttcccgccccgggcgcgcttgaggtggttgttgatgacgatgcggttgtcgaacagcagcttcaccgggaccgcgcgcacggacgtggccgtgggcagctccagcgaggcgttcatgttcttcgcgaccgcggcggccgggccgcgcagggtcaccagctcggggccctcgggggcggcgccggcgtccttggcgggcgcggcggccttcgcctgcggcttggcggccggcttggccggcgcggcggcgggcttggtggccggagcggccggagccgcgggggcggcggcggcgggcttcgcgggggcgggcgccggggcggcggcctgcggctgcgccggggcctgcgcccgcggggcgggggcggccggtggcgtgctgccggcgtccgtgggcacggtgccggcggcggtcggggtcgccgccgctccgggcttgtagtcggcgaagaagtcccaccaggctcggtccacggagttcgggtcctggaggtactgctgatagatctcgtcgacgagccactcattggcaccgaacgcggccgcggggttctttcccgcggtgcccgcttggtcggtgtcggtcgagatgctcgagttactgggggactgtggcgacacggcgagaaccgccctccttccgcttcttcacaagatggtggacagcgggaatcaaggctacgcctaccgaccccggaaggtcagaccgggcccgttcatcgtcgcgtaagtcacattgcagaccgcgtttcggcgctggaaatggcgggaaacaaccgaggttctgccgcgtgagggatcgggagaccgtgacccggcgcctcgaaaacgcggggccgtgcctgatcacacgtgtctgccagcgcggacgcagtggatcttgacgctccgcttcgaaccctacgtcaaccggacgtcgacggcaggcccggaagagtgatgaggatgcggcagccccgctcggattcggccaccccgatccggccgccgtgcagatccaccgcccagcgcgcgatcgcgaggcccaggccggtgcccccgtcgctgcccggaccgtgcggccgcgacaccgaaccccggttgaaccgctcgaacacccggcgccactccgagcgcgggatgccgggcccttcgtcgagaacctccagctcaagcgattccggcagctcgccgcgccgcgcccggaccgtcacccggccgtgcggcgggctgtgcttgacggcgttgtcgatcaggttggcgacgacctggtggatgcgctcggggtcggcgtgcgcggtcagctccggcgggaagacgtccagggccaggtgcacgtcggtgcgggagtggctgccggaccccgaggcgatgcccgcgcgcgcggaggcgaccatgttggcctccttcagcacgcccgacaggtacggccacacctcgaagcggcgcttgcgcagcggtatgacgccgttgtccaggcgggagaggtcgagcagcgtctccaccagccggccgagccgctcggtctgcccgagcgccgtgcgcatggtctccgggtcggcctcggtgacgccgtcgacgatgttctccagcaccgcgcgcaggcccgcgatcggggtgcgcagctcgtgcgagacgttcgccaccagctccttgcgctggaggtcctgggcctccaggtcgtcggccatgcggttgatggtgacggccaggtcgcccagctcgtcgcggcggttctcgcgcacccggcgggtgtagtcgccgtgcgagatggaccgggccaccgcgttcatctcgtccagcggggcggtcagcgagtgcgccacgaactgcgtgatcagcagcgtggcgatcatcgagaagaccgtgatgaaccgcagctccgtcttggtgtgcaccgctatcaccgacaggccggtggtgatcagcaccgacgtgacgaccagcgcgcccagcttggtcttgatcgagaacgggcgcacgccgccccagggctccccggtggtccgagggccggggttcctccgtgcggcttcccgtcctctgctgctcatggcgtcggcgtctccaaggcgtagcccacgccgtgcacggtacggatgcgctcggcgccgatcttccggcgcagcgccttgatgtggctgtccacggtccgggtgccggaggcgtccgcccagtcccacacctcggcgagcagctgctcgcgggagagcaccgcgcgcggggtgttcgccaggcagaccagcaggtcgaactcggtcggcgtgaggtggacgtcctcgctgcgcacccgcacccggcgctgcgcgtggtcgatctccagctcgcccaggcgcaggatgccgctgcgcggcgtggaggcggccaccacggcccgctccacccgccgcagcagcacgtgcacgcgggcggccagctcgcgcatcgagaacggcttggtcatgtagtcgtcggcgcccacgccgaggccgaccagcatgtccgtctcgtcgtcgcgcgcggtgagcatcagcaccggcaccggccgctgggcctgcacgcgccggcagacctccaggccgtcgaagccgggcagcatgatgtcgaggatcagcaggtcgggctgccaagcctcggccgtgtcgacggcggacggaccgtcgcccgccgtttgcaccaggaatccctcggcgcgcagacgggtcgcgatggcgtccacgatcgtctgatcgtcctcgaccaccagcacccggcgctgggcgccctgggtggccgtgccgttgtgggaggtctgtgtctgctccatcgcccgcccctgaggtgtgctttccggaatccgtggggtgatcccatgactgcgcttgacgcttgaatgatccgcgtcagggcagcagcgtacggggagtcaccgcgcctttgctatccaggcccgacgccgatgtgcacgacgtccggaacgccccgggcaacggggatctcttcggtacgcacctgttggaaaccggcattacgcaaggtttcttcgaattccggagagggctgcgcggaccatacggcgagcaccccgccgggcctcaacagccgtgcgcagcccgccagtccggacggcgcgtacagcccgtcgttgccctcggtgacggtccagccggggccgttgtcgatgtccaggcacagggcgtcgtacgtgtcggatgtctcattgacgtactcgaccaggtccgcctcgacgatctccgcgcgcgggtcggccagcgcgtcggcggagagcgcggccagcggtccggtgcggtgccagtcgatgatggcgccctcgcgctcgacgaccgcgatccggccccagcgggggtcggcggccgcgtgcgcgagggagaagccgaccccgagaccgccgatgagcaggtgcggagcggtccgtccgccggaggcggccagcgcgtcggccgccgcgtcgaccaggcgccgctccgaacgcccgtcggaggtgtccatcaggaagcagccgttcgcgatgatctggagcaacgtcccgtgccggcgcaggaccacctcgccatacggaccctcgcggcggtccagcacctcgggggcctcggcggcctcgggggagtcgtgggtagtgaggggcatcggcccatcctggcacccgctccggcggaggaatgcgggccggtacggcggtgctgtcccgagaggcgggaaatgcccccggtacttgatcgctcacagcgaacagggcttggggaacaatcccgggctccctttcattgagtcgatgtaactcaacttgactgccgaaggggagatcatggctgctgagtccgccgccttcacaccgctcaccctgcccgtgctgccgctcgacgacgaagtggtcctgcccggcatggtcgtccccctggacctgagcgacgccgaggtacgggccgcggtggaggccgcccaggccgccgccaggtccgagcccggcaagccccgcgtcctcctcgtcccgcgcatcgacggcacgcacgccgccaccggcgtgctcggcacggtcgagcaggtcggccgcctggccgacggcgacccgggcgccctgatccgcggccggggccgggtgcgcatcggcgccggcaccaccggcccgggcgccgcgctctgggtcgagggcacccgggtcgacgagaccgttcccgatccgctgcccggccaggtcgccgagctggtgaaggagtacaaggcgctcgccaccgcctggctgcgcaagcgcggcgcctggcaggtcgtcgaccgggtccaggccatcgacgacgtgtccgcgctcgccgacaactccggctactcgccgttcctgaccaccgagcagaaggtcgaactgctggagaccaccgacccggtcgcccgcctgaagatcgccacccagcagctgcgcgaccacctcgccgagcaggacgtcgccgagaccatcgccaaggacgtccaggagggcgtcgacaagcagcagcgcgagttcctgctgcgccgccagctcgaagccgtccgcaaggagctgcgcgagatcaacggcgagcaggagggcgaggagtccgacgactaccgcgcccgggtcgaggccgccgacctgcccgagaaggtccgcgaggccgcgctcaaggaggtcgacaagctggagcggtcctccgaccagtcgcccgagggctcctggatccgcacctggctcgacacggtcctggagatgccgtggagcgagcgcaccgaggacgcctacgacatccagggcgcccaggccgtgctcgacgccgagcacgcgggcctggaggacgtgaaggagcgcatcaccgagtacctggccgtgcgcaagcggcgcggtgaccggggcctcggcgtggtcggcggccggcgcggcggtgccgtactggccctggtcggcccgcccggcgtcggcaagaccagcctcggcgagtccgtcgcccacgcgatgggccgcaagttcgtccgcgtcgccctcggcggcgtccgcgacgaggccgagatccgcggccaccggcggacgtacgtcggcgcgctgcccggccggatcgtgcgggcgatcaaggaggcggggtccatgaacccggtcgtcctgctcgacgagatcgacaaggtgggctccgacttccggggcgacccggccgccgccctgctggaggtcctcgacccggcccagaaccacaccttccgggaccactacctggaggtcgagctggacctgtccgacgtcgtcttcctcgccaccgccaacgtcctggaggccatcccggaggccctgctcgaccgcatggagctggtccgcctggacggctacacggaggacgagaaggtcgtcatcgcccgggaccacctgctcccgcgccagctggagcgggccggactggacgacgacgaggtcaccgtcgacgagggcgcgctgcgcaagctggcgggcgagtacacccgcgaggcgggcgtgcgcaccctggagcggtccatcgcgcggctgctgcgcaaggtggcggcccagcacgaactgggcgagcgggagctgccgttcaccgtcaccgagggcgacctgcgctcgctgatcggacggccgcaccacgtgccggagtcggcccaggacccggccgagcggcgcaccgcggtgcccggcgtggccaccggcctcgcggtcaccggcgcgggcggcgacgtcctgtacgtggaggcctcgctggccgacccggagaccggcgcggcgggactgaccctgaccggtcagctgggcgacgtgatgaaggagtcggcgcagatcgcgctgagcttcctgcgcagtcacggcgccgagctggagctgccggtgggggacctcaaggaccggggagcgcacatccacttcccggcgggcgcggtccccaaggacggtccgagcgccggcgtcaccatgaccacggccctcgcctcgctcctgtccggccggctggtccgcaccgacgtggcgatgaccggagaggtctcgctgaccgggcgggtgctgccgatcggcggggtcaagcagaagctgctcgccgcgcaccgggcggggatcaccacggtgatcatccccaagcgcaacgaaccggacctggacgacgtcccggcccaggtgctggacaagctcgacgtccacgccgtcaccgacgtccgccaggtcctggagctggcgctcgcaccggcgaccaacggtgcggagcgtgaggttccggtcgcagcgtgacggacgcggccggatgaggcagggcccgggtcccgtgagggggcccgggccttcgcccgtgggcgaggaggagccgtcagccgttggccagcgcgacgacgcggtccagcgcaccgttgaacttgttgtgatcgccgaccgtcggaccggacgacgtgtactgccacatcgtgtagtagccccagccggccggcagcgtgcccaccgtcgaggcgtaccgggcgatccacagcgggttgctggcggcgaagccgccgtagttgccggtgcactgggtccaccagctggtggccgtgtagatcacggcgtcccggccggtacgggccttgtaggtgttcaggaagtcgcggatccaggagaccatcccgctctgcgacttgccgtagcaggtggccccgtacgggttccactcgatgtcgagcgcgcccggcagcgtcttgccgtccctggaccagccgccgccgtggtcgacgaagtagttggcctgggtcgcgccgctcgtcgtgtccggcgtggcgaagtggtaggcgccccggatcatgccgacgttgtaggagccgttgtactgctgggcgaagtaggggttcgtgtagtacgtcccctcggtggccttggcgtaggcccatttgacgccgctgttccacagggtcgaccaggcgacgttgccctggtggctggagacgtcgacgccctccgtctgggccgcgcggcccgggacgggggtgccgtgttcgccgtcgtgggccgcgacgcccatgcccatgtgggcggagccgcgggccgggacgtccgcggcggacgcggcgtcggcgggaagggtgaacacgagggagaacgcggcgagcaggatcccggtgacggcgaaccgccgtccgcgggccgatccggatctgtgcacgagcatgacgtgcctccgatggctcggtggtgctccgtgggggatgcgcgagtggggagaacccctggatggtgtacggatggcgtgcgcatgccatccggaggtccggtgaagactctacgcacgtagaaacggcgggtggaagaggaccgggagccgccgttggtctaagcctgcgaaatacttggcgagctgcggcgatggcggcccgtggcggaaactttcaggaccggaaaatcgaggcaggggctgacgtgcacgaagacgggaacggcggcggtcgcgggggcgaatcccacctgtccggcagtggtgtgaaccaaccggagttcctggccctggagcgggagctgaccgtcctgctgcggcgggcccgggccaaccagggcgagatggcccgggaggtccaccccgacctggagtcgtccgcgtacggcctgctcgtgcggctcggcgagtgcggcggccagcgcgccaccgacctcgccgccttcatcggcgtcggcaaggccaccatgtcccgccagctgcgcgcgctggaggaactcgggctcgtcgcccgtgagcccgaccccgccgacggccgggcctggctggtcaccctgaccccggagggccaggaacgcgtcggccgggtccgggaggcccgccgcgcccggtatgcccggcggctcgccggctgggacccgcgcgaggtgacggaactggcccggctgctgcacgaactcaaccgggggatggagaagtagtaccggcgccgtccgtccgtctcacaactcggcgtagaccaccgtcgcgtcgtcgtgcgtcttgctgcgcccgagaaacgcccggccgtcggccgcgtccgcgcgctccagctcccgcacccggtccaccagggcctgcgcgccctgcttgcggaccagcgccaggcagtccgcccagtcgccctccccgaacttctccacccaccgcgcggccccgtccgtgagcgccgccagcgtccgcaccgcaccgcgcgggagcacccccgtcacggcgcgcgccgccacggcggggtcggccgcggccgtgaagaagccgccctccttgttgcgcagcccggcgtcgatcaccgcgtcgctcacgagggccgagcggggcagccgggccagccggtcgtccaggacgggggtgagggtgccgtcgggagcctccagcaggagggcggagtcggacaggaccaggtactcgaaggcggccgcggaccagcgcgccaggaccacggttgcctgcggcgtgcgcgggtgagaaaggtcacaggtttccgcgtgcgccgcggcggtacgcgcgatgccgcgggacagggcctcggcgaggggaagatccgggagtgaaacggtcagttcggtcagcgctccaccgaggcgcgcggtgaaccagggcacggaatgcagacagcccgtcgcggtccgtggcggcgtcacaccgtcgaggacgacgagtgaaccaccctgtcccgaggcgggtagtccgacgctcgcgaagtcctcgttgggctggtcggcgaggcctggttccgagacgagttccgtacgcatccggccagtctgcacgagcccttcacagcgttcgcaaaaggctggcaccttcctcgggttctcccggaatcgaggcggcgacgcaggtcaggcgccggatttgggatggaattccaagatccgtcggtgcgtggcggcacatagtgccaccgcccgtcgcagacgtccaaccggctcgccgggctaccgtgcggcatgcgccgggggaacttgctcctcaactcccctccggggttcactccttcgggtggcgggtcggacgatgcgcgctcaccgtccaccggcactgggagggtcgggaaccggtggggggactgccccgctcacgcggtttccccgcccgacgcgcggccgcggccggggaacagcccagcgcccggcagtgggtgcacgcgcccccggccggccagttgacggagcgccacccgggcccacgggtacacgagtcaggaatgcgagcaccggtgcagaagacgcggcctcgtcgcacaggcaagcagacggcccccgtggggagcgcggagcgcacccccggtacctccacccctccgcagccgccggaggctcccgtcggcaagggccgtgccacccacgtacgcaaccgcctcatcgtcgcggtggccgtcgtggccgccgccgtcgccggggccggagccccctcggtcgtggccgcctccgggcaactgcacgactcccaggaactggtgacgctcgccgagcagacccagggcgcgctgaccctcgcccactccctggccgacgagcgcgacgaggtcaccccctacatcgcggccggccgccccaagtcgaaggcgccctccgagcagcgcagcgcccgcgtcgaccgccaggtggaggagctgcgcgccgacaccgacacgcccgcctccctgcgcgaggacctcgacgccgtcgccgcgctgcgccgcgccgccctcaccggcaagagcaccgcgctggaggcccaccaggcgtactcggaggcgatcaccgaactccacgccctggccgagaagctgggcgaggagatgccgccccgcgcgggctccggcgcgtacgccctcgccgagctggacaccgccgtccagcaggccgccgccacccgcggcctgctgctggcggccctgaacgtgccgagcaccaccgagaccgtcatcgacccggtcaccggcctgccgaccgagacgaccacctcctcggacgccgacgccgagcagcgcgacgccctcgccgccgccgcccagcaggcccgggtgcgctccgacgcggccctcgccgacttccgcgagggcgctcccaaggaggcgcgcggcagcttcgacgccacggtcgccggtcccgaggtcaactccgccgagaagtacctcgccggcctcaccgacgagccgacgctctccgaccgcgacctcggcaccagtaccaagcggctggacgcggcgctctccgcccgcgtcgacgcgatgcgcggtgccgagtccgccctgtacgagaagcgcgtcgcggccctggagcagttgcgcgacgacgacgtcaccgcgctggagatccggatcgccgtcctcggcgccctgatcctgctcgccgtcggtatcgccaccgccctggcccgcaccctcacccgcccgctgtcggtgctgcgccgcggctcggcccggctggccggcgcggcggacccgacgaccgaggagccggtcgccttcaccggccgcaacgacgagttcgcgcaggtcgtccgctccgtcaacgccctgcacacgcacgccgccacgctcgccggacgggtcgccacgctggagtccgaccgcaagcacctggtcggccagcggcagaagatggccgacgcccgcgaggaactgcgcaccgaactcgccgagtccgccgcccagctggaggtggtgcgcaagagcatcggctccaccttcgtcagcctcgcactgcgcaccctcggcctggtcgagcggcaactcgcggtcatcgagagcctggaggagcgcgagcaggacccggaccgcctcgccaccctgttcaagctcgaccacttcgccacggtcatgcgccggcacagcgagaacctcctcgtcctcgccggcaccgagcacgtccagcacagcgcctcgccggtgccgctggtcgacgtggtccgcgccgcggtcagcgagatcgagcggtacgagcgggtgcgcatcgccgcgctgccgccgcacgcccatgtggccgggttcgccgccgacgacctctcccacctgctggccgagctgatggagaacgccacctccttctcgccgccggacctgcccgtcgaggtctccggctggctcctggagaacggcgaggtgatgctctccgttcaggacgagggcatcggcatggccaccgaacgtctccagcggctcaacgcccgcctcaccgacttcgacccggacgcgccgtacgaccaggagggcgaggacggtctggggctcggcctctacgtcgtcgcccggctcgcccaccggcacggggcgcgggtacggctgcgggagcagaagcagggcggcgtcgctgccgtcgtcgtcctgccgagcccgctgctggccgccgccccgccggccgcgctggccccgaccgtgccggtgtccgacggcaccggcaccttctccctgcccggcgccgacgcggaggccaactccaacgtcctgcacgggcggacggagaagtccgaggcggcggagaagtccgagacggccgagagggctgggacggccgagaaggccgagaaggctgggacggcggggaagtcggagacggcggagcaaggtgccggggaggacgcgggccccggtgccgagccggtcatcgacccgctggtcgcctcggcggaggaagccgtacgccgtgccgaggcggacgcgtcccacgcggacgcgccgcagactccggaacccgacgagcgcgaagacccggccgggccggtgcccccggaacccgcgagggagacggtgtccgcccaggacggtcccgcccccggcagcgacctccccgacgacgccacgatggccctgttcctcccggccctcgcggaaccggagacccggccggagaccgaccccggcccgtacgccatcggacccgacgcccacgaccgcgtaccggacacggcggaggagaccggcgggcagcaggaaccggccccgtccacgcgggccgaaccggtcaccgacaagggcctgcccaagcggaccccgaagctcaccaccccggccgcggtgccgcgtccgcgcacctcgggttccgtcgacgccgacgcgctccgccggcggctgggcggattccgccgcggcgcggaggccggccgccgggacgtcgaggcggagatcgccgaccgccccgggcaggaccaggcgccggacaccggggcgggcacaaccgaagaagccacggggggcaccgtcgaggaggcaagcagttgaccgctcccagtacgttcggactgagcagtgaagcccgcaatctccactggctgctgaccaacctcgtcgaggaggtgcccggcatccggtcggtcgccgtggtctcctccgacgggctcctgctcctgtcctcggaccccggccgcaacgaggaggcccggcaggcccgcgagacgccccgggcgggcccgcgcggctccgcggccgacctcgccaccgtcgtctccggcgtgggcagcctgaccgtcggcgccgcccggctgatggacttcggcccggtgaagcacacgatggtcgccatggacgagggcagcctgttcgtgatgtcgatcagcgacggatcgctgctcggcgtgcacggctcggcggagtgcgacatgagcgtcgtggcgtaccacatggcgctcttcgtcggccgcgccggccacgtcctgacccccgaactccgcaccgagctgcggaagtccctggagtccgagtcgtccgagtcgtccgtgtcgtccgagccgacggggagcgcccgatgagcagcagtcccggaaaacccggcactaacggccggggcaacctccccgtccgcggcgccgaccgcaaaccggcccgcgtacgcccctactcgctcaccggcggccgcacccgcttcggtcacgtgctgctcgtcgagacgttcgtcggcgccaccgccggcaccgccgcgctcgaagccgccgaggagcgcagggaactgacgaacggcggtctcacctcccgcgtgatgccggagatgcgggccatcgtcgaactgtgccgccggatgcgtacggtggccgagatcgccgcgctgctgaagatgccgctcggcgtcgtccgggtgctcctcagcgacctggcggaccagggaaagatccgtgtgtacggcaccgggaccggccacggcacgggccgcccggaccgcgctctgctcgaaagggtgctcagtggactccgtcgtctctgacgccgccgcgttcggcgtccccccgctcgtcgacaccgacgggcccgtgcagccctggcagaccgatcccacccgcgcgccggtcgccacgaagatcgtcgtcgcgggaggtttcggggtcggcaagaccacgctggtcaccgccgtctcggagatcacgcccctgcagaccgaggcgctgatgaccgaggcgagcgaggagaccgacgacctcaccgccaccccgggcaagctcaccaccaccgtggccatggacttcggccgcatcacgctcgacgacgacctggtgctctacctgttcggcacgccgggccagcagcggttctggttcatgtgggacgacctggtgcgcggcgcgatcggcgccgtcgtcctggccgacacccggcggctgaaggactgctggccggccctcgactacttcgagagctgcggactgccctacgtcgtcgcggtcaaccacttcgacggcagcgagctgttcgaggcggaggacgtgcgggaggcgctgacgatcccggcgcacatacctgtcatgatcatggacgcgcgccgtcggatctcggccatcgagaccctcttgtccctcgtgggtcacgcgctcgacgaaacccccgagtagacgaacccccgaccagacgccctcgaccagacgccctcgaccaggagacggaaaccgcatgcggaagatactcgtcgtcggagccggccagtccggcctccagctcgccctcggcctgcagtcgcacggctacgaggtcaccctgatgtccaaccggaccgcggacgagatccgcaccggccgggtcatgtcgacgcagtgcatgttccacacggcactccagcacgagcgcgatctccaactgaacttctgggagtcccaggccccgaagatcgagggactcggcgtctcggtggcggcccccggctccttcgacccgggcccctcgcagcgcgcgatcgactggctcggacacctcgacggcttcgcgcagtcggtcgaccagcgggtgaagatggccggctggatggagaccttcgcccagcgcggcggccagctggtcatccacggcgcggccgtcggcgacctcgactacttctcccgcgcctacgacctcgtcctggtctcggcgggcaagggcgaactggtgcagatgttcggccgcgacgcggagcggtcgccgtacagcgagccgcagcgcgccctcgccgtcgcctacgtccacgggatgggcccgcgccccgagcacccggagacggaggccgtgcgctgcaacctggtgcccggcgtcggcgagatgttcatcatgccgacgttcaccacctccggccgcgccgacatcctgttctgggagggcatacccggcggcccgctggacgccttcaaggacgtcaaggaccctgcggagcacctctccctgaccctggaactcatggagaagttcctcccctgggagtacgcgcgggccaccaaggtcgaactgaccgacgccggcggcaccctcgccgggcggtacgcccccaccgtccgcaacccggtcggccgcctccccggcggcggcgcggtcctcggcgtcgccgacgtggtcgtcgccaacgacccgatcaccggccagggctccaactccgcgtccaagtgcgccgcctcctacctcgcctcgatcatcgagcacggcgaccaggagttcgacgagacctggatgcggcagaccttcgaccgctactgggagacggcgcagcacgtcaccaagtggaccaacaccatgctggccccgccgccggagcacatcctcaacctgttcggcgcggcgacgcagctccagcccatcgccgaccgtttcgccaacggcttcaacgacccgtcggacttcgagaacttcttctacgacccggcgaagaccgagggctacctggccgaggtctcgggcgccgcgggcgcgtaggaggccgcgtacccctcgtcggacccgttcgtcgccccggcgggaagcctcggcggcgtgtagcgcaataccggctccccgccggggtcggggcgtacggcgcccaggaccgggttggcggcgatcggcgacaccttgacgtcggcgccggggcgcggtgcctggacgaccatgccgtcaccgaggtacatcgccacgtgggtggcctcggggaagtacacgaccaggtcgccggggcgcagctcgtccagcggcacgtggtcgaggcgggcccactgctcctggctggtgcgcgggatcggcgtcccggcccgctcccaggccaccgaggtcagccccgagcagtcgtacgacgccgggccctcggcgccccactggtacggcttgccgagctgctccaccgcgaagcgcaccgcactctcgcccccggcggacggcttggcgtcgtcgccgagcgcgccggacgccaggaaccgctcctgctcctcggcgatcccgctcttctccagctccgccagggcggccagctgctccggggtgagggaggcgagcagctcctcgacggcgcgcaggcgttcgcgcacgccgtcccgttccctctcctggcgctcggcgagggcggcctgccgggccagggccgcgcgggcccgcccggccagctcgtcggccttcttcgtgtcgccggtcagccgccccaccgtctcggcccgctcctcggacagcctgccgatcacatgcccctggtcgagcgcgtgctgcgggtcgcgggcgagcagcagccgcagatagggggagaagtcgctgctgttctggtactgctgccgggccagccgcccggccgcgcctcggctgtcccgcagcgacagccgggtccgggtcagctccgcgttcagccgcagcacccgggcgcgctgccgcttcagccgctcctcggtgccgttgtaggtctcggtggcccgctccgcctcccggtacagccgctggaggtccgtcagcagtccggccacggtacggtcgccggccgccccctcggccggtccgggtccgggtccgggtccggccgcggcgggcacgggcgcgaggacgatcccggccgtgagcgccgccgtacacaccagacgcagcagccttcctgacacgccatcacctccgctgcggggcggcgggtccgctccgcacggtgagcatgtggcgggtcggcgggcttcgcgcgccgagtgtgcgcggatcggcgcaacggggtcacccgtccgcgtcgtccggcttgccacccggcgtggcgtctggctcggcggccgacggacgctccggtttcgaccagggccacttccggccggagcccttcgccccctcgggggcgtacgcgtacttccagcgggcgaaccgcagcccgccccgggagtcgcggggcacgcgccggtagacgagcaccgtgggcgggccgccgtccgggtccggcacggggatgcggtacgtcttcggggggtgcccggtcatgccgaccaggacgggcagcacgcggccgtccatggggccgccctcgaagggggtgtcttcgctcttcacggctccagtgtcggtgatcggggcccgggtgccggaagccgtcgtccccctgtcgggccgccgcccggtgtcagaggtccgccgccagcgtctcgaccagcgccgcgctctgcgggtcgcggcgggcggtgaccgtcagtacggcgaggaactgctccaccagccagtcccgcagctcgtcgaagggcggctgcttgtcctcgtccagccagatcagcgaggccgcctccaccgccgtgatccacatccggacggtcatccgcagccgggggccgggctcggcgacgtccaggtggcgcatgatgtggtcggcggcggcccggcgtacgccgtccacgatgcccgaggtctgcgaggtctcgaccacgctgccgccgcgcagcagggcgctgaagccggtgtcgtgctcgtcgacgaaggtgaggtagcggtccagggcgcgggagagccgggccagcagcgggcccttgcggggttcgtcgaagcagagccgcagctcgtcggcggcggagctgagcgcggcctcgtacagctgctgcttgccgccggggaagtaccggtacaccagcggccgcgagacccccgcctgctcggcgacgtcgtccagggagacctcctccgggggccggtgcgcgaagagggcgagcgccgcgtccagcaactggacgcggcgctcctccacgctgaggcggcggtaggcgggggtgggggcctgcggggtcatgaaccgcagcgtaacccgcacgaccgggcatccacccacgtcggcgaggcggaccggccgaaccagggcctgtccggcggatcatgccgcagacgcggggtctggcacgcccatctgcggcgttgtcgtcggttgccgactcccccacgctcgactgcgctcgcgcggggggacccccatcgcgtcgacgccctcctccgccttgcagctgcacgcaccagaccccgctcaccagcgacaatgaggtgccgtgtctttcctgcgacctgatccgccggacaggccctaggtcgtgtccgtaaagtgctgtggtcgttggtctgttcgtggtgcgtcgtcatgagctgactgatgagtcgtgggcggtgatcgagccgtttctggctccgccgcggatgggtcgtccggtgcgggatcgccggcaggtggtcaacgggatcctgtggaaactgtccaccggggctgcctggcgggacctgcccgagcggtatggcccgtggaagacggtctatgaacgtttccgccgctggtctgccgacggcacctgggaccgcctcctggcccacgtccagcagcactcggacgcggccggtgcggtcgactggaccgttgtctgcgtggactcaacgaccgtgcgggcccatcagcatgccgcgggagcccgaaaaaggggcaggactggccgggcgaggcactcggccggtcccgcggcgggctgaccacaaagatccacctcgcctgcgacggtgaaggccgccccctggccttcaccctcaccgccggcaacgtcaacgactgcacccagttcgagcaggtcatggcccgcatccgcattcagcggtgcggacccggcagacccagaaccaggcccgagcgggtcgcggcggacaagggctactcgtccacgaagatccgcacctacctgcgacgtcgcggcatcaaggcggcgattcccgagcgcatcgaccagatcaacggccgcatccgcaggggcgagagcctctgccgactcgaccgggcggcctaccggcgacgcaacgtcgtcgagcgctgcttcaacaagctcaagcacaacaaagccctggccacccgctacgacaaacgcgcccgtcactaccaggccctggtcaccctggcctgcctcaaactctggctaccctgactttgcggacacgacctaggccagcaggcccgaggaccgccacagcttgcggccggcgccgcgcaggacgccgatgtcgtccaggaagtcggtcaggcgcttcgcgccggtctgcatgatctccttgcggtggccactggcccggacctgggccagggcctcccgcttgtccaggccgacgttcgtgtagacctcggggttgatgaaggccttggagaagacgcgggcgaactcgccggaggtgacccgggtgaactcctgcgaccacttcggggccgtcaccatctgccggcgcagctcctcacgggcgtaccgcacgtgccgggcctcctccacgacgtggatgcgcgtgacgccccggatcagcggctggacccgctcgtccgggaaggtcaggcgctgcatccagtccaggacctcctcgccgagcagcgtggcggtgaaggagccgggcgtggtggagatcgtcttgaacaggcgccccaggtgctggtggaccgggctcaccggataccacggggtctccccgcgcgatatcagccgggcgaacatcttcgagtgccggcactcgtcctcgatctcggtcagcgcgtagcgcacgtgggcgctcgtcgccgccttgtcgtagatgtgccgcaccaggagctgcatcaggatcagctcgaaccagatgccgagcgaggcgagcgcggcggcctcgtgctgggagagcgcgatgcgctgctcctcgctcatccgctgccacatcggcgtgtcgtacagcgacaccagctccggcggccagaaccacttgccgtcctcgaacggcgcgtcccagtccagctccttgtccgggtcgaaggagtgcttggcggacgagtcgagcagccgttcggccacctgctcccggtccttgagcaggccgagcgcgtcgcgcaggccctcgagcgcgtcggcttccgtcagggtcgtcatggctgtgtcccacctcgtcgaacggatcgtgttacccgcggtcactccagcttgctccgtcttatgagactgcgtgtcagtaagctcgtcaatcccctgcgcggaacttgttgaccgcgagtaaagaagtgagaggtgttcaggtcctcagaccgagcagtccagcccctccggcacctcgcccgggaccggctccgacgccccggccgggtaggacgtccgcagggtgaaggcgtacggcgtggggccgtgggtgcgcaggtggcgcaggcgggactccgcctccgcgaccgtcgggcggtggcccgcgggcacccaccacagggcggtgacggcctccgccggccgctcgaaccactcgcgccgccgggccagcatctcccggtgccgcccctggtacatgaacgccgtcagggcgtccgcgtcccgccacatggtcaggttgacgatcagccaggagtccccgaagaccgggatgtcggtggcgtcgccgccctcgctctggagccgccacacgaagccgtccgccgcgtcggccgcggcgttcaccggttcgagcgcgtccacgaagtccttcaactgcggtgagtccagcggggccttgaggcgggcgatgttgacctgggcgagttcgtgcacggcgtcttcagtcatgtaccgaacgttaggtcgggagcttcggccggcggtacccccgtctcatcccccgagcaccgcctccatcaccgcacgcgcgatcggcgccgccagcccgcctccgctgaccccctgccggtccgacgccgtgccctcgaccaccaccgccaccgcgaccttcggctcgatgtccccggcgccccgcgcccaggagatgaaccacgcgtacggcgtgcccgagttgccgacgccgtgctgggcggtgccggtcttgccgccgacggtggcgccggggatcgccgccttcgcgccggtgcccttgtccaccacgccggtcatcagctccttgagcagcgcggccgtcgaggggcgcatcacctcgcgggagggccgggacccggccgccgccaccaggctgccgcccgcccgcagcgtccgctccaccaggtacggcgagcgcacctggccgccgcccgccaccgccgccgccaccgtcgccatctgcagcggcgtcgcccgggtgttgtactggccgatcgacgacaggccgagctgcgcccggtccacgctggtgtcgaaggtgctccgtgcgacggggaaggggacccgcagtccgtcgtcgttgaagccgaaggcctccgccatcgccgtcatgccgcgcacgcccacgtccacgccgagcttggcgaacaccgtgttgcaggaccactcgaacgcctcccgcagcgaggcgttccggcacccgtcggcctcgttcgtgagcttcgtccgcgtcccgggcagggtgtacgggtcgggggagcgggtcggcgcgtccaggtcccggatcacccccgcctccagcgccgccgccgcggtgaccaccttgaacgtcgaacccggcggataggtccggctcaccgcccggttgagcatcggcttgtcggggtcggcgttcagccgcttccaggtgcgggtggccgcggcactgttgccggagagcaactgcgggtcgtaggagggggtggagaccagggccagcacgcggcccgtggccggctcgatcgcggccaccgcgcccttgcgcccgccgagcccctcgaaggccgcccgctgcgcggccccgtggatcgtcgtcaccacgtcgccgcccgggttgtgggcccccgtcacgtcgttccacagcggcagcggcgcgagcatcgggtcggcgccggacagcaggccgtcctcggcgtgttcgagcagcgtcgtcccgtacgcctgggaggcgaagccggtgatcggcgcgtacatcggcccgtcggcgtaggtccgctcgaagcgcaggtgctcaccggtgtcccgggagccggtgaccgccccgccgccgaccaggatgtcgccgcgcggctgctggtagcgggcgatgtcggggcggcggttggccgggttgtcgtcgtactccggcttctggacgatctgcacccgggccgcgttgaccaccagggcgaccagcagcagggcgcagaagacggcggcgtgccggatgttccgggtcaccgcagctgccccccgctcacggctccgcccgcccgccggcctggctgcgggccgcgtggctgacccggatcagcagcgccacgatcgcccagttggtgacgaccgaggacccgccctgcgccaggaacggcatcgccatgccggtcagcgggatcagcccggtcaccccgcccgcgatgacgaacacctggagcgcgacgatcgaggagagtccgaccgcgagcagccggccgaaggggtcgcgggcgccgagccccgcccggtagccgcgctccaccagcagcccgtacagcaggaagacggcgctcaggccgaggaagcccagctcctcgccggccgtcgccaggatgaagtccgacttgacggcgaagccgatcaggaccgagtggccgaggccgagaccggtgccggtcaccccgcccgccgcgaaggcgaagagggactgggccagctggttcgggccgtggcccgcctcgatggacgcgaaggggtgcagccagtcctccaccctgctgtgcacgtgcggctccagccagcccacggcgaccgcgcccagcgacgccagcagcagcccgacggcgatccagccggtgcggccggtggcgacgtagagcaggaccacgaacaggccgaagaagaggagcgaggtgcccaggtcccgctccaggaccaggacgccgacgctgaccagccacaccgccaggatcgggccgagcacccggccggtgggcagttgcagccgccacacccggcggcccgcgtaggccagcgcgctgcggttggcggccaggtaggcggcgaagaacaccgcgagcagcaccttggcgaactcgccgggctggatggagaagccctcgatccggatccagatgcgggcgccgttcaccgccgggaagaagatcggcacggtgagcagggcgagcgccgcagcgacgcacacgtaggcgtagcgctgcaggacccggtggtcgcgcaggagcaggacgaccacgatgaacagcgcgacacccagcgtcgaccagaccagctgggtcggggccgcccggtcgccgggggtctccaggtcgagccggtagatcagcaccaggccgaggccgttgagcagcaccccgatgggcagcagcagcggatcggcgtacggggcgcgcagccgtaccgccaggtgggcgaggagcgcgagcaccccgagcccggcgccgtaaccggcggcgccgggaggaagggcgtcgtgctgggcgaggcccacgttgcagtagccgaagaccgacagcaggacggccatgaggatgagcgcgagttcgatgccccggcgccgggggagccgggcgacgggagcgggggtgtccgcctgtgccacggtgatcccggttccggttccggccttggtcatgtccggaacttacccaaatggtgtggtgtgcgcggcgtccggctcagcaccagcgcggcgcggggccgatgttgtcgatgtaccgggccgccccccaggcccaggtgccgtccgtgaggaggtaccacagcgggttgccctgcaccctggagccgggcgtcttgcagtagatggagacgacctcgccccggcgggcgtaccggatgacgtccgcaccacgactcggcgaggtgcgcagcgcgagccggtcggccgtcacgacaccccggtagcggccctgctcctggcggccgtcgctcccgccccacgcgccgccgccgcttcctcccccgtctcctcccctgttcccgccgccggtgacggcggacgtggagccggcgtcgccgccccactcgtcgttcgcggcggcgggtgtgacggcgacggcggtggcgagcgcgccggccgcgagggcggtggcgaggccgcggaccaggggcgaacgcgaggccggtgcggacagtggcgacatgggagtacctcccgggagcgaacgggtcttcaggtgactaaccgccacattaggagcgccccgcaggccccgcccgccgcactgagccatcggggaagacgccgtggtcagggctgctgaggcagcgtcagccgggccagcgcaccgccgtccggcggattggtgaactccagccgcgccccgagcacctcggcctgccccagcgcgatcgtcagccccaggccgtgccccttcgccccgccctcggtgcgaaagcgctgcgggccgtgcgcgagcaggtactccggatagccgtccccgtggtcccgcacggtgatcaccgcaccgtccacggtcagcaccaccggcgcccgcccgtgccggtgggcgttcgcgaccaggttgcccagcacccgctccagacgccgccggtcggtctccacccgcgcgtcccgtacgacgtccacgcgcgtgtcggtgcccgagccccgcaggacccgccggaccagcgcgcccagctcctccggctccgtcgccggccgctcccgcccgctctccagccgggagatctccagcaggtcctcggtgagcgtgcgcagcgccgccacccggtcccgcaccagctcggtggggcggcccggcggcagcagctcggccgccgcgtgcagtccggtgagcggggtgcgcagctcgtgcgccacgtccgcggtgaaccgctgctcggccagcagcttgccctgcaacgacgaggccatggagtccagcgcggcggcgaccgacgccacctcgtcctgcgggcgcgtcggatcctgcgcgcgcggatcacccacccgcgcgtcgaggtcgcccgcgctgatccgccgtgccacccgcgccgtcgtgtgcagccgccgcgtcacccgcgtcaccgcgaacgcgccgaccagcagcgtcgccccgatcgccagcgccgacgaccacacgagcgtgccgtccaggccgtcgatggtggcctgtccctgggagtggtcgacccgcaccgccagcgcccggccgccgtcggccggccccgccgcccacatcgtggggcgccccgcgtactcggcgagcatcgtgccgcgccggcccgaggcggccagttcgcgcagctgccgcggcagccccgccggatcgatgccggccccgcgccgcagcggatcccccgcctcgtaggactcggtcgcctcgcccagccgggacagggccgcgtcgcgcgcctggccgacggtccggttggtcaccgagacgtgcaccaggacgccgagcagcgcggcgagcccgcagcacatcacggtgatgaagacggccgccttcacggccagcggtccggtccaccgagggagggcgagcctcaccgggcgctcgccgagggcgacgcggacggtgcggccgggggcgacgagggtggtgcggccgagcgcgacacggagggcgacggcgaggcggagggacgcctggcgtgccgtccgccgtcgtcggtgcgcagcatctcgtcgctggtcagcagcatggcccgctggtcggcgtcccaggtccactgaaggcggtactcgtacccggcgacctccgagggcgagcggacgatcaccgtgcgcccggccagctcgaccgcgctcacggcgtcctcgtaggacatgatccgcacgagccggtccttctcgacggtgtagacccgcacggcggtcagccggtccggcagcagccggaaacccagcgtcatctcgggacgcccgtccccggtcaggtcgcggtagtacggccgcagcaccgggcagccgccgggctcgtccccggcaccgtccgcgccgcagtccgccatccgcgccgacgtctcgtggtaccgcgccccggcgcccgcgtagtcgtccgggtgcgcggcgatctcggcccgcaccgcggccaccgggtccgccctgcggatgtcgccaccgggcacggcgacgcccttcatcggcgcgtgctccacctcgccgatgtcgtacgccggactggacgccggggtcaggccgggccacagccgggccggatggtgcgcggcgggcgtcgccccggcactctccaggccgccggtgtccccgcaggccgccagcacgccggtcgcggcggtcgccaggagcagcgcgagggcggcggggacgcgggcggggcgcccgcggcggctcgggagcactgcactcctggggttcgggggatcggcgtcggcggtcccgcacggccgcgggcggcaccgcgggcatcgcggcaccgcacgcgacgccgtacggaaggccattttgcgtgcgcacgggcccgccgggctactcggccggttcctccagcagccgcacggtggccaggccggtccggagataggccacgaacagctcgttgtgcagcgcccacggcgagcgccgggcccggaccagccggatcgcctcctcggcgccgctgccccggcgcatcagggtgtgcgcgacgacgagaccggagcggttgtacccgtggtagcagcggacgaggaccttgcggccgccgtccagcgcctcgtccgcggcccgggccagccggatcaccccggcgagctgggtgccgtccaggggcccgtccgggatcggccacacatggtgctcgacgccttcgtccggcccgtgcccgggcagccgcagcagcgtctgcacgaggtcgaactcgtcccgcaccacggcgaactccagccgccccggcgtgggccggaactcgtgcccgcccatccacaggcccggcacgatctcgtcccagggccggtccggagccggcacgtccggacctttcccacgggtacgcacagccacctcccagtcccgcccagggtctgcccaactcgtcccgaaagcaaccggcttcttgccctcgcggcacctcgcctgctcccatggacgggggtggtgatggcatggacggactgcgcgtcgtgccgacccggcgccacggccgggaacggctctacgtctgcctcccggacggcgggaacgtcgcctggtacgaccgcgaggaggcccgcgtcagcctgctgagcgacgaccgcagggccgaggtgctccaggccctcgcccccttcgtcaccggcccggtcacggtcggcccgccgccggtcccgaccccggccgagctggcccggctcaccctgcaccccgacgacgacctggcccccaaccggcccggcgaggccctcctggtcgccctggaacgcgcgccgggaccggcacaccggctgcgccccgacccgcgccgccgggcgctggccgccgagcaggccaccgggaccgccctcgaccgcctcgacggcgccggcctgcacaccctgcactccctcccgctgcccggcggcgaccgtatccaccacctgctgatcgggcccggtggtctcttcgccctccacgtgctgcccgcccgcggacaacgggtgcgggtcgccgacccgctggtggcgctgggccgccggaccccccgccccctgctggaccgggtccgcgccgacgccgaccgggcctcgtacgccctgacggccgaggtccacccggtgctcgtcctcgccgggccggcgcacgtgaccgtcaccgccccgccccgctcggtgcgcgtcctcacggaccgggagctgccggacctggcccggacgggcggggtgctgaaaccggcggacgtggaggccctgcacgccatggcccgggaccgggccacctggcagggcgtctgagggcacgcccgcttccgaggtccgtccgcgtccgaggacccgtccgcctccgaggtccgtacggcgtccggggtccgtccgagggcccggctcagggcagcgccgccgcccgccgccggtcgaacagcggggccagcaggtcgccgtggtcccgcacccgccgtccgacgtccggcgtcaggaagacgaaccgctccgcccgcccgcacccggcgacctcctcccacgtcaccggcgtggagaccgcgggcacgccgcgggcgcgcacggtgtacggggcggccgtggtcttgcgggcggcgttctggctccagtccacgaacaccttcccgggccgcaggctgcgcgtcatccggtgcaccaccagctccggcagcgcccgctccgcctccacggcgagccccttcgcgtactccgacacccgctccgaggacgcgccccgcacccccgccagcaggtgcagccccttggccccggaggtcttggcgtacgcctcgatcccgtccgccgccagccgctcccgcagccacagcgcgacctcgcagcactgcaccacggtcgcgggcggccccgggtccaggtcgaacaccagccggtcggcctcgccgggatcgtccacggtccactggtgggtgtggaactcggtcaccaggttcgccgcccacatcaggctcgccaggtcctgcaccagcaccatccgggccgggccctccgagcggggcacctcggccgtggtgacccagtcgggcgtaccaggcggcacgttcttggtgaagaacacctggccgtccgggccgtccggataccgcaggaaggagaccgcgcggtcccgcaggtgcggcagcagcacctcggcggtcgtcgcgtagtagtgcagcagctcgcccttggtgaggccggccgcgggatacagcaccttgtccaggttgctgagggccacccgccgcccctccacttccgtcatcggcgccataccatgagaatctcatgaaacagtcacaaaacgcccgaaaggaacggtgctgcacgtgcgatccatctggaacggcgccatctccttcggcctggtcagcatcccgatcaagctggtgaacgccaccgagagccactccgtctccttccggcagatccacacggaggacggcggccggatccgctaccgcaaggtgtgcgaactggaggaccgcgaggtcacccaggccgagatcggcaaggcctacgaggacgccgacggttcgatgatcccgatcaccgacgaggacctgtcccagctgccgatcccgacggcccgcacgatcgagatcgtcgccttcgtgcccgaggaccgcatcgatccgctccagatgggctccgcctactacctcgcggccagcggcgccccggccgccaagccgtacacgctgctgcgcgaggcgctcaagcgcagcaaccgggtggcgatcgccaagttcgcgctgcgcggccgggagcgcctgggcatgctccgggtcgtcggcgacgccatcgcgatgcacgggctgctgtggccggacgaggtccgcgcccccgagggcgtcgcccccgaaggcggggtcaccgtgcgcgaccaggaactggacctcgccgacgccctcatggacaccctcggcgagatcgacctggacgacctgcacgacgagtaccgggaggccgtcgaggaggtcgtcgccgccaaggcctccggcgagaagcccccggaggcccgcgaggaggcggcgcccgggaaggtgctcgacctgatggcggcactggagagcagcgtgcgggcggcgcgggagtcccgggacggtgagggggcgggcccggcggaggaggcggaggtcaggtccctgtcgcggcgcaagacctcgtcccgggccccgaaggagaccgggggcaagaagtcgacgtcgacggccgcgaagaagacggcggcgaagagggcggagccgaagaagtcgacggccaaggccgccgggtccgcgaagaagacggcggccgggagtcctgccaagggcaccgccaagaaggccacggccaggagcacggcccgcagcggcgacaagggcgcggccaagagcaccgccaagaagacggcgtcccgcaggcgcagcgcctgacccggagccggccgccgcgcggtcagccgaaggtccgggtggacgcgggcgcccggggtatcgcggacggggcgggttcgaaggcggcggggctcgcgccggcggactccgcggacgccggcgtgtccgccacggaggccggcgagggcagggcggggctttcctccaggcgctgcccgatcgtctcggcggggccgccgcccggggtggccggtccggtggtcagctgcgaccacgcggtcacggcgagggcgaccgcggccgccgtgccgagcacgcggcccgtccgccgcagccgggcccgcccgtccagctcgcgccaggccggtccggcccacgcgtcctcccggcgccacggctcaccgaccgtgtcgtgggcgcggccggggtggccggagcagtcggcgggaggctccggccgcgtgcggccggggatccggtcccgtgcggcgggttcccggggggcggaggcgtggatggcgcgctcgtcgtcctccaggaacagtcgccagacgtactcgggcacgaccggcgcatcgtccggtccgtccggggtgtcgccgccgcccggtccggaagcggtcatggtcccgctcctcctgtcgtcggctccggacgggcgcgggcgggagcaggggaacggccgcccaccaccggctccggcgccggatggtcatggcccggcggacaccgtcgcccgccacctgcgaagaacgtgcgcgcgtggcggcccgttccccgtgccgccggtcgtgactgggtcgtaatcggtgaccgtgcccgcgtcgggttcgcgcgccgcgcgccgcgcaccgtgcccgcgtcgggttcgcgcaccgcgccgccgcgcccgggccccgccccccccgggtcctcagggagccgccggggacggggcgggcgtcggggaggcggtgttcacgttcaggtcggggcgcggcttgagcaccagcacccgctcgccgggctgcggcgggggcggggtgaccttctccctcggcagcttcgccgggcccgtctgcttgaaggtgacgtcgtcgtactcgaccagcccggtcttctccagcaccgtgatgtggtccaggacggtgtcgttggccaggtccgccagctgccgcacgagggtgttcttggtggaggcccggatcttggcgatggccgggaagatctgaccgtgggtcacccgcatgatgttgaccgccgaagagtcgaactccctgccgctctcggcgtccacggcggccacgaagccctcctgctgcggggaggcccggttgggcagcgtgatgcccagctcgggggagatctcgcggcacatcgcgtcgagtccggcgtgcccgacgaccaggtgctccccggccgtcttcatcgccttcgtcgtgccgcgctccatcaccatctcgcccagcgggtactcccacagtccggcggcgcggaccttcaccacgaagtcgcggtcggcctcggtgagcggaccgaacttcgtactggccaccacccggttctggttgccgtcggccttgtccagaccgagcacggccgggaaggccagcgcggtgagggtcagggtcatcgcaccgaacaggacgacgactccgatcctgctgcgggacaggcgcatggtgcctccaggggcgacgcggggacgcgaggtacgcgcacgtgtgctcgtgcgcgtaccggtacgccaggaagtacggaagcggcggccggatccttcaccgcttcggcacggaacttgcgggcccggcgagggacccgctcccgggccgtcgccgcgccggtcagccgatgtcggcgccgtacacgcgctcgaccgtgatggtgagcagcacccggcggtcggacaccatcgtcgaccggtactcgtcccagtccgggtgctccccggccgcggcgcggtagtactccaccagcgcttcgacctccggtccgtgcgggtcggcacccggaccggtgagggtggcgacgccctcggcggtggcccaggacctgccgtccggagcggtcacctccagtgcggcccgcgggtcccggcgcaggttcgccgtcttggcgaggccctcgcgggtggagacccggatgacgcccgcctcggggtcgtaggcgggcatgacgggcgagagctgcgggcggccgtccgacttgatcgtcgccagtacgccgagccggctctcggccagcaggacacggggatcgaagcgcggtgtggtggtcatggaccgatcatcacccggaaacgggctcaggacaccgccgggccgcccaggtagtcgcccttctcgtcgtagggccaggcgttggccacgcatcccttgaggcccttgatctgctgcatcatcgccggagcgggccggccggctccggggcacgtctcgtggccgtggccgatgcggtgaccgacctcgtggttcacgatcagggcccggtactcgtggatcggcccgtcgaactccggggagcccagcacccagcgcttgaggttcaccacgacgtccgtgccgacgctgcagttgacctcgccccgggtgagcaggcccgccgcgccgcagatcctgtcgacggtgcccggcgtggcgatcttcaccacgaagtcgtaggagccactgctgaccagccggaaggagttggtcccgtcctgggtccagccgcggcggtcggcgagcacctcggatatctcggcggcggcggcgctcggccggacgtcgatgcccttctcgaccaggaccttgtagcggcgcacccggctgccggtgcccacggtcgtgccgtcggcccgggcggtgacgaaggtgccgggaccggtcgccgggatggcgatggtggtggcggagggggaggacgagggcgacgccgagggcgacgcggaggccttcggggacggtgacgccgagggggagggggaagccgaaggcgtccgggtcgtggcgtccagcgcgtccgtgacgtcggccacctggtcgtccgtcaccggcggccgggtctcccgccagtacgcgacggccgcccccgcggtgagcaggaccgccccgagggcgaggcaggccaggaccgctcgggcgggtccgcggcggctgcgcctgcgggcgcgggacctgtgtccggaaccgtccggcccggttcttcggtcggcccggcgggcggtggatcggcccacggtgtgcgtcctctctgctggtcggcggggctggcccggtaggcccggcacagcggactgcggtgccgtcgtgccccgatgatccaagcggacggacgtgcgaaaacatcgcggtttccgaagtgtcccttctcacgcggacattcggtccgtgcgggcaaccgttcgatgccccggaacgtcttcgtcggggtcacccggaggagatccgggcgaccccgacgcatgcggggacggagtgccgtcagccggcgggggtccgctcccagcggtagaagcagcgcgccatcgcgtccttcggaccgcgccacgtcgccgggtcgtacgccgagacgtacggttcgagccgctcgctgacctggcggaactccgggtgcccggtcagcctgccgatggtgggggccgggtcctcgtcgctctcgatgaggtgcaggtacacgccgtcaccgaactcgaacaggctgcgccggttgacgcccaccaggtgcggcagctcgccgctgtcggactccgcgaacaccttcgcgatgtccggtgccgcgccgggtgccatccgggcgacgatcagtgtgtggtgcatgagggtgctgcccttcgccgatgtccgtacgggtcagtcggcgagcaccgacgcggtccgccgctcgcccgccgcctgctcgatccggtcccggatcagcgccatctgcgtacgcgagttgcggttgatgttgtccgtcatccaggcgtcgtccacgggcgcgtccggcttcatcgcgaagtcctgcgtccagcgcatgacggtgccctcggcggtctccgcgtactcccagacgatgttcatgtactggaagggcccggtctcgacccgctgggcgcggacggtgcgggtgacggggtcggcgacccgctcggagacccagctccacaccttgccgtcggcgtccgggtgcatcgtgagccggaaggtgaccttgtcgtcgtcgcgcccgagcacctccacggaggcgtactcgctgaacaggccgggccacttctcgatgtcgttggtcatgttccagaccagctccatcggggcggcgatggtgatctcgttgtcggtgtgccctgccatgtcacactcccgtcttgagggcgccgttgaccagcgcgaggaaatccgcgggcgtcttgcagcgctcggcctgctcgggcaggcccagtccgtaccgcttctccagctcggccacgatgcccagcaggccgagggagtccaggccgaaggtgtcgaaaccgtcgtcggcctgctgccggagggtgaccgggtcgacgtgcacgccggcggtgcgcttcatcagcgccgacagctcctcgacggtcacctggtagtccagctgctgatcggtcatgggtgtcctccttgtctcgggttggccggccacgggcaccgcccgtggccgttggtcgtcgttcggccgtcagcggccctcgggcggtaccgcaccccggcgcaggacgagcgccgagttcgaccccatgaggccgcgcgccaggaccagggcggtgcgcggctcggcggggcgggcccggccggtcaccaggtccaggtcgtggcacacgtccagcacgtgcggggtcggcgggatcagcccgtgctccatcgccagcaccgccgtcgccacgtccagcaccggcgccgcgcagtacgcccgcccggtcccggtcttgggcgcggtgaccggcacccgcgcggcgtgcgggcccagcgcgtcggccagcgccagcgcctcggcccggtcggcctccgggaccccgagggcgtccgcgaagaccacgtcgacctcctcgggccggcagcccgcctcggccagggcgccctggatcgcgcgggccagcccctcccgggactcggcccagcggccggccccggtgaaggtcgccgcgtgcccggccaccgtcgcccgtacgtccgccccgcgctcccgggccgccgcctcctcctccacgacgagcacggcaccgccctcggccggggcgaaaccgcaggccgcctcggtgaacgggcggtaggcgcggtcgggttcggtggcccggctcagctcggggtagcccagctggcagacgatcgagtacggggccagcggcgcctccgttgcgccgcagaccaccgtgtcggtgccgttccgcacggccagcgccgcgtgcgccagggcgtccaggccgcccgcctcgtcggcggccacgaccccgcaggggcccttgaagtcgttgcgtatggagacctgaccggtgctggccgcgtagaaccaggcgatcgactggtacgggccgacgtggcgcgagccgtgcccccacaggttctgcagctcccgctgcccgaactcgccgccgcccgaacccgccgcggtgaccacgccgaccgagtagggcgagtcgacgtcggcccggccgaaccgggcgtcggccagcgcgtgctgggtcgcggacagcgcgaagtgcgtgaaccggtcggtctggacgaggaagcggtcctcgaccgtctcggccgcgtcgaagccgtgcacctcgcccgcgacccgcagcggcaggtgcgcgcagccctcccgggtgacggggccgagactgctggtgccgtcggcgaccgccttccagtgcgcctcgacgccggtgccgtgcggcgacaacacgccgagtccggtgacgaccgctcgccggctcccaccgccggtgccggtccgttgtggtccgctcatcgcagccctccttcactgccgctcagtacgaccgcggactggaagccgccgaagccgctgcccaccgacagcacgtgccgcagcgtccgctcccgtgcctcgcgcggcacgtagtccaggtcgcactcggggtcgggggtcgtgtagttggcggtgggcggcaccacctggtgggccatcgccaggacgcacgcggccagttcgatggagccgatcgcgccgagcgagtggcccaccatggacttgatggagctcatcggcgtcgcgtaggcgtgctcgcccagcgagcgtttgacggccgcggtctcgtgccggtcgttctgctgggtgccggagccgtgcgcgttgacgtagtcgatcgccgacccgtcgagttccgccatgtccagcgccgtgtcgatggcccgcgccatctccaggccctccttggtgagcccggtcatgtggtaggcgttgccgaaggtggcgtagccggagacctcgcagtacacgtccgcgccccgggcccgggcgtgctccaggtcctccaggaccagcaccgccgcgccctcgcccatcacgaagccgttgcggtccgcgtcgaagggccgggaggcgtgcgcggggtcgtcgttgttcggcgaggtcgccttgatggcgtcgaagcaggccatggtgatcggcgatatcggcgagtccgccgcgcccgccaggcacacgtcgacgcgtccctcggcgaccgcgtggtaggcgtacccgacggcgtcgaggccggacgtgcacccggtggagacggtctgcaccggcccgcgcaccccgaactcctcggcgaccgcggaggagagggtggccggggtgaacgcgcgctccaggtgcggttcggagcgccggtcgtcgacgtcccagcgcgagccgcgctcgctgaccaggacgtagtcgtgctccagccgggtggtgccgccgaccgccgtgccgagcgtggcaccggcccgccaggggtcctcgcggttcatgtcgaggttcgcgtcccggaccgcctccgaggcggccaccagcgcgaactgcacgtacctgtcgcagcgctgggcggtggcgaggccgagcccgtggtcggacggctcgaagtcgcactcggcggcgatctgcgagcgcagcccggacgggtcgaacagggagatgcggcgcgtcgccgtacggccctcggacagcagcctccagaactggggcgtgccgatcccgcccggggcgacgacgcctatgcccgtgacggcgacccggcgccgggtcatgacaccacctcggccgcgggggcgggccgctcgtgcccggccgcgtggcccgcgtgcgcaccgtcgcaggggagcgcgttgccctccgcgtcctccgtgtcgacgtggcccagctccggacgcggggccagcggccccaggtggaacacgagccgcgcctcgacgtcccccgcgttgcggaagcggtggcgcatgtcctgcgggatcagcagcccctgcccggtgccgagcgagtgcggcaccccgtccaggtccacctcgagggcgccctccgtgacgtacacgaactcctcggagtacgggtggtagtgctcggcgatgcggtcgccgggctgcacgatggccacgcccatgaagccgctggtcgacccggcggtggtgggcgtgaggagggcgcggaggtctccgccgcggcggcggttcggggcgatgtcgccgagggagacgatgcgtacctgctggtctgtcatgtcgttcactccggggtgacgggaggaaggaggggaggagaagaaggagaagcgggggaagcgggggagcaggggcggcgcggaaggccgcgcggcccggcgggcacgccgtcgggcccggccggccgcgcggtcgggggcgtgcttcaggaaccggccgaacgccggtcggtcaggggcgtcatacggatccggcgcagcagccgggacagcgtcgccgcctcggccggcgacccgtcgacgccgacggcggcggcgtccagcagccgctcggcatccgcggcgccccggccgtgcaggccgaggacctcggcgggcgcgtcctcggggtcgccgtccacgtcgacgagccgtacgacgaggtcgtcgcggtggaagacggtggccgccagcaccgggccgtccgggttccgggcggcggccgcgtcctgacgggccagcagccgggccaggtccggaccggcgccgtcgcgtaccgggtagagcagcgcgagccgttcccggcgcgcgcccgaccggtcggggtacgtcgcgtggtggacggccggcatggcggcccgggtgaagaagcgccgggcggactgcgggtcgccgaggtcccggtcctgctccagatacgggttcagcgcctcctcgacggcccgtaccccgggctgccgggcgacgtggcgcaacgcggtctgcaggtcgccgcgcacctccacggctcgcacgatccggttgccggacatgaagagcgaggtgcgcagcagccgcgtggagccgtccacgtgggcgtcgggcgacacgtactcggacagcagccgcgcggtctcggcctcggtgccgggccgtacggtgaaggtgagggcgtgccgtacgacgttgtccccgatccggggcgcggagcgcggctcaccgggcgccgggcgccccccgtcggtctcccgcaggacgctgtagcgcagcgagtgggtgtcacggacgcaggtcgccagcggttcgacggtgtccaggtgctcgtcgctgttgacccaggccaggaagggcgcggcgctctcccactcactggtgaggagccactgggtcggattctccagggactggcacagctggtcgctgacgtgtccgggaacggcggcgacccggtcgcggatgcgctcgtaggcgtccaggaactcctgctgcattccgtcgtggacgtccagcatcaggacgacccgcacgcgggaaccgtcgaacgcggatatcgacacgccacccgcgtccgtcgccacggcgggcgacgtcgccgacgtcgctgtggtccgcgtcgcgtccgtgctcggggcatccgtcgctacgacgggagagaccgtcatccggcccacctcttctccggtcatcctcgtggactggggcgatcgtcggcggcgcccgccaggccggcggggtgcgacggtcgcgtaagcacgatcgtgggccgtgcccgcggggaccgcgaaccaggagggttaagcgggtgaagcctgcgccgtggcgggccccgacgggccgtacggggcatgcatgaaggccccggcgcacctcggtcggacccctctcggacccctgacgcactcctgacgcatccctgacgcgcatctgaacgcgcgtccgacgcactcccgacgcacttccgacgcaacccctgacggacacctgtcgtacaacggaggacgaatcatgaacgaaagagccgaccggtccggcggcgccgcccccgggggcgaccggacccaccgcgtcccggtcctggtcgtcggcgggtccctggtgggcctgtcgacctcggtgttcctgggccggctgggcgtccggcacaccctggtggagcggcacgccggcacctccatccacccccgcgggcgcggcaacaacgtccgcacgatggagatcttccgggtggccggcaccgagccggacatccgcagggccgccgccacgctggccgacaaccacggcatcctccaggcgccgaccctggccggcgacgcgggggagtggctgttcaagcagatcgacccgggcggcggactggcccgcttcagccccagctcctggtgcctgtgcagccagaacgacctggagcccgaactcctcacgcacgccacgaacctcggcggcgacctgcgcttcggcaccgaactgctctccttcgaggccgacaccgagggcgtcacggcgatcgtgaagagccgggagaccggcgagcacaccaccatccgcgcggactacctggtcgccgccgacggcccccgcagccccgtccgcgaacagctcggcatcggccagagcggacccggcgacctcttccacaacgtcagcatcaccttccgctcgcgccgtctcgccgacgtggtgggcgaccgccggttcatcgtctgctacctgacggacgagaacgccgacggagccctcctgcccgtcgacaaccgcgagaactgggtcttccacgccccctggcaccccgaacagggcgaaaccgtcgaggacttcaccgacgagcgctgcgccgcccacatccgccgcgcgatcggcgatcccgacctcgacgtcgagatcaccggcaaggccccctggcacgccgcccagcgcgtcgcccgcagctaccgctccggccgcgtcctgctggccggcgactcggcccacgagatgtcccccaccggcgccttcggctccaacaccggcatccaggacgcccacaacctcgcctggaagctggccgcggtcctcgagggctgggcgggcgaggccctgctggacacgtacgacacggaacggcgcccggtcgcggaggccaccagcgcccgcgccgcccatcgctcggtcgagcacagccacccgggcttcgcgccgccgccggtcgcggggggtggcggtccgggcgcgggtactcccggcggtgcgggccgtggcaccggtgggcctggcggtcctggcgggcctggcggcctcggtggtcctggcggtcctggcggtaccggtggtcctggcggacccggtggtcctggcggacccgacggtcctcggggtgcgggtggtgcgcctggtggcggccccggtggcggtcccggcggcggcggcccgcagcgcgggatcctcaacgtcgccctcggctaccgctacccccggggcgcggtcgtcggcgccgacccggcgaccccggtggtcccggagggcctcgacctcaccggagcacccggcagccgggctccccacctctgggtgcgccggggccaggaccgcctgtccaccctggacctctacgaggactccctcgtcctgctcagcgacgccgcccagcccaccggctggcacgaggcggccgccggggtggccgccgggatgcgggtcccgctgaagtcgtaccgcgtgggcgggtcccccggggccgatctgaacccggacgacgaggagaccgactgggcgcgcgcccacggggtgacccggggcggcgcggtcctggtccgccccgacggcttcgtggcctggcgctccccgggccccgcccccgacccggagtcgatgctgcgccaggtggtggggacggtgctggcccgaagctgagtggggcacgggacaccccaaacgtggaccactccccgtttacctgctagcgtcacgctcggcagtgaagcggggagtggtccccgttacgggaggggtgacggacgtggcggacacggcgctggtgctgggcgggggcggtctgaccgcgtacggatggcagatcggtgtcctggcggggctggccgacgcgggggtggacctcgcggacgccgacgtcctcgcgggcacgtcggcgggttcgctgctggccctcgacctggccaggggtgcggccccggccggcctctacaaggagcagctcgaccgtgaacgccccatgctggacgtggacttcaccttcggcatgacggtcaggtacctgtgggccgcgctgggctcgcgcgacccggagacggtggtcaggcgcctcggccggctggcgctctccgtgcgcgacgtgccgcagagcgcggtcttcgccgccatcggcgcccaactgcccgtgcgggactggccggacaggaccgtccggatgttcgccgtcgacgcgctcaccggggaaccgaccgccttcgacgccgacagcggggtcgacctgctgcacgccatgtcggcgacctgcgcactgccgcccctcttcccgccgatcagtatcggggcgggccgctggatggacggcggcgtccgctccacgaccaacgccgacctggtcgacgactgcgcacgcgtcgtcgtgctggccccgattcccaagggcgcgggagcgagcccgagcgcgcggacccaggccgagaccctcgcctcgcgtggcgcccgggtcgccctgctgacccccgaccgggcggcccgccgcgccttcggccgcaacgccctggacgcctcccgcatccccggggcagcgcgggaagggcggcgccagggcgcggcccacgcgggacgcatcggggagatctggcagggctgagcgcggctcagccggccggcgtcccgaggggcccgaggggcccggggaaccgcggaatcagcccaggcgtggctcggacaggccggacacctcgtcgaccaagggctggacgcggtaggggacgacggcgctgagggcgatgaccgtcgtactgcgtcgcacccccggcacctcgagcacctggtcgatcacctcctgcacatgctggttgctcgtgcccgcgatacggcaccagatgtcgccggggcccgtcacgacgtgcgcctccaggatctgcggcacggctcgcagccgcgcggcgatggcctcacgggccggctggtccacctcgaacgtcgtgaacgcctggaccacgtgcccgagggcggcgacgtccatgtccggcccgtaaccggtcaccacgccggatccggtcaaccggtcgagccgcgcctgcaaggtgccgcgggcgaccccgagccggcgggcgatctccaacaggccctcacgcggacgctcccggagcagccgcagcatccgcccgtcgagctggtcgagcccctgtcgtgccactgcatctgccgatctgccacgcgaagagcaccccgatgccgcttctcctgccaaatagacaaccagaagatgcatcagttgcccaataggcaccccacgccccaccctgtgggctcccgtccaggaggagacccgtgaggcagcacacgcacccgttcgtcccctaccgccccgaccggtacgacgaggccgaaatgatccggcgggggcgggacttcgtctcgttcgtcgaccgcaggcgcagcgtgcggttcttcagcgacgagccggtcccgcgcgagtgcctcgacctcgccgtcgccgcggccaacaccgcaccctccggcgcccacttccagccgtggaagttcgccgtgatcggcgacgccgcgaccaagcaccgcatccgggtcgccgccgaggaggaggaacgggtcaactacgagggcggacgcatcccgcccgagtggcgcgccgcgctcgcccgcctcgaaacggactccgacaagggcttcctcgacgtcgtaccgtggatcgtggtctgcttcgccgagaagagcaccgcgctgccggacggatcgctgcgcaagaactactacgtgaacgagagcgtgggcatcgcctgcggcctcttcatcaccgccctgcacgcgatgggcctgagcaccctcacccacacgcccaacccgatggccttcctcacccggatctgcgcacgccccggcaacgaacgcccctacatcctcttccccgtcggctacgcggcacccgactgcgaggtcccggacctggcccgaaagcccctggcggaggccatcaccgaacccccgcgctgacgcccccgaccgccgtgggcgtcgtcggggcgctgtcgggcccgtcggctcaggcccggctcacctcccggccagccgccgccggcggaccaacagcccaccggccaccccggcgacggcgaaggcacccgctcccaccccggcgacgaccggcgtcgtgtcaactccccgacgatccgcacgccgacatcaccgcccccactcgcgagtgcccggtggagatcaccctggcggccctccagggccgctggacgacgctggtgatccgcgaactactgcgcggcgaccactcttacagcgacctgcgcgccgccctggccgccccctcggacaaggtgaccaaggtggccgccgacgtgatcacccggtggtcgtcggcgcgagcaagggcgagccagccggtgaccgcgcgatcgcgcaggacggccttggccagtcctccgccgtcgaggacgagggcgccgccgggaaccgcgggggaccggctcacgtctcctcgtccgagacgggtccgtgctcggcctcggcgacactgatcagttcactgaggttgtcccgttcgatctgacgggccgcggccgcggccacgtaggcggacagcccagagggtccactgcgggccttggcggcttccgcgatgtcgcgcggcatggtgatcgagtacttgccggtaggctcactcgagctatccatcctcccgaatgagcggtgggcaaccaggccggaacgatccggacccacgccctgctgtcattgcgtaggtgacgctccatcagtgagcttcttcgatgtggccaccgatcgggtgacgggccgtgaagcgcaacgagcgaggcccccgggctgttgatcgagatgtctgacgtctcaatcacgttgctcgggggcctcgttggtcatgcatcctgccgcacttgacctgccgcatgcactcgtggagtgggccaccatgctgatcgtcacccgtgagggcgaccggcgctgcaagctccgcccgtcccagcgcgcgatggtggcactggtgtacctgcgcgaacacaccactctggcgaagattgccgccgggttcgggatcagcgagtccaccgcccacgcctacacccgcgcggtcgtcgaccttctcgccgcctgtgcaccgggcctgctcaagacgctgcgcgaccacgaacccgacttcgtcctgctcgacggcactctcgccgaatgcgaccgggtcggcgacggccgggccgactactcacacaaacaccgtcggcatggtgtgaacgtgcaggtcgtcaccgatcccggcggccggctgctgtggctctcgcccgctctgccgggccgtacccacgacctgaccgcagcccgcacccaccggatcatccggatctgcgagcgccagggcgttccgatcgtggccgatctcgcgtaccagggcgccggcccgtggctgaccacgggcatcaaacgcaagcccctgcaggaactgacccctaccgacaagacccgcaaccgtgccctggccgcagcacgcgcacccgtcgagcgcggcgtcgcccgcctgaaatcctggcggatcttccgcaggtcccgctgcagccccaaccgcatgacgtcaatcgccaaggccgtcctcaccctggagttgcaccgctgaagaagctcagtcgatgaatggcgaccggtacttgtcatgggctgcatctgacggcactcgcctgcacatacgcgaagacccggcctcagcgtttccgctggtgacggggtctttgggcacctcatacagggtgcccccggcaggattcgaacctgcgcacacggctccggaggccgttccggcacctcacatctgggcacgtcatgaggtcacagccggccaactaccttgctccagtccacgaacagtccacggtttgtcagctgcctgcagagctagagctggagctaacgtctgcctgagctgtgcgctcatgccggcgttgagcggggccggtcactgagcttcttcagcgttgccgctccaaggtgagtacagctttggcgattgacgtcatgcggttggggctgcagcgggctctgcggaaaatccgccaggacttcaggcgggcaacaccgcgttcgaccgatgcccgcgctgcggccagggcccggttgacggtcttcttggtgggggtgagttcctgcaggggcctgcgtttgatgcccgtggtcagccacgggccggcgccctggtaggcaagattagccaggatgaggacgccctggcgctcgcagatacggatgatgcggtgggcgggcagcggtcaggtcgtgagcccggcccggcagcgcgggtagccacagcagccggccctccggatcggtgaccacctgcacgttcactccgtgccggcggtgcttgtgggagtagtccgcgcgtgagtcgccgacccggtcgcactcggcgagggtgccgtccagcaggacgaagtcggggccagtctcgagcaggaccttcagcagacccggcgcgcgctgggcgagtaggtggatgaccgcgctggtgtaggcgtgggcggtggactcgctgatcccgaacccggcagcgatcttcgccagggtggtgtgctcgcgcaggtacaccagtgccaccatcgcgcgctgggacgggcggagcttgcagcgccggtcgccctcacgggtgacgatgagcatggtgacccactccacgagcgcatgcggcaggtcgagtgcggcaggatagatgatcaacgaggcccctgagcagtgtggttgagacgtcagacatctcgatcaactgcccgggggcctcgctcgttgcgcttcgcggacgtcacccgatcagtggcccgctcgaagaagctcactggtcaatcctgtgcccgcttcaggagcctgatgatgagccaacttcctgtccaacgggggtcgcaggcgttatcttctcccaatgagcatgatctacgaacctgcgaagaagacggttggcgacctgctgggtgacgtagccaagaagacatccgtccctgattaccaacgagactacagctggacagaaagtcatgtcgactacttttggcaagacgtgctcggcttcatgcgggagcagaatgaaaaaactctagccgatgcagagtacttcatcggctccatggtgcgtgtagataaggcggagaggtatgagctgctagacgggcagcaacgcctagccacgattgtaatcctcctatcagcaatcagagacagacttcgcccgctcaacacgaaggcctacataaagacccaagggcgctggatagcggaagaagatgaccttacgggtgaaagcaaatattcgctaactttgagtacgtacgaccgtgactacttcagaaggcgtatccagaacgatcctgttgaaacccttaagccggcgacagccagtcagacgttgattgatgctgcgcgaagaaagttcgatgccgaactaactagcgaactcgacaagcaacccgacgagaaagggcgtgagcagtggctgctgctgttgcgtgatgtgattatgaatcacgtaactacagtcactgtcacatgcgcaagtgaacaagatgctgcgagcatcttcgagacattgaatgatcggggactcggactttccaccgtagacttgctgcgaaacttcgttcttcgtagggccggcgaaccagatagagacgaaatcgttagcatttgggcagacgttttgagagagtccaactcggttgatgtcgatgagtttctacggcattactggatttctcgccatggcgacatcaagtcgcagcgactttatcgcgcaattaggaaatatatggaggatagtggggaatcaagccttgagttcatgcgtgacctcggttcggctcatgccgcgtacgtgcgcctcatgcgtccagacttcgccaatgacgcaaccaacgaggagctgcagaacattgccgatctgaaagcgaagatgctctatccgtttctcttgagcggcctaactcgcgacgaagagggattcctttctcttgtgcgtgcagggatcgttttctatgtacgagaagggatcgtggttaaaagaaacagctcgcagatggagaaggtggtgttctcggctgcccgtcttatgtcggaagggggcgccacggataaagctctcgccctgctgcataacggcgcatctgctgacccagtgtttgatgcggccgttcgcgagctaagaaacctggacacgtctgcagccagataccttctccgcgagatcgagatctcgctccgaaatggtgaagagactgatgttgctcgccctcccaagattcacatcgagcacatctatccgcagaagccaaaagcgggtgagcgatggtcgaatcatactgactatgtcgggaagatcggcaacctgacgctgttggcgcgacgcatcaatactgcaatcaaaaactccgagttcgcagtcaagaggttggaactggcaaagtctgagatcttcctgaccagggaagtcgcagcgcacggaatgtgggatgctgcggccattgatcagagacaggatgagctcggcaaaaaagtaaaatcgctttggggttggcctcctgatgttatcgaggcagtgaataaatttcctacacatgtggaagcgtgaggagtttcctgttacgtaggctctgactgcagccccggtctgctcccagctgcaaaatcacaatgccggttaaggcgatgctggttaaggtgcgttggttgctcacctaacacccggcgttccgccatggggactgctgcgatctgacacgggtctaatgcagcctcctcctcaccacaaataccgaagttcggtcgctgagtctccactgcggctccgagtggcgtgctgatggatacggacatcacccaagtcgcggcacactgactgacggtagcgggacatgcgaccgaaccttgggttcgccgactcgcttcttgccgccacccctctggatcggtctcctgtacgatgaccgccgtcccaactcctgggaaaattgcgccacttccagtccacggactcgctgctggcgtagcccactgcaccctccccaaagggaggccgagtgatggagagctcatgcccaaaaccgcgcacatctacgtacccagcccttctcgcgagaaccttgagatcgggctcgaccagggcttgtggggatggcgccgcagcgccctcgaccgtgccggcactcgtcaggcagtccagtcccttaccgaaggcgacttcctcgtcctggggcaccgggggcccaacagccgggttgctcccggcggatgggcgaatgcgaccctgcagcgtgtcatcgtcacccaggtcagccggccctacttcaccgacagcacccctgtctggccgggcgacgactaccccgagcgcatcggcatcgacgtcctcgaggaagaacagaacgtgccgggcaccgccctcggtaccgatgccatggaagctctgcgcctgtccgccaacaagcagggggccgcggtcctccagcctggtatcgcagccgtcgcccagctcgccgacgtgctcccgcttgttcctgtccttccgggcgacgcgaccgtggaccacgagggcaccgacagcgccgtcgcccaggtactcgtccgtcgggagcaggtcaagctccgcaagaacctgctcggtggcgccactgaggcggcctgtgccttgtgcggccgtgtcctgcccacccggtttatccgcgccgcccacatcaagcggcgcagcgcggccagccgccaggagcggctgatgatggccaacatcatgccagcctgcctcatcggctgcgacgagctcttcgagcacggctacctgtacgtcaccgacaacggcaccatcgccgtcagcccgaagagcaacgccactcctgacctggctgtcgcggcgaaggctctcgaaggccgtaccgtcgccgactacggcccccaccgcgcacccttctacatctggcaccgcacccacatcgccaactgagtgagcgcagccagttggaccagcacgcagacaaattcagggtgtgtggctcactccctacaagcgagccacccatcttgaccagccatattgcgcggtcacagatgtgctcaagcgtgactgactgcctagccgaactcgttggcagttcgttgtccggccctatcgcttcttgtccttgccccgggtggaggccgaggggcgccaggcgcgcaggtggtcgtcggtgagtccgtgttcggcctgcttctgctggcggtaactggcgaagaagtccgccgggggcccgctgtagagcatgtcgaacccgttgtgccactggtacaaccacggctgcagttccagcaggccggcgaggaacggtgtgatctcctcggtggtcagcgcggtgttggtgaagtacgtcgccagcgcctgcgcctgctccttgtggtcccagccggcccagccgtacagctcgggggtggcggcgttggtctgcccgtaggagatgaaccgctccttgggcacgtccagcttgccgcgcgcccgccaataggaggggcgcaggaagtcggccgaggcgtacttcggcggcacggggatggagtcccggatcttccgcttggcaggctcgtcgggggcggcgtcttccttgcgctggaggtcccagacctcctcccagtccgcgtgcttcttcagcccggagggcttgtagcgcagggcggacaggaacggcacgtgctcgtcagtgatcagctcggcgacgaccttgtgcatgtcttggcggggtgcgtaaagcttggccacggagacgaagtcctcgtcgcgcgagagcgcgtcggtaagccgggccagggtgaggatcgtgggctggccgttctcgtcgaaccacaggtcacgatcctccatgtggtcgagcagccaggagcgcagcgccttttcctgaagcgcgtcccaaccctcggtggcccagcgacgcttgtactcaggccgctcaaccatgccgatggcgcggttcgactcgatcgcgtcgatccgcttctggacgacctcccggtaggaggcgggccagtgagcggggacctccgtgttgggggtggagttgtgccgcttgaaccactcgtcgctggcttcgcccgcggctacacggcgcgcgagaacgatttcgaaggcgcgctcgccaagggcaagttcggggatgttggggtcgtcgggatcctcggagactcggagatcttcagagtgcaggttgtagagggagtagacctgccagtccaactcctcctggagagcgatcatgcgggcacggatggactcccagcggactttagcctcgcggagggcgctggcgaccggggcggcctcaactgccacggcttcggggctgatggcgctgagttgctgggccagcgcatcaagggtggtagcaagggtggtggggtgctcagctgggagagggaactcctggagcttggtgccagtgaactcaaagaatcgttcccagtcgtcgctggtaaagccgccaccctctccacggatccccttgtcgtgactgacctgcttcagccaaaaaccagccgtagaactattaagtagcccaagcagttgaagatgttcctcctcacttgccccctcctgcaacttgatcactggtgcagtgcggttgaatactttcccgccccgatccaaggaaaagtgactgtgggtagctacaaacgggaatgcgataccaagtggagttgagtaccgcttcgggaaaaacatgctgtggtcaaaccagcggaggcctcgctcagtgggcgtctggccgaagtccaatcgcctccgcagcacagttcgatttggccagagaaaccggtattccggtagtgtgatttcacgcggattcccgcgcgagtcataaggaaagtacgttgacaagcgggagttgatcccaaagtcccgaatgccatctccggggactacgggaacacaggagtcgctcaatgccaacgtctttgcggctgacgccttcatgtagaagcaatcatccatgcctgtgtgggtggtgcgtccaattgcatcactaagcgatccgataattttgatggcggatttgctaagttgttcaaccatttcaagaccgccgttagccaagatccacggctgcttagcaaaataacgaccgcgctccaagtcgtctaccgacacccactgacttaccgagcctggcttgtcgatctggtccacgattgcattccacacaagaccgtccttgccgttcgccggcgcggcaggctcgccctggatgcttcgcacagtgcgaatcgtcgacaaacgctgactacctttgcaacgtttccctaccaggataacggttggcgtcccgtgccccggaatataagcgcccgatgtgtcgattacctctgtcagctcgacacggtcccggaagtacctctcgattagcttcgtaccaaactcacgcttcatgaaagaattcgccgtgatctggccgaccatgccatacgcgcgcccttcatcgcccccccgcttggccagttcgaagaaccgctgcgcaaatggaactgacagtgcgtatgtaccaccgcaggcgtcatacagctcccgatacagctcgttcagtttcttgtccttgaccgtaatgtatggcggattccctaccactacgtgatagcgtccttgctgcaaaattccggggtgctcgtggacgtcttccgtggcgtaggtaaacgaggccagtggatcgtaacccccgtcctcgtctccgcccagcgtcaactccaattgccgagccttaatgagcgagtcgcccaccgccagatgaatcggccactcgtatttcgcagcctcagccagggtccggaccccactcgccgcaatggccgccaccagcagccggaaccgggcaatggccaccgcgaacgggttaatgtccaccccgtgaatcgagtgcagcgcagcccgcactcgctcatgcacgtcccgccccggctgtccctccgcccaaagtcgcaccagtcgccggaacgcgcccaacacgaagtgccccgacccgcacgtggggtcgatcatcttcagttcctcgtagccgaactcccgcaccgccgggttcatcgtccggtcgaggatgaactcctctacgaactccggcgtctggagcagcgcataggtcttccgggcagcctcgctcaggtcctggtacaggtcgcccaggaaccgggtgtcccagccttccgtgccgtcctcgttcagcgggtcggtgaagtcgtggacgaggacgcccgcctcgtcgcgctgacgccagaactcgaccagttcgcgtgcgccgtcgtgcgagagcgggatctggtacagcgggttatgccgcttgtcgaagaggaggcggccggcctggccctggcccagttcgtcgaacgccttctccagccacccccgatacgtcgggtcgtcgtccgactccacgtacgcgtcgtaccgcgcctccgccagctcgcgccggtcgccgtccggccccgtcaggtacggctcggggatcagccggttgtcctcgcagaaccgcacgaagacagtgcccagcacccacgccaccgcgacctgggtgacccgctcgtccagccacgagttccacgtcgccgccgtacgcccgagcttgcgcgcctggtcgtattcggtccgcagccgcgcgccggcctcaccgagcggtttcacctgcttgcccaggtcggcctcgaccgccttgacctgctgcttcaggtggtccaacagagccttgcggtcgatcacgacgcccctccttagttacttcacaagagttctgcatgttactgctcgcctcagagtgacttgttgcggaaggactccggcaaagtcggtgtaggcacgggagctggcagactcaggcttccgtgctcgcagtcacgtctaagctcctgtggcgaaccataggcgaggtacgtttgcgaagaaggtggcgtgggcaagatccgccaactaggattgtgatccttgtttcgaaacccgggggggtttgtgcgagtttctgaatactacggcatcgggcgcagccagggggctctcgattttgtggacgtagacataactgacgatgttcctgtctatattgaccccggcatgattaggcatctccctgacgattggggaaaggaatgcctcctcatgctgaccacgtttttcgacagcgttttggatgcagtaaggaagaatgataaaaagcgagccaggtatcttctcggtcatcttggtgagcctaatgaaacacatctaggcttttccgctgggcggagcgctggacgcggattcggtaaacagatgggcgtcacgctcgcggagaaattggcagccagtcaagccgcgcagacaggtttgattgaagatctagaggacacagcttttttcatcgagaaagtcgggaaggatatcgtctctgacattacgacgaacatcatccgtggtccgctaatcgcgtacacgcagcagatggcgacggtcttcggtatccccatggaggagggggtagccagtggagcggcctggaaccctcattctcaggattgggagcatggctatgtacgccttcccattgcgggagatcgtaagttgctcctcgtcccaaaggtgatcgtgcgtcgcgacctgcacatgtctcggtcggagtactaccggaatcacctggtccctgcgctacagagcgaagagctggacaagccgagcagccgcctagtgcgcactctcaaggacggaagcaggagggtctgggtaggggacattaaagcgcactacggcagcacgaaacccgacgtgacgcgcgaatcgctgctccgcccagacatctacgctaattacagggaaataaagcggaagtccgcaccacccccgatttcccatggggaactcagcgagatcagcaatactccgctgccagattacgagaaactactgactgatgttctgcagactccggcaggcaaggattcggctggagagtaccatcggcgcatcgaggcgctactaagcgccgtattctatccttcgctcgtgatgcccgagctcgaagaggagcttcacgctggccgtaagcgcgtggacatctcctacaccaacgtcgcccagagtggtttcttcgccttcctcggaaagcataagatcaaatccacctatgttatggttgaatgcaagaattatggcaaggaagtcggaaacccagagctggatcagctgtcctctcgcttttcacctctacgaggacagttcggaattcttgcctgccgatccttcgaagataaggataggttcctcaagcgatgcagagacacagccctggactatcgcggatttgtcattgcgctggatgatgacgatctccgtgaactggtcgccgacgtcttggaggcagtcaactggatacctgccgatccgcccccggctgagccggaagtgcaaccgcgggtggaaaactatccccttctatttcgccgattcaaggctctggtgaattagtaaggacggcgagcgctcccgagtcgaaggacgctcaagctgatcatgagaagtcggtgaccttccggcctggtggaggaactgcttactggcgccaacgttcacggtgccttcgaacgcactcgatgtttactttgtgtttgggatgcgtccggaggggtcctacgagttggccgttcttcgagacgatcaggtcgtctgacaggacgatggcgccggcatcgagcatcacgtgacagttcgggcagagacacagcatgttgtccgtacggtccgggccgttgtgggggcgccccagagcctgaatatgggcgccttcgctatagaaaccgccagggacttcgatgtggatgccgcacgtctgacactggtcctggtgccatgccttgacagtgtccgcaatcgcactgctgcgcacgatccgctgcaccatggatgtgacgcgttccggttgctcggtcccagacgctgcgacggggtcttgcttagcgcagtccgtcggctcagcaaagagggctcgtaccttggtgatcttaggcgtaggagtttcctcgtacgcctccatgcggaactgccagatcaaaaacccgtcgatgccgagcttgctggtatagctcgcaacccgatacaggccgtcgtaccggtatccgttggaaggagcgaagggggaaccgctctggctgccgcggatcacacgcacgggcaacccgcgcagatagcttgtgacgagggctgcgttgcccgagtcatcaagagactggtcgctgacctggttgccagcactatcccgtcccccgtggccggtgtaaatgatcacatcgccgtagtcctcgtcgtccttgtatccgccggataccacgatggactctgccccagtcgccttcgtaccgcagatgcctgcctggagggggcgatggaccccggcttcgtgggcaagacgacggctgttgtacggctgacctgctgctacaccagggatctcaccaatcatggacacagcttgtcaggcagtactgacacgccgacaccctgttttacggggaggtcgtgcgcctcccacctcaacccaccactctccctagctcccatcccgtccgccgtcgacccacacaccgtggagcagacgtggttcctggcgtccaggtggagcgcactactgtacgaacgacctggacgccaggggccgcgtctgctcggctctgcctgggtcgatggcggacgggatgggagctccccgcgcatgccactacggacccgcagtcggaagcggcgctctttccatcccggtgccggccgatcccccgccggaggcatcatcttgtgcctgcggatgacgtcccgtccttgcccgcatgcacgcagcgcgccgccgggcggggccgccgctggcgaagacagggcggcggccccgccggcaaggcggggcgcgcccgcgccgtgcgcgggccttgatgaagtagggaaagtcttaccgcgctggtctacgcccctcgatcgtggcctgtcggctcaccgctggactcggctaccgttccatccatgccttctgcactggacacgccccagggagcggcggaactcgctgagtccctgcttcctccgctcgggaatcgctggctgcatactcaggccgtggctgctcgggctcgcgaggtttccgcggctgtgtccgaggctgaccgggatcttctcgttgctgctgcgtggctgcatgacatcggctacgcgcccggactgcgtgacaccgggttccatcccctcgacggtgctcggcaccttgaatcgctgggagcgccggcgcgcttggtacgcctggtcgcccatcactccggggccgtgtacgaggcggaacagcgcgggctctcgacagaacttgccgtctacgagcgggaagactccccggtcctggacgctctgatcttcgctgacatgacgaccggccccgccggacagtccttcgacttcgatacccggattgacgagatcttggtccgctacgagccgggcagtgaggtgcacaacgcgatcagcaaggcgcggccgtaccttcagggcgctgtcgagcggacccgcgaccgcatggcgcatcagccgatgtagggctctgcccggtcggtcaggccgtgctcgatccgcatgcgcatcgacgggtggatgttcagctcgtccagcttgctcggatcgacgaaggccacttccttgctctcgctgctcgtccgcagctcgccgccggtgatgcgggcgtgatagcagatggagaactgctggcggacctcgccgtcgtcgtacgccatgacgtgcccggggttggtgtagatgccgacgaggccggtcacctccacgtcgaagccggtctcttccttcgtctcacggaccgctgcgtcgggcgctgactcgcccaggtcgatgccgcctccgggcagggcccagaggtcgttgtcggtcttgtggatcagcaggacctctccagcctcgttgcgggctacggcggtcacggaggggacgaggctgttcgccttcggagcgttggggtcgttgaagtagtcgacacgggccatgggttcagcgtcgcacgtccggggcctgttatgcctcccggcctcgctcccacgcgtagtcgaagctccgcatgtagtgccggaaggtccgcgcgccggggaggtaccgaaagtgcattaccgggttctggccggcgggggctccgaggacgtgcgggttcacgagaacgtcctcgtcgaaccgatagatcgagttgtagaggatcgtgtcgtgcaggcggacttcgacgccgagtgtcgacatggcgggttcgaggtagcggcgggtgatccgcgcgcgtgcggccaggtcgccgccgatgccctcttcttcgccacgctgacggaccgcttcggagtcggggtcgccgagcaggatgcggatctgggcgccggccttcgccttctcggccagctggtcgggcaggtccggatgactgtcgaagaggaacaaaccggcgtacacgaggatgtcgacctggtccgtcgccttctcgatcagggatgaccagagcggagcgggcaccgcgccacggtgcgggtagtacgtgatcagctcggacgtgctggccttctccgcctgcttctctaccgacggccagagatagacctcgtcgactccgaggaagctcgctgccttccagcggtgcccgcggtgtggggtgcgactggtggtgatccaccgttcgacgctcttggggtccacgccgatgtgctcggcaacggactggatcgtctcgcctttcgctgaaatcgccgcgcgcagacgctcgttcgccatgtcgtgtccttcgctgggaccaccggggacgttttgacggtagctcagacgtccctaaacgtccatacgggcggtgatgcgtccacacccttccgcggtctcctgatctcaccgacgggatgtcggtcaacaccccgatacatcaggagacgagacgatgcgtcagatccccgtggacacctcgaacgcgaccgtgatggttgccaaggctccgcagcccaaggtgaaggaccgccgtaccggtgagatcgccaccgacaaggacggcgtcaccctgatggtcgtggaggtcatgttctccacgcccgacgaggtcgagattctcaagctcaccgttccgcagcccggcgtctccgaggacctgaccatgggcaccccggtggcgctgaccggtctggtcgcctcggcgtgggagaacgagttcaacggccagaagaagcacggcatcgccttccgcgcggtcgcggtgacctcgctcgccgccggcgcctcgtcctcgaaggcggcctgagccatgacgtggctgatcgtcgccctggtgctggtcgtcgctgctgcgggtctcctgcggtggcggcgccccgcctggtactggctgaccttcggggtcaccctcgccgcgctgcgggtcctggtccgctacggctcggtcatggacgcctgcggcctcaccgtcccggccccccgctggcgcctgaccttggcccggatgaccaaccggccggttcccggtccgcgggccccgcgcatcctgcggttccgcgtcacccgcaccggtctggtgctgcggctgaagctccggcccggtcaggacgctttcgacgtggccgcgtcgtgtgaccggctgcggcactcgttcgccatgtacggcgtcacctcgcgtgagctgcgctcgggtgtggtggagctgcggatgaccggctacgacgtgctcaagcgcgtgcagatgcccgccctggccgagactcggccgatgcgggtgccggtcgccttgcgcgaggacggggccgtgcactatcgcgactaccgtgccgtgccgcacgggctggtcatcggtgccacggagtccggcaagtcggtctatcagcgcaacctcgtcgccgcgctcgcgccgcagcgggtcgcgctggtggggatcgactgcaagcagggggtggagctgttcccgctggcccgccggttctccgcgctggccgacaaccccgacaccgccgctgaactcctcgacgccctggtgtctcacatgcaggacgtctaccagctgatccgggccgagcagcggatcaccgcggatgtgccggatgcggagatcgctgccgacatctgggacctgcccgagaacctgcgcccggtgccgatcgtggtcctggtcgacgaggtcgccgaactcgccctcttcgccaccaaggacgacgagaagcgccgcgaccggatcatcaccgccctggcccggctcgcccagctcggccgcgctgccggcatctacctcgaaatctgtgggcagcgcttcggctccgagctcggcaagggcatcaccatgcttcgcgcccagctcaccggccgcaccgcccaccgcgtcaacgacgaagccagcgcgaacatggccttcggcgacatcgccccggacgccgtgctggccgcgatctcgatccccaccgacaccccgggcgtcgccatcaccggcgactcggccggcggctgggcccgcatccgcgccccgcacaccacgctgcgccaggccgtgaacgtctgcaaccggcacgccgacctgaccccggacctgcccgctcttgcgccgttccggcccgccctcggcaccctcgccccggtcccggccccggctgtcgagtccgccccggccgccgcctgatcccgcccgggaggttccccatggctaccgcgaagaagcccaccacccgccgcaagatcacgcccccggcgccggagcccgcgctgtgcccggactgcgacggcaagggcgagacccgcgaaaccgtccgcgtcggcgcccgcaagatgcgcgtcaccgacgaccaccagaccgccctgtgcctgacctgctggggcaccggccacgccaccgactgaccccggaaaggaggacacgcgatgcgcaccgttcttcgcccggacgccgtgctcgtacaggccgtgatcgccggtgccctgtccttcgcccacctgcacgacctcgccgccgccgcgggacaggacggctggaaagcctgggcctaccccatctcggtggacctgctcttcgtcgccgcctggcgccgcctgcgcaccgacggaccgtcccggctgtcctggtgttggttcctgatcgccctggccgcctcgctcggcgccaacatcgccaccgccggactcctcgacctcagcgacgtcccggcctggctgcgcatcctcgtcgccggatggcccgccctagccttcctcggcggcaccctcctcgcccactcaccaaccggccacgccccggacccggacccggcgcctgaagtcgagcgcgaaccggagcccgtgcccgaatcagacccggaacctgcggccgtcccggcaccccaggaaaccccggctctgccggtcgccgaaccggccccggttccggcctcgccgccggcggttccggtcccggccgcgctggtcgaccacgcccgcaaggtcgccgccgaccacgaacaccgcaccggctcccggatcgacaccgacaccctgcgcgcccggctcggcgtcccgccgcacctggccgacgccatcgccgcccagctcacctgacccgaaaggagaaccctcgtcatgcctgcccgtgacttcttccactccgtgatgcgcatcggcccggtgcagatcggcacccaccgcgaccggcacggccagaccaagcacgccgccgtgtgcagcaacgacggctgcggctggtccgccgactacaccagccagtccgccgcccagctcgccgcccgcacccaccgctgcaagatccgctaggaggccacccgtggacgtcccgctctggttcgccctgctctgcgtcggagtcctcggcgtcaagctcatccgcccgccctggtggctcatcgccgtactcctcctgggcggctacctcctcgccgacagcctcctggccccggtcatcgacaccgccgtcaagtaaggagatccgcccatgctccggcccaagctcccgaccatgccccagcccaccagcaccgtcaccccgcccgccgtcatcgaaccgaccaccatcaccccgggcaccccgccgccgacccccaccgctccggctccggccccggtgtcggcccggcccacgatgcagctcaccccaggcaccgcgctcgccctcgtcggcggcggcaccgcggtcgtcctggtcgtcggcgccgtcctggtctccatgctcctggccgttgccatcaccgccgcctcggtcgccgtctgcgccgttgtcctgcgctcgctgctcgcctccgacgccaagcgtcgctgaccggtcccgggggcgacgcacaagccgccagcacgccgccacctccgggaccgggctccgccaaccgctctcaccgaaggggaacgctcatggatctgcagatagccgccgccctggtgccgttactgggctgggccgtgcacgggagcatcctcacgcaccgcctcgtctccgcccgccgcgacccgctgaccggcctgcacacccgcgccggatggaccgcccgcgccgaacactgcatccgccgacacccggacgccgccgtcctcctgctcgacctcgaccacttcaagaccctcaacgacacccacggccacgccgccggagacgccgccctcgtcgccaccgccgaccggctgcgcacctggtgcggacgccacggcaccgccggccgtctgggcggggacgagttcgtggccgtcgtccaggacctgaccgccgccgacctggacgcgctgatcgccgcactgcaccggccgctgcactacgccgggaggtcgctgccgctggccgcctcggtcggcgtctgccgcctcgccgagctgccgatgccgctgctgaccgatgcactcgccgccgccgatgcggccatgtacgcggccaagggccgcagccgccggggctcgcgcctctctcgctgaccggccgccgggtggcgcacaagccgccaagcacgccgccacccggggccgttccttccaaccgcaatcgaaaggaaccaccatcatggcccagcacaccccgcccgcgccgcgaatctgcccggcctgcgacggcttcgccaccgtcgccgtcaccctcggcggccgagacccccgcggccacctgcgcaccctcaccaccgactgcccggcctgccacggcaccggcaccgcccccgcccaccgcgtccgggagggcgcccgtgcctgacacgctgctcgacccgacaaccctcggcgacctgctgagggtggcttcggcccccgactacacccgctgggaagaccagatccgccgcaccggcggctgcgccgaccccatccacctgaccggctggacgctccacaaggacaagaccaccggcgccaccctgcaccactacaccaccgccgacgaacccggcggacgcctccgcctcgcctgcggcaaccgccgcgcctcccgctgccccgcctgcgcctggacctacgccggcgacacctaccacctcatccgcgccggactcgccggtgacgaccgccgcgacatccccgccaccgtccgcgaccacccccgcgtcttcgccaccctcaccgccccgtccttcggcccggtccacaaccggcccgaccgcggcacctgccgctgcggcacccaccacgccccggacgctcccgagctgggcaccgccctcgacccggacacctacgactacgcgggcgccgtcctgttcaacaaccacgccggacagctctggcagcgcttcaccaaccgcctccgccgggaggtcgccgcccgcgctggcctcacgcaacgcgaactcaaggagtgcgcccggctgtcgtacggcaaggtcgccgagttccagaaacgcggcgccgtgcacttccacgccgtgatccgcctcgacggacccgacggccccgacaccccgccgcccgtctgggccaccgtggacctgctcaccgacgcgatccgcgccgccgccggccactcctacacctcggtgtccgtcccggccgccgacggccaaccggcccggaccttccgctggggcacccagctcgacgtccgcccggtcaaggcgttcggcgacggctccgacatcaccgaacaggccgtcgcctcctacgtcgccaagtacgccaccaaagccgccgagaacaccggcaccctcgaccgccgcatcggcgaactcgccgaactcgaccgccacggcgtccccgaccacacccgccgcctcatcgaagcctgcaagacgctcgactcgctctaccccgaccgccgcctctgggcctgggcccacatgctcggcttccgcggccacttcagctccaagtcccgccgctactccaccaccctcggcgccctccgccaggcccgcgccgactaccgcgccgcacagggacacgccgccctcggcatcgacgacgccgagccggacaccgtgctcgtcctcgccgactggcagtacgccggccacggccacacccccggcgaatccgtcctcgccgccaccatcgcccgagacctccagctcaaccgacaaaccgcccgcgaagaactcgcagccctggaaggagcctgacgtgaaagacgagctgatgaccgtcccgcagatcctcgatgagctcggtggagtgtcgcggcggacgttctaccggtggcgcgagctggggcaggggccggccgccttcaagcttcccaacggggagctgcgagtttggcggagcgacttccggacctggttgcggcagttggaggccgccgcgtgaagtctctcgacgtgaaggtctggggggttcgaaagaggaacacgaagaagtcgtcctatgacgtccggtggaccgtggccgggaacgtgttctccgaacagttccgcacgaaggggctggcggatcattaccgttccaagctcctccgggctgctcatggaggcgaggagttcgacacagtcacggggctgcctgactcgatggtcgaaaaggcggcctctatgagctggtacgccttcgctctgaggtacctcgccatgaagtggccgcacgctgctcccaacacgcgtaatggcatcaacgagtcgctgaccgcggtgaccatgaccctgctcgacgatcgaccgggtcgaccgccggaggaactgatcaggagggcgctccgcaactgggctttcgtccttcctggtccggacgaccgcgaactgccggatgagatcgcgcacgccctgcactgggtgtcgaaggcttcgcgccctctcgccgatctcggtgacgctgcgatcgccagggccgtgctggacgcgttgaagctgaaactggacggcacagcggcagccgcggagactgttcggcgcaagcgccggacgctcgtcaacgccctgcactatgcggtcgacctcggggagttcaaagagaacccgatcactggcattcgttggaagaaaccgaaggtcgccggagaagtcgatccacgggtggtggccaacccagagcaggcgcgttctttgctgaccgctgtgtcgtacgtcggtgggtacggtcgggcccgcggccgtcgactggttggcctgttcgcctgcatgtattacggggccttccgcccggctgaagctgtcggcctcaccgcggcagacctgaagttgccggagacgggctggggcacggcgttgctgaaccggacgcgtcccagtgctggcaagcagtggacggactcgggagagacccacgacgaccggggcctgaagaatcggccggccgaagaagtgcggctcgtgccgatcccgccccagctcgttgccatcctcaggcggcacctcgacaccttcggtaccgccgaggacgggcggctgttcaccaatgagcgtgggggagtggtcggctcctcgacgtactaccgcgtctggcaggaggcccgtgcgttcgctctcctgccggccgcggtggcctcgccactcgctgcccgtccgtacgacctgcggcactcggcgttgtccacctggctcaacgccggtgtcgacccgaccgaggtcgccgcccgcgcaggcaacagcgtggaggtcttgctgagccggtacgcaaaatgcatcgacgggcggcaagaggtcgtcaatcgcaagatcgaagagttgttgcgcgagtacgagtgacacgtacgtgagcccttagcccccagcccgcatggactgggggcttcgctatatctcggccgcgtgtcgtcggtcgttggttgttggctgcacctgccgcgtcgcttttggcctcgctggcggactgctgccccagaggttccgtccggttcgcgccctacgcctgggctgtcggactggcgaccctcacggtatggggcttttagagagggaaccgcggcggctgagtggtgggcagtcccgttgccctgactgtgggctgttacaggaccgggtgccgacgcttgagcaggattgggtgctgttggagccggacatgaatcccctggcccacacggtgccggcggagcatcggtggatcgaactgtccgatggacgggtgacggtctacgaggtgtgcccgccagatcagtcccagcggtgccgcgtcgagcaccgcctcgcctgcccggcacgacccctgccggatctgtggccgtggttgacctccctacgaggggagaacgcgcggcgagtggaacggcagaatgatccggagccgcctccaccccccgaggagtggccggacgccggctgacgggccctccagaaacttcgggtctgaccaggggagacagtccaagatcctgtccacgaatagtccacagaccccgacatacgcccgctccgagcggcatacggctgcacatacgcgaagaccccggcctcagcgtttccgctggtgacggggtctttggacacctcatgctgggtgcccccggcaggattcgaacctgcgcacacggctccggaggccgttgctctatcccctgagctacgggggcgtgtccgtcgcgttcggtgttgctcgcggcgacgggtagaacactaccagctcgcccggggtggtcatgaacgggttttcgcgggtcgtgacggggcccgtgcggggccctgtcacccgcggagggcggaagtcgggaaaacccggacgcggtggccggtccggacctactctcgagttgtgcctaggccgtccggccggattcttgtcgtcgacgacaacaaggtcatccggcagctgatcagggtcaacctcgagctggagggcttcgaggtcgtgaccgcgggcgatggtgccgagtgtctggaagtcgtccagcaggtgcggcccgacgccgtgacgctggacgtggtcatgcctcggctggacgggctcaggaccgccgcccggctgcgtgccgatccgcgtacccgggaccttccgatcgcgatcgtcagcgcctgtacgcagtacgaggtcgacgccgggtccgccgcgggggccgacgcctttctgtcgaagcccttcgagcccgccgagctggtcggtctggtgcggcagttggtggagcggaagggaagtgggtccaccgtcgtacgcggggcgtccggagcgggccccgggcagccgggtcccggagccggggcctcgccgccgcgggtgcgtgggctcgccggggagagcggggcgtccgcgcaggcgtgaccggggacccgggtgcattcgggtccggtcctggtcccctcgggctgccgcttcgtccatatcccgggaccggcgcacatcggttcgcctccccacccccttcctcccatacgcttgtcccgtgacacccgtagagctctcccgcaccgtgctgcacgcggtgcgtcgcgccgtcgacgcgggggagctgagcgtggccgtgccgacgcgtgccgtggtcgcgccgccggggcccggggggtgcggggactacgccaccggcatcgccctccagctggcccgcccggccgggcagccgccgttccgggtcgccgaggtgttgcggccctacctggtcggaacggacgggatcaccgacgtcgtcctcaccgggccggggttcctcaacatcagcctcgaccgcgccgcctccgacgtcggtctcgtcgccgagatactgcgccgcggggaccggtacgggcacgccgaccaaccggacggccgcgtcgtgcagctccactgcccccacgacctgcgtgccgtcgtcgtcgccgaggcatccgcacggctgctccgctcccagggggccctcgtccgggtgagcgccgaggggttcgaggacgcctggacctccgtcctcggggtcaccgtcgacgccgtcgggcacgcccccgccgagctgcccgtcaacgtccggcccgtccccgcccacggctccgccgacccgatgtccctcgggcgggacgccggacgctgggccctgctccaccccgcggccggcgaccggccccggatcggcgacgagcacctcgtccagcgggaggggaatcccctgttccgcgtgcggtacgcccacgcccgcgcccgggccgccgcccggaacgccgccggtctcgggttcaccgcagcccccggccccgtcgccgagcgcgacctcctcgccgccctcgccgaccacccccgcgtcctcgccgccgccgcggaccaccgcgcccccgaccggctcgcccggcacctcgtcaccgtcgccgacgccgcgctgccgttcctgcccaccgtgctgccccgcggcggggagaaaccctcggccgcccaccgtgcccggctggccctcgccgaagccgtcggggcggtgctggccggcggcctggccctgctcggcatcgacgcacccgaacacctctgagagagcacggaagacgccatgagccgttccgcacaccccgccgggccccgccacgccgacgtcctgcccgaggggcactacaccgccccggccgacgacctcaacgccctcgatcccaaggtctgggcccgcaccgtcgggcgggacgcggacggggtcgtcaccgtcggcgggattcccgtcacgcagctcgccgaggagtacggcacccccgcctacctcctcgacgaggccgacttccgggagcgggcgcgggcgtggcgcaccgcgttcggcgacgacgccgacgtcttctacgccgggaaggccttcctgtcgcgcgcggtcgtgcggtggctggacgaggaagggctcaacctcgacgtgtgttcggggggcgagctcgccaccgccctctccgccgggatgcccgccgagcggatcgccttccacggcaacaacaagtcgccggaggagatcgagcgtgccgtccgggccggggtcgggcggatcgtgctcgactccttccaggagatcgtgcgggtggcccacatcgcccagtcgctcggcaagcggcagcgggtgcagatccggatcaccgtcggggtcgaggcgcacacgcacgagttcatcgccaccgcccacgaggaccagaagttcggtatcccgctggccggcgggcaggcggcggaggccgtgcggcgggccctgaagctggacgggctcgaggtcatcgggatccactcgcacatcgggtcccagatcttcgacatgtcggggttcgaggtcgccgcgcaccgggtcgtgggactgctcaaggacatccgggacgagcacggcgtcgagctgcccgagatcgacctcgggggcgggctcggcatcgcgtacaccagtgacgacgacccccgcgagccgcacgagatcgccaaggcgctgaccgagatcgtgacgcgggagtgcgaggccgcccgactcgccaccccccgcatctccgtcgagcccgggcgggccatcgtggggccgaccgccttcaccctgtacgaggtcggcaccgtcaagcccctcgaagggctgcggacctacgtctccgtcgacggcgggatgtcggacaacatccggaccgcgctctacgacgccgagtacagcgtcgccctcgcctcgcgcacctccgacgccgagccgatgctcgtgcgcgtcgtcggcaagcactgcgagagcggggacatcgtggtcaaggacgccttcctgccgggggacctggcacccggtgacctgatcgccgtaccggcgacgggggcgtactgccgctccatggccagcaactacaaccacgcgctgcggccgccggtcgtcgccgtgcgggacggtgcggcgcgggtcgtcgtgcggcgggagaccgaggaggatctgctgcgtctcgacgtcgggtgaggtccgagggagggaaagctgggggcgggcgaagatcttccggtccgcaccccctcagaaaatgaaataaacgtctcacgatccggacgaaaggcagaaaatcccgtccggtgcgtgagactggtccaaccgtagacggtatgaggaaacgaggtcggatgatgcgtacgcgtccgctgaaggtggcgctgctgggctgtggagtggtcggctcaaaggtggcgcgcatcatgacgacgcacgccgccgacctcgccgcccggatcggggccccggtggagctcgcgggcgtcgccgtacggcggcccgacaaggtgcgggaggggatcgacccggccctcgtcaccaccgacgccaccgcgctcgtcaagcgcggggacatcgacgtcgtcgtcgaggtcatcggggggatcgagcccgcgcggacgctcatcaccaccgccttcgcgcacggcgcctccgtggtctccgccaacaaggcgctcatcgcccaggacggcgccgccctgcacgccgccgccgacgagcacggcaaggacctgtactacgaggccgccgtcgccggtgccatcccgctgatccggccgctgcgcgagtccctcgccggcgacaaggtcaaccgggtgctcggcatcgtcaacgggaccaccaacttcatcctcgacgccatggactcgaccggggccggctatcaggaagcgctcgacgaggccacggccctcgggtacgccgaggccgacccgaccgccgacgtcgagggcttcgacgccgcagccaaggccgccatcctcgccgggatcgccttccacacgcgcgtacgcctcgacgacgtctaccgcgagggcatgaccgaggtcaccgccgccgacttcgcctccgccaaggagatgggctgcaccatcaagctgctcgccatctgcgagcgggcggcggacggagggtcggtcaccgcacgcgtgcatcccgcgatgatcccgctcagccatccgctggccaacgtgcgcgaggcgtacaacgccgtgttcgtggagtccgacgccgccggtcagctcatgttctacgggcccggcgccggcggttcgccgaccgcgtccgccgtgctcggcgacctggtggccgtgtgccgcaaccggctgggcggagcgaccggacccggtgagtccgcgtacgccgccctgcccgtctccccgatgggcgacgtcgtcacgcgctaccacatcagcctcgacgtggccgacaaaccgggcgtgctcgcccaggtcgcgaccgtgttcgcggagcacggtgtctccatcgacaccgtgcggcagtccggcaaggacggcgaggcatccctcgtcgtcgtcacccatcgcgcgtccgacgccgccctcggcggtacggtcgaggcgctgcgcaagctcgacaccgtgcggggtgtcgccagcatcatgcgggttgaaggagagtaaccagcaatgacccaccagtggcgcggaatcatcgaggagtaccgggaccggctgcccgtctccgacagcacgcccgtcgtgacgctccgtgagggcggcaccccgctcgtgcccgcgcaggtgctctccgagcgcacgggctgcgaggtccacctcaaggtcgagggggcgaacccgaccgggtccttcaaggaccgtggcatgaccatggccatcagcaaggccaaggaggagggcgcgcaggccgtcatctgcgcgtccaccgggaacacgtccgcgagtgccgccgcgtacggcgtgcgcgcgggcatggtctccgccgtgctcgtgccgcagggcaagatcgcgctcggcaagatgggccaggccctcgtgcacggcgcgaagatcctccaggtcgacggcaacttcgacgactgcctcacgctggcccgtgcgctcagcgacaactacccggtggcactggtcaattcggtcaacccggtgcgtatcgaggggcagaagacggccgccttcgagatcgtggacatgctcggcgacgcgcccgacatacatgtccttcccgtgggcaacgcgggcaacatcaccgcgtactggaaggggtaccaggagtacgccgccgacggggtcagcaccaagaagccccgcatgtgggggttccaggcctccggctccgccccgatcgtgcgcggcgaggtcgtcaaggacccgtcgaccatcgccaccgccatccggatcggcaaccccgcctcgtgggacttcgcgctcgccgcgcgcgacgagtcgggcggcgccatcgacgaggtgacggaccgtgagatcctgcgcgcctaccggctgttggcctcgcaggagggcgtcttcgtggagcccgcctccgccgcctccgtggccggtctgctgaaggccgccgagcagggcaaggtcgacccggggcagcgcatcgtgtgcaccgtcaccggcaacgggctgaaggacccggactgggccgtcgccggcgcgccgcagccggtcaccgtcccggtcgacgcggcgacggcggccgagcggctcgggctggtctgagccccgcgccggtgaaaggcgcccggcgcaggagggcgtaggcgacgcccggccgggaaagtcactgacggggggtgcacagggggcttacgacacgcatcgtgcgcctcctgtgcgccctatgtcgccacagaaccttccttcgataggctgtacctaacccgcctgccgcatatgccgcggtgccgcgccgtctccgcggtcgcgcccagggttctgtacgtcatcgtcgtcgtcatcgaatgtcattcgacagtcccgcagctcaaggagagtcatctagcgatggccggtccagcgttccgcgccgccgccgtcagggtgcgcgtccccgccaccagcgccaacctcggtccgggcttcgacgccctgggcctcgcgctgggtctgtacgacgacgtggtcgtccgggtggccgactccgggctgcacatcgacatcgcgggtgagggcagcgagacccttccgcgcgacgagaagcacctcctcgtccgctccctgcgcaccgccttcgacctgctcggcgggcagccgcgcggcctggagatcgtctgcgccaaccgcatcccgcacggccgcggcctcggctcctcctctgccgccatctgcgccggaatcgtcgccgcgcgcgccgtgacgataggcggcgaggcccgcctcgacgacgccgcgctgctcgacctcgccaccgagatcgagggccaccccgacaacgtggcggcctgtctcctgggcggattcaccctttcctggatggagtccggcgccgcccgggcgatcaggatggagccctccgattccatcgttccggtggttttcgtgcccggaaagccggtactgacccagaccgcgcgcgggctgctcccgcgcagcgttccgcacgtcgacgccgccgccaacgccggccgcgccgcgctgctcgtcgaggccctcaccaggcgccccgagctgctgctgccggccaccgaggaccgcctgcaccaggagtaccgcgcgccggccatgccggagagcacggcgctggtggaaaggctgcgtggcgacggcattcccgcggtgatctcgggtgccggacccacggtgatggcactggccgacgccgacacggccgacaaggtcgaggcgctggccggaacggactgggcggccaaccggctcggcctggaccagcagggcgcgaccgtcctgcccctggcgaccgccagcgacacctgacgcgcacggttgccggatttcgagagggggaatgtttgttggatccggtagtgttaacctcaagtctgcacccgaccccaccatggcgaggtgcctcgtgtccccgtccgggacagacattcttccgggagccccccaagccgcattctgcagtggatgccgtacgtgatcagtacggccgacacgggcattgagcggcccaccggtgggggttacccccactgggggagtttcggaaccggtgcgaccacgccgcatgacacagacaccgggtgccacggctaggggaagcgccatcaccagatatctcttccgccgttcaggcggaccaccgccccggcacggttcacacagcaaggaccgaagccggacagcacaaccggtcgccgagccagacaggccgacgtccgctccagggaaggacccttcgtgagcgacaccaccgatctgatgggcgcacgtgtcgaggagaccgctgccgcgcccgccacggacgcctccgcgcctgccaccggtgccggctcccggcggcgccgcggtaccggcctcgagggcatggtgctggccgagctgcagcaggtcgcatccggcctcggcatcaggggcaccgcgcgtatgcgcaagagccagctgatcgaggtcatcaaggaggcgcaggccgcggggggagcccccgccaaggccgcgcccgccgccgcggacaccgccggcgagaccaagcccaagcgccgcagcacctcccggacccgtacgggcgacgaggcacccgccgagaaggcggagaaggccggcaaggccgacaagaaggcggacaaggcggccgccgacaaggccgccgcccagcagcagatcgagatccccggtcagccgtcccccaaggtcaacgcctcggccgagcaggccgcgcccgccgacgacgccccctccgagcgccgtcgtcgccgggccacctccgacgcgggcagcccgtccgccaccgacacgacggtggccgtcgagacccgcgccgagccgaaggccgacacgtcggccccgcagcagtcgcagggtcaccagcagggccagggcgacgcccgttccgacgccgagggcggcgacggccgccgccgcgaccgcagagaccgcggcgaccgcgaccgcggtgaccgtggcgagcgcggccgcgaccggcgcaacaagggcgacgaccagcagaaccagggcggcggtcggcaggaccgccagcagcagggcggcggacgccaggaccgtcagcagcacgacgacggttacgacgacgacggcagcggccgtcggggccgccgcggccgctaccgggaccgccggggccgtcgcggacgcgacgagatccaggagccgcagatcaacgaggacgacgtcctcatcccggtcgccggcatcctcgacatccttgacaactacgcgttcatccggacctccggctacctgcccggcccgaacgacgtgtacgtctccctcgcccaggtccgcaagaacggcctgcgcaagggcgaccacctcaccggtgccgtgcgccagcccaaggagggcgagcgccgcgagaagttcaacgcgctggtgcgcctggactcggtcaacggcatggcccccgaacacggccgcggtcgcccggagttcaacaagctcaccccgctgtacccgcaggaccgcctccgtctggagacggacccgggcgtcctcaccacccgcatcatcgacctggtcgcgccgatcggtaaggggcagcgcggtctgatcgtggccccgccgaagaccggcaagaccatgatcatgcaggcgatcgccaacgcgatcacgcacaacaaccccgagtgccacctgatggtcgtcctggtcgacgagcgtccggaagaggtcaccgacatgcagcggtcggtgaagggcgaggtcatctcctcgaccttcgaccgcccggccgaggaccacaccacggtcgccgagctggccatcgagcgcgccaagcgcctggtggagctgggccacgacgtcgtcgtgctgctcgactcgatcacgcgtctgggccgtgcgtacaacctcgccgccccggcctccggccgcatcctgtccggtggtgtcgactcgaccgccctgtacccgccgaagcgcttcttcggtgcggcccgcaacatcgaggacggcggttcgctgaccatcctcgccaccgccctggtggacaccgggtcccgcatggacgaggtcatcttcgaggagttcaagggcaccggcaacgccgagctcaagctcgaccggaagctcgccgacaagcgcatcttcccggcggtggacgtggacgcgtccggcacccgcaaggaagagatcctgctcggcagcgacgaactcgccatcacctggaagctgcgccgtgtgctgcacgcgctcgaccagcagcaggcgatcgaactgctcctcgacaagatgaagcagacgaagtcgaacgccgagttcctgatgcagatccagaagacgacgccgacgcccggcaacggcgactgagtcaccgccgcgcaccgcaggggccgcctccgtttcgggggcggccccttcgtcatgggcgcctgcccgtgcctacggcctccacccgtgaccctgcgcccacgaccaccatcacctacgcccccacctacgcctcccacctgcgatcaccacctacgcccccacctgcgaccttcgccacacggaccggcccggacggtgtcccggcgggtccgggccggagctcgcggatgcccaggtcagcgaggtggagcggggcggaacgaacacgctccgtcaccgattccccaccgggtcgccacagaccgttgtgcaaccctgtcccgagttccgccgtctgagctacggagggaccatggtgaggtagcggcgccgaccaccggagccgagccgaccgacccgaccctgagcgcagggggtaaccgaccggacgaacaccgaggagcccatgtccgccgagagcacgccggatcccgcgatacccggccccggccagtcccgcacccccggccccggccgccggggcaagggccgccgccgcaagcccacggccaagcggcgcaaggccctgctcgtcgcggcctggagcgccgcgggcatcgtggtcctcggcggcaccggagccggagtcctgtacttcaagctcaacggcaacctcacgagcgtcgacatcgaccaggcgctcggcgccgaccggcccgagaaggccgacaacggctcggagaacatcctggtcctcggctccgacacccgctccggcggcaacaagaagctgggcggcggcaccgacgacggcaccgcccgctcggacacggcgatgatcgtgcacgtctacaagggccacaagaaggccagcgtggtctccatcccgcgcgacaccctcatcgaccgccccgactgcaccgacaccgacgggggcgagcacccggccgccgacggcgtgatgttcaactccgcgtactccaccggtggcgcggcctgtgccgtgaagaccgtcgagtcgatcagcggcctgcgcatggaccactacctcgaggtcgacttcagcggcttccagaacctcatcgacgacctcggcggcgtacaggtcaccaccaccgaggacatcaaggaccccgacagccacctcgacctcacggccggcacccaccggctcgacggcgagcaggccctcggcctggtccgcacccggcacggcgtcggcgacggctccgacctcggccgcatccagctccagcaggccttcgtcaaggccctggtcgaccaggtcaaggacatcggcctgctcggcaaccccaagaagctgtacgacgtcgccgacaccgccaccaagaccgtcaccaccgactccgacctgggctcggtgaactccctgatgtccttcgcgagcggcctgaagggcatcggcccggacaagatgcacatggtcaccatgccggtcgtctacgaccccgccgacgccaaccgcgtcctggtcgagaaggacaaggcccagcaggtctggacggccctgaagaacgaccgcccgatcccgaaggcggccacggagggcacggccaccggcgaggcgaagggcgtcgtcaacaccggggaatagttcaccccgccccccggttttgggggatggcaccagtcctggcagactggtacgtcggctccggttcacgcttccgcatcccgcggctgcgacccggcgccctcccggaacactaggagacaccttgaagcgcgacatccaccccgagtacgtcgagacgcaggtcagctgcacctgtggcgcgtcgttcaccacccgcagcacgatcgagagcggcaccatccgcgccgaggtctgctccgagtgccacccgttctacacgggcaagcagaagatcctcgacaccggtggccgcgtggcccgcttcgaggcccgcttcggcaaggcttccgccggctccaagaagtagcgagcctccaaccgccggtccacggccgcatcccctccccggggagcgccgggaccggcgtttttggtcgcccgacttccctttcccacgcagtagcaggagcccaagatgttcgaggccgtcgaggaactcgtcgccgagcacgccgacctggagaagaagctcgccgacccgtcggtccactccgaccaggcgaacgcgcgcaagctgaacaagcggtacgccgagctgaccccgatcgtcgccacgttccgctcctggaagcagaccggcgacgacatggagaccgcgcgcgagttcgcggccgacgaccccgacttcgccgccgaggtcaaggagctggacaagcagcgcgacgagctcaccgagaagctgcggctgctcctcgtcccgcgcgaccccagcgacgacaaggacgtcatcctcgagatcaaggccggcgccggcggcgacgagtcggcgctcttcgccggcgacctgctgcgcatgtacctgcgctacgccgagcggatcggctggaagaccgagatcatcgactccaccgagtccgagctgggcggctacaaggacgtccaggtcgccgtgaagaccaagggcggccagggcgccaccgagcccggccagggcgtctgggcgcggctcaagtacgagggcggcgtgcaccgcgtgcagcgcgtccccgccaccgagtcccagggccgcatccacacctccgcggcgggcgtcctcgtgacccccgaggccgaggagatcgacgtcgagatcaaccccaacgacctgcgcatcgacgtctaccgctcctccgggcccggcggccagtccgtcaacaccaccgactccgccgtgcgcatcacgcacatcccgaccggagtcgtcgcctcctgccagaacgagaagagccagctgcagaacaaggagcaggcgatgcgtatcctgcgctccaggctgctcgcggcggcgcaggaggaggcggagaaggaggccgcggacgcccggcgaagccaggtccgcaccgtcgaccgctccgagaagatccgcacgtacaacttcccggagaaccgcatctcggaccaccgcgtcggcttcaaggcgtacaacctggaccaggtcctggacggcgacctcgactcggtgatccaggcctgcgtcgacgcggactcggcggccaagctcgccgccgcgtgagccccgtcagcccgtagccgcacccgtacgcccgtaccggacgaccagctcagccccggaggaccagcgtgaacctgctgctcgcggaggtggcccaggccacccagcggctggccgacgccggcgtgccctcgccgcgcaccgacgcggaggaactcgccgcgtacctgcacggcgtcaagcggggcgagctgcacaccgtgccggacgcggacttcgacgcccggtactgggaggtcgtcgcccgccgcgaggcgcgcgagccgctccagcacatcaccggccgcgcctacttccgctacctggagctccaggtcggccccggcgtcttcgtgccccgccccgagaccgagtcggtcgtcggctgggccatagacgcggtgcgcgccatggacgtcgtcgagccctgcatcgtcgacctgtgcaccggctcgggcgccatcgcgctcgccctcgcccaggaggtgccgcgctcgcgcgtgcacgccgtggagctgtccgaggacgccctcaagtggacgcgcaggaacatggaggggtccagggtcgacctgcgccagggagacgccctgacggccttcccggacctcgacggccaggtcgacctggtggtctccaacccgccgtacatcccgctcaccgagtgggagtacgtcgcgcccgaggcccgcgaccacgatccggagctggccctgttctccggcgaggacggcctcgacctgatccgcggcctggaacgcaccgcgcaccgcctgctgcgccccggcggcgtggtcgtcgtcgagcacgccgacacccagggcggccaggtgccgtggatcttcaccgaggagcggggctgggccgacgcggccgaccaccccgacctcaacaaccgacctcgtttcgcgacggcccgcaaggcactgccgtgaacaccccgacgacccccaccccgcagtacgtgtacgaggaggccagctagatggcacggcgttacgacaccaacgacgcgaccgaccgagtgaccggtctgcgtgaggccgcgtccgccgtccgccgtggcgagctcgtggtgctgccgacggacaccgtgtacggcatcggcgccgacgccttcgccgcggaggccgtcggcgacctgctggaggccaaggggcggggccgcaacatgccctcaccggtgctcatcggctccccgaacaccctgcacggcctggtcaccgacttctccgagatggcctgggagctggtcgacgccttctggcccggcgcgctgaccctggtcgccaagcaccagccgtccctccagtgggacctgggcgagacccggggcacggtcgccgtccgcatgccgctgcacccggtcgccatcgagctgctcaccgaggtcggccccatggccgtctcgtccgccaacctgaccggccacccggcgcccgaggactgcgacgccgcccagcagatgctcggcgactccgtctccgtctacctcgacggcggccccacgcccggcatcgtcccgtcgtccatcgtcgacgtcacccgcgaggtgccggtcctgctgcgcgcgggcgcgctgtcggcggaggaactgcgcaaggtggtacccgacctcgaggtggcgaattgacggcccctgagacggggcgtggcataggcaacggggaacgcgccgcggagatcacgaccacgttcgtcggcctcccgcgcgacagcttccgcatcctccacgtcagcaccggaaacgtctgccgctcgccgatcaccgagcggctgacccggcacgcggtgcaggagcggctcggcgtgctgggcggcggcctgatcgtggagagcgcgggcacctggggccacgagggcgcgcccatggaggcgaacgccgagacggtcctcacggacttcggcgccgaccccgccggcttcaccggccgcgagctgctcgacgagcacgtgatccgcgccgacctggtcctcaccgcgacccgggaccaccgggcccaggtcatctccatgggccactcggcgggcctgcgcaccttcaccctgaaggagttcacccgcctggtgaacgccatcgacccggcgacgctccctcccctggaggacggcgtggtcacccgcgcccgcgccctggtccgcgccgccgccgcgctacgcgggtggctcctggcccccacggtcgaggcggacgaggtctacgacccgtacggcgccccgctgcccttcttccgctccatcggcgacgagatacaccaggccctcgaccccgtggtgacggcgctgacgggggtcccggcgcggatgtagggccccgccacgcgcacgccgggcgtcttcgtcgtggcgggcctacattggtgctacgtcaccgtcgacgcacgcccggagcgcaccatgtcggtcacccacgagatcatcgaggccgatgacagttcggtcggagtcctgctgcgccaggatcccgagctggccgagatcctgttcgccgaaggccgccgccagtcgacgaccctccagctcatcgccgccgagaacttcacctccccggccgtgctggccgccctcggctcaccgctggccaacaagtacgccgagggctacccgggcgcccgccaccacggcggctgcgagatcgtcgacgtggccgagcggctggccgcccagcgggcccaggcgctcttcggcgccgagcacgccaacgtgcagtcccactccggctcctccgccgtgctggccgcctacgccgccctgctgcgccccggcgacaccgtcctcgccctcggcctgccctacggcggccacctcacccacggctcacccgccaacttctccggccgctggttcgacttcgtcggctacggcgtggacgcggagaccgggctgatcgaccacgaccaggtgcgcaccctggcccgcgcccgccggcccaaggcgatcgtctgcggctccatcgcctacccccgccacctcgactacgccgccttccgcgacatcgccgacgaggtgggcgcctatctcatcgccgacgccgcccacccgatcggactcgtcgccgggggagcggcgcccagtccggtgccgtacgccgacatcgtgtgcgccaccacgcacaaggtgctgcgcggaccccgcggcggcatgatcctgtgcggaagcgaactggcggaacgggtcgaccgggccgtcttcccgttcacccagggcggcgcccagatgcacaccatcgccgccaaggccgtcgccttcggggaggcggcgacccccgccttcgccgcctacgcccaccaggtggtcgccaacgcccgggcgctcgcggcccacctggccgccgagggcctggtcgtcaccaccggcggcaccgacacccacctgctcaccgccgaccccgccccgctcggcgtcgacgggaagaccgcccgggggctgctcgcggcggccgggatcgtcctggactgctgcgcactgccgcacgccgacgcccgcgggctgcgcctgggcaccgccgcggtcaccacacagggcatgggggagcgggagatgcgggcggtggccacactggtcgccggggttctgcgggggacgacggacccggccgcggcacgggcggacgtaagggacctgaccgcggaattccccccgtacccggactgaggccgggtaggagtacaggcgtacacagccgcacgtgcaaccatcgtcgatacccggaagtcctcaaccgtatgcgtcgcattgccatgcgcatcgctagggtgtggggttgaggatggccagcgagacctgtggggaagcccgtgcgtgaatacctgctgacgctctgcatcacggccgcggtgacgtatctgctgacagggccggtacggaagttcgcgatcgtggcgggggcgatgccggagatccgggcacgtgacgtgcaccgggaacccactccgcggctcggcgggatcgccatgttcttcgggctgtgcgccggcctgctggtcgccgaccacctcaccaacctcagcgaggtcttcgagaagtccaacgagccgcgcgccctgctctccggggccgccctgatctggctgatcggtgtcctggacgacaagttcgagatcgacgccctgatcaagctcggcggccagatgatcgccgccggcgtgatggtggtgcagggtctgaccatcctgtggatcccggtgccgggcgtcggcacggtcgcgctgacccagtggcagggcaccctgctgacggtggcgctggtcgtcatcaccatcaacgcggtcaacttcgtggacggcctggacggtctcgcggccggcatggtgtgcatcgcggcggcggcgttcttcatgtacgcctaccggatctggtactcgtacggcatcgaggccgcggctcccgcctcgctcttcgcggtcatcctcatgggcatgtgcctcggcttcctgccgcacaacatgcaccccgcccggatcttcatgggcgactccggctccatgctgatcgggcttgtgctggcggccggcgcgatctccgtgaccggacaggtcgaccccgacctgatgaacctgttctccgggtcggagcgcaactcggtgcaccagatggtgccggtctacatcccgctggtgatgccgctgaccatcatcgccatcccggccgccgacctgatcctggccatcgtgcgccgcacctggcgcggccagtcgccgttcgccgcggaccgggggcacctgcaccaccgcctgctggagatcggccactcgcacagccgcgcggtgctgatcatgtacttcttctcggcactcatcgcgttcggcgcgctcgcctactccgtgaacgcggcgtcgatgtggatcgtgctgagcgtcgtcttcctcagcgcgatcggtctggtgctgctcctgctgccgcggttcaccccgcgcgccccgcgctgggccgagagtctggtgccgccgcgctaccggcgccgcaaggccgctgtcgccgaggacggcggggccggggacgcggcggtcgaggccgagggcgaggagcgcgttccggtcacggtgggtgtctcgggcgtcaacggggcgaccgccgtcgggcaccgtacggggacccggtaggagcgggaaatcgccgcaataccagacaagttgccgctgtgactgcacaaacgcgcagggtcactctcacgtgtgacagcaagcacacccagaggtaaagacctcatcaaatagtttgtgatacggttcacgagtatcccccgggtagagcccaaggaccgtagtgcgacggtctcttgtaagtgaggacctcgtccggctcggggctacgctcgtccatgacgacacctgccccctgtgtgttgaaagcggagttgccgccatgccgtccaatgacgtccggatcctgcttcaggctgccgtgcccgcggctgccgtcggcgctgtagccgccgtcgtcagcgccgtggtcgccggcggcaagggggcggtcggagccgtcgtcgcgaccgtgctcgcgatgctcttcatgggaatcggcctctacgtcctgcagcgcaccgccaagtcgcttccgcaccttttccaggcgatgggcctgatgctctacgcggcacagatcctgctgctgttcgtcttcctcgccgcgttcaagaacacgacgctgttcaacccccgttccttcgcggtcagtctgctcgtcgtcacgctcgcgtggatcgccgcgcagacgcgggcgcacatgaaggccaaggttctctacgtcgagcccgaaccgacgggcgaaaagcccgaaaagacgggccactcgtcgtgaggggtagggccgggataaagaggcatgtgaagtcctgctatcgtccggtgccaactgcggcatcgcgggcgcgggcatctcggctgacgcctgctgaatcgcgaggcgagatgccccacagccgcccccacacccgtaacaccagtcccgtgccgaacagcggccccgcgccgcgccgacacaacgaggttgccgtatccatgcgccacgctgaaggagcccgcggtgagtgctgacccgacgcaggtgctcgccttcgagaccgactgccacatcttcgacggttgtggcttcccttctcccggcctgcactcgttcctgttcgagcccctgtggggcgaccacgacagcaacttgtacttcaacaagccgatgctgctggcgctgctggggtcgatcgtcatcgtcgggttcttctgggcggccttccgcaagccgaaggtcgtccccggcaagctccagatggtcgccgaggcgggttacgacttcatccggcgcggagtcgtctacgagaccatcggcaagaaggaaggcgagaagtacgttccgctcgtcgtctcgctcttcttcttcgtctggatgatgaacctctggtcgatcattccggtcgcccagttcccggtcacctcgatcatcgcctacccggcggtgctcgccgcgatcgtctacgtcacctggatcacgctgaccttcaagcgtcagggattcgtcgggttcttcaagaacgtcaccggctacgacaagtcgctcggcccggtgctgccgctggccatgctgatcgagttcttctcgaacatcctgatccggcccttcacccacgccgtgcgactcttcgcgaacatgttcgcgggtcacaccctgctgcttctgttcacgatcgccagctggtacctgctgaacggcgtcggcatcgcctacgcgggcgtctcgttcatcatgaccgtggtgatgaccgccttcgagctgttcatccaggctctgcaggcgtacgtgttcgtcctgctgacgtgcacctacatccagggcgccatggccgagcaccactgagcaagcgcgcctagacctctcacagtcgtccggtggccaacccccaccggtccgtaaagaaaaggaagaactggcatgtcccagacccttgctgccgtcgaaggttccctcggttccatcggttacggcctcgctgccatcggccccggcgtcggcgtcggcatcatcttcggcaacggcacccaggccatggcccgtcagcccgaggcggccggcctgatccgcgccaaccagatcctgggcttcgccttctgtgaggcgctcgccctgatcggtctggtcatgccgttcgtctacggctactgatcgctgatcccagaccagccgactagacgaaaggcaaacccatgagcccgatgctccagatcgcggccgaggagatggaaaatcccctcatcccgccgatccccgagctcgtcatcggcctgatcgccttcgtcatcgtcttcggcttcctcgccaagaagctcctcccgaacatcaacaaggttctggaagagcgtcgcgaggccatcgagggcggtatcgagaaggccgaggccgcgcagaccgaggcccagagcgtcctcgagcagtacaaggcgcagctcgccgaggcccggcacgaggccgcgcgactgcgccaggaggcgcaggagcagggcgccacgctcatcgcggagatgcgcgcggaaggccagcggcagcgtgaggagatcatcgccgccggtcacgcccagatccaggccgaccgcaaggccgccgcgtccgcgctgcgccaggacgtcggcaagctggccaccgagctggccggcaagctggtcggcgagtccctggaggaccacgcccgccagagccgtgtgatcgaccgcttcctggacgagctggacgacaaggcgacgacggcagaggcaacccgatgagtgggatgcacggagcgagccgcgaggccctggccgccgcacgcgagcgcctcgacgcgctgacggactccacgtccgtggacgccggctcgctcgccgacgagctggccgccgtcaccgcgctgctccaccgcgaggtgtcgctgcgtcgggtcctcaccgacccggcgcagtcgggcgaggccaaggccgagctcgcccagcgtctcctcggcacccaggtcagcggcaccgccgtcgacctggtggccggcaccgtgcgctcccgctggtcgcagtcccgcgacctggtggacgcgctggagcagctggcgaacatcgccgacctcaccgccgcccagaagcggggccggctcgacaacgtcgaggacgagctgttccggttcggccggatcatctcctccaacaccgagctgcgcgccgcgctcaccagccggtcggccaccaccgcggccaagagcgagctgctggccggcctgctcggcagccgggcggagcggaccaccgagcgtctggtgacgcgccttgtcaccgcgccgcggggacgtagcctggagtcgggactcgagtccctgtccaagctcgccgccgaccggcgggaccggatggtcgccgtggtcacctcggcggtgccgctgagcgacacgcagaagcagcgcctcggcgcggccctcgcgaaggtctacggccgtccgatgcacctgaacctcgacgtggaccccgaggtcctcggcgggatccgggtgcaggtgggtgacgaggtcatcaacggctccatcgcggaccgtctggaggacgccggccgccggctggcgagctgacgcccccgcgacggcgatcgcgacaacagcacagcacttagcagcaccgcagtaaccgagcagtagcagtacgtacttacgacggccctggttgggccgtgcagaggattcacctctcattggggggagtcccgactcgtggaataccccccaagtgaaacttcgggcccaacaaggagagcagggaactcagatggcggagctcacgatccggccggaggagatccgggacgcactggagaacttcgtccagtcgtacaagccggacgcggcctcgcgcgaggaggtcggtacggtcacccttgccggcgacggcatcgcgaaggtcgagggcctgccctcggccatggccaacgaactgctgaagttcgaggacggcaccctcggcctcgccctcaacctcgaggagcgcgagatcggttgcgtcgtcctcggtgagttcagcggcatcgaggaggggcagccggtctcgcgtaccggtgaggtcctctccgtggccgtcggcgagggctacctcggccgcgtcgtcgaccccctcggcaacccgatcgacggcctcggcgagatcgagacctccggtcgccgcgccctcgaactgcaggcccccacggtcatgcagcgcaagtcggtgcacgagccgatggagacgggctacaaggccgtcgacgccatgacgccgatcggccgcggtcagcgtcagctgatcatcggcgaccgtcagaccggcaagaccgccctggccgtcgacacgatcatcaaccagcgcgacaactggcgcaccggcgacccgaacaagcaggtccgctgcatctacgtcgccatcggccagaagggctccaccatcgcgtccgtgcgcggcgcgctggaggagaacggcgcgctggagtacacgaccatcgtggccgccccggcgtccgacccggccggcttcaagtacctggcgccgtacaccggctcggccatcggccagcagtggatgtacgagggcaagcacgtcctgatcatcttcgacgacctgtcgaagcaggccgacgcctaccgcgccgtgtcgctgctgctgcgccgcccgccgggccgcgaggcctacccgggtgacgtcttctacctgcactcccgtctgctggagcgctgcgcgaagctctccgacgccgagggcgccggctcgatgaccggtctgccgatcgtcgagaccaaggccaacgacgtgtcggcgttcatcccgaccaacgtcatctccatcaccgacggccagtgcttcctggagtccgacctgttcaacgccggtcagcgtccggccctgaacgtcggtatctcggtctcccgcgtcggtggctccgcccagcacaaggccatgaagcaggtctccggccgcctccgcgtcgacctcgcccagttccgcgagctggaggcgttcgccgccttcggttccgacctggacgccgcgtcgaagtcgcagctggagcgcggtcagcgcatggtcgagctgctgaagcagaaccagtaccagccgatgtccaccgaggaccaggtcgtctccgtctgggccggcaccaccggcaagatggacgaggtgcccgtcgccgacatccgccgcttcgagaaggagctgctggagtacctgcaccgccaggagcagggcctcatgacctccatccgcgagggcggcaagatgtccgacgacaccctgcaggccgtcgccgaggccatcgcggcgttcaagaagcagttcgagacgagcgacggcaagctgctcggcgaggacgccccgtccgccgccaagtgacgtaaggaagggacctgactcatgggagcccagctccgggtctacaagcgtcgcatccgatccgtcaccgcgaccaagaagatcaccaaggcgatggagatgatcgccgcctcgcgcgtcgtcaaggcgcagcgcaaggtggcggcctccacgccgtacgcgcgggagctcacccgcgcggtcacggcggtcggtaccgggtcgaacacgaagcacccgctcaccacggaggcggacagcccgagccgtgccgcggtcctgctcctcacgagcgaccgcggtctggccggcgccttcaactccaactccatcaaggcggcggagcagctgaccgagcgcctcgagcgtgaaggccgccaggtcgacacgtacatcgtcggccgccgcggtctggcccactacaacttccgcgagcgcaaggtcgtggagtcgttcgcgggcttcaccgacgagccgacgtacgcggacgccaagaaggtcgcggcgccgctgatcgaggccatcgagaaggacacggcggagggcggcgtggacgagctccacatcgtctacaccgagttcgtctcgatgatgacgcagacggcggtcgactcccggctgctgccgctgagcctcgacgaggtggccgaggagtcgggcgcgaaggacgagatccttccgctgtacgacttcgagccgtcggcggaggacgtcctcgacgccctgctgccgcgctacgtcgaaagccgcatctacaacgcgctgctccagtcggctgcctccaagcacgccgccacccggcgcgcgatgaagtcggccaccgacaacgcgggcgagctgatcaacacgctctcccgtcttgccaacgcggcccgccaggccgaaatcacccaggaaatcagcgagatcgtcggtggcgccagtgccctggccgacgcgaacgcggggagtgacaactaatgaccaccactgttgagaccgcgacggccacgggccgcgtcgcccgggtcatcggcccggtcgtcgacgtggagttccccgtcgacgcgatgccggagatctacaacgcgctgcacgtagaggtcgccgacccggccaaggagggcgagctcaagacgctgaccctcgaggtcgcccagcacctcggtgacggcctggtccgcaccatctccatgcagcccaccgacggcctgatccgtcaggccccggtgaccgacacgggcgcggccatctccgtccccgtcggcgacttcaccaagggcaaggtgttcaacaccctcggtgaggtgctgaacgtcgacgagcagtacaccggtgagcgctggccgatccaccgcaaggccccgaacttcgacgagctcgagtcgaagaccgagatgttcgagaccggcgtcaaggtcatcgacctgctgaccccgtacgtcaagggcggcaagatcggtctgttcggcggtgccggcgtcggcaagacggtgctcatccaggagatgatctaccgcgtcgccaacaaccacgacggtgtctccgtgttcgccggtgtcggcgagcgcacccgtgagggcaacgacctcatcgacgagatgagcgagtccggcgtcatcgacaagaccgcgctggtcttcggtcagatggacgagccgccgggcacccgtctgcgcgtcgcgctggccggcctcaccatggccgagtacttccgcgacgtccagaagcaggacgtgctgttcttcatcgacaacatcttccgcttcacccaggcgggctccgaggtgtcgaccctgctcggccgcatgccctccgcggtgggctaccagccgaacctggccgacgagatgggtctcctccaggagcgcatcacctcgacccgtggtcactcgatcacctcgatgcaggcgatctacgtccccgcggacgacctgaccgacccggccccggccaccaccttcgcccacctcgacgcgacgacggtgctctcccgtccgatctccgagaagggcatctacccggccgtggacccgctggactcgacgtcccgcatcctcgacccgcggtacatcgcggcggagcactacaacgccgcgatgcgcgtgaagaacatcctgcagaagtacaaggacctgcaggacatcatcgcgatcctcggtatcgacgagctgggcgaagaggacaagctcgtcgtccaccgcgcccgtcgcgtggagcgcttcctgtcccagaacacccacgtcgccaagcagttcaccggcgtcgacgggtcggacgtcccgctggacgagtcgatcgcggccttcaacgcgatctgcgacggcgagtacgaccacttcccggagcaggcgttcttcatgtgcggtggcatcgaggacctgaagaacaacgccaaggagctgggcgtctcctgagcctcggctcacggtgagccgcacggttcaccacccggagggggcgggcgcgtcccgtcccctccggcacgccccttagacttgtaaccaacacccggctctcccgccgggtggtgacccgaggagccaccttggctgctgagctgcacgtcgcgctggtcgcggccgaccgagaggtctggtccggcgaggccaccctggtcgtcgcgcgcaccacgtccggcgacatcggcgtcatgcccggtcaccagccgctgctcggtgtgctggagtcgggcccggtgaccattcgtacgagtgacggcgggacggtcgtcgccgcggtgcacggcggtttcatctcgttcgccgacaacaagctgtcgctgctggccgaggtcgccgagctgtcggacgagatcgacgtccaccgcgccgagcgcaagctcgaacaggcgaagacggagggcgacgcccacgccgagcgccgcgcggacgtccgactgcgcgcggcggcgggacgctgatccacagcacagtgcgatagcgtcgtgccatgacgtcactcagccgcggctgggaccggagccatccggacccggccgcggctgaggcagatccgggtgttttttccgttccgttacctaggagacgaggaggtcggtgtcgatggccctcgctctgactgtgtgcggaatcgtcgtggccgtggtggtgatcggcctcttcgtcttcggtctgcgccgccggctgatccagcgctcgggcggcaccttcgactgctccctgcgctgggacgcccccaaggagggtgacaccaccgacggcaagggctgggcgtacggggtggcccgctacaacggcgaccgggtcgagtggtaccgcgtcttctcgtactccccgcgcccgcgccgcgtcctggagcgctccgcgatcgaggtggccggccgacggctgccggacggcgaggaggagctggcgttgctgtccgacgccgtgatcctggcctgtctccaccggggcacccggctggaactggcgatgagcgaagacgcgctgaccggattcctcgcgtggctcgaggcagccccgcccggtcagcgcgtcaatgtcgcctagttgtcctgacagctggtgttacttgaggccgctgtcgatggcgctcaccagttcgccgttcgtggtgtcgccgctgaactcccagaagaaggcgccgccgaggccctgctgctccgcccagtccatcttggacttgatggtggccggggtgtcgtaggaccaccagttggagccgcagtgggcgtacgcggtgccggcgatggtgcccgtggccgggcagctgttcttgaggaccttgtagtcctcgatgcccgcctcgtaggtgccggtcgccgggccggtggcggtgccgccgggcgcggactgggtgacgccggtccagccgcggccgtagaagccgatgccgatcagcagcttgtcggccgggacgcccttggacttgaacttcgccatcgcgtcggcggtgttgaagccctgctgcgggatgccgtcgtacgcggtcagcggcgagtgcggggcggtcgggccgttcttcgcccaggcgccgaagaagtcgtacgtcatcacgttgtaccagtcgatgtacttcgaggcctcgccgtagtcggcggcgtcgatcttgccgccgtccgagccgtcggcggtgacggccgcggtgatcaggtagtcctggccgaactcggcgcgcatggccttcatcatgctgctgaaggcgttcggggcgctggtctcgtcacagctgagaccgcaggcgttcgggtactcccagtccaggtcgatgccgtcgaagacgtcggcccagcgcgggtcctcgaccaggtcgtggcaggacttcgcgaacgcggccgggttcttcacggcgtcggggaagccgccggaccaggtccagccgccgaaggagtagaggatcttgatgttcgggtacttggccttcagcttgcgcagctggttgaagttgccgcgcagcggctggtcccaggtgtcggcgacgccgtcgacggactggtcggcggtgtaggccttgtcgtagtcggcgtaggagtcgccgatggtgcacttgccgccctggacgttgccgaaggcgtagttgatgtgcgtgatcttgtcggcggagccggaggtgaccaggttcttcacgtggtagttgcgcccgtagacgccccagttggtgaagtagcccatcttgacctcggcaccggtgccggggttgccgccgtccccgccgccggtggtggtgaccttcaccgcgccgctggccgggccggtctggtcggcggtgtcacgggccttgacgctgtacgagtaggcggtgcccttggtgaggccgttgtccgtgtaggtggtgccggtgacggtggcgaccttcgcgccgtcccgcaggacgtcgtagttcttgacgcccttgtcgtcggtcgccgccgaccaggacagcttcaccgaggtgtcggtgatgttggaggcggtgggcgtgccgggcgcggagggggccgcgtcgccggggaccgaggtgccgtcgcagctgccgccgttgagcttgcagttggacggggagccgggcccgctgccgttgaagccgaaggagaccgaggcgccgggggcgagcgtcccgttccagccgacgttcttggcggtccagtggtcgccggagttggtgacggtggcgtcccaggcggaggtgaccttggtgccggtggggaagtcccactcgacggtccaggagctgagggaggtggtgccggtgttcttcaccgtccagctgccgccgaagcccgtgccccagtccgaggtcttggcgaaggtggccgtcgcgctcgtggccgcctgggccgggctcgcgaggccgaccagaccggcgaggggaagcgccagggtcgctgcgagtgccgcggctttgtgtctgaagcgcatgtgcgcctccttatatggggatgttgtcgagggcatgactgagcctcatgcccgcagtgcggcgagaatagaaaggtctggaccataggtcaataggtctggaccaatgtggcgcccgggggttgaaccggtggttgagaggggaaactagatccccaactcctgcgccagcaccgccgcttgcacccggctgcgcagccccagcttgcccagcagccggctgacgtgcgtcttcaccgtggcctccgccatgtcaagacgttcggcgaccgccgcgttggacagcccctcgccgagacaggacagcacctcgcgctcacgccgggtcagctcccgcagcaccgccgggtccgcggtcggctcgcgcaccggcttcgcggcgaactcggcgatcagccgccgggtgacggccggggccacgatgccctcgccgccggccaccgtgcgcacggccgcgagcaggtccctggcgtcggtgttcttcagcaggaacccggcggcccccgcccgcagcgccccgaagacgtactcgtccagatcgaaggtggtcagcaccaggacgtcggcgagctgctccccgaccacgatccgggtcgccgagacgccgtccatgcgcggcatctgcacgtccatcagcaccaggtcgggacgcagctcccgggccagcgccaccgcctgctcgccgtccgcggcctccccgaccacctcgatgtccggggcgctgcccaggatcagcaccagccccgcgcggacggcggactggtcctcggcgacgaggacgcggatcatgcgaggtctccttcggtcaggggcagcgtggcgcgcacggcccagatcttgccgcccgccgggccggggtccgccaccgccccggcctcgaacgtgccgtgcagcagggcggcccgctcccgcatgccgaccagaccggcgccggaaccgggcgcgcgcggggtgtcccggtcgccgtacgggctggtcacctcgacccgcagggcgccctcgtgccggtccagccggaccaggacggtgccctcggaggcgtgcttgagggcgttggtgagcgactcctgcacgatccggtacgcggccagctcgaccggcacgggcaggttctcgccgggtgccgtgtccagggtgacgtcgaggccgttggcgcgggcgccctcgaccagcgcgccgagtccgtcgagggtgggggcggcggccggcccggtgtccccaccctggtcccgcaggatgccgatgaggcgtcgcatctcggccagtcccgccacgctgttctcgcggatcacaccgagcgcctgccgggtggtcgccgcgtcgtccagggagagcgcggccgtggagtggatggcgatcgcggacaggtggttggcgaccatgtcgtgcagctcgcgggccatccgggagcgctccgcggtcaccgcctgggcccggtccatctcggcgagcagcgcggtctgctcggcccgcagcagggcggcgtcggcggcctcgcggtggttgcggacgatgagccccgtggaggcgggcgcgaaggacacgacgccgacggcgacaccgacgagcagtgtctcgggcacccgccacacggcgaacggcaccagcgtcgaggcgacggtgagcagcccggtgatccacggaatgcggcgggccgaggcgggcggaccgtacagcaccgccgcgtatatcaggtcggtgtacatgatcaccgtgaccaggctgccctgggtgagcgtgtccgcgaccagcgcgacggtgccgatcagcagaccggtgcgcggcgcggcccggcgcagcagctcgcagcccgccatgacggccagcggggccagcagcggccagcggccgtcgaacagcacgaccggctcgtcggccggccgcacgccgaggccgatgccccacagcagcagcccgcccagcagcccggccgacgcggcgtacacgtcgaagcggcgcgggcgggggagtcgtacggccatgccaccatccaacacgccccgcgccccgcccgcctgatgcccgggaagggtcccgcactgcatctttcgatgtaccggaggttcgtcaccggcgacgacgaacccggcggattccgacgggagcctggaagggtgaacgaagggagtgcgtcgtggtcgtcgcgttgatcatcgcctgtgaggtcggcttctgggtcctgctggccctcgggctgggcgcccgctacctgctgaagtggcggcgcaccggcgtggtcctgctgctgtgcgagccggtgctggaactggtgctgttcgcggtgacggcatgggacctgaagaacggcgccgagcccggctgggagcacggcctggccgcgctgtacatcggctacaccgtcgcctacggccactacacgatccgctggctcgacggccacgccgcccaccgcctgggcggggccccgccgccggtcaagccccctcgctacggcagggcccgggcggcccacgagggccggctgtggctgcggaccctgctgggcgcggccgtggcctgcgcgctgctccagggcgcggtctggtacgtcggtgacgacggcgacgtctcgtcgctgcgggccttccagtgggcggcgatacgggtcctcggcatccacggcgcggtggccctcgggtacctgatctggccgaagaaggccccggcggggacgcctgaggccgctgccgagcggcggaagcaggaggcacaccggtgacccgggcgtcgaagcacctgctggagggcgccgtcaccctgctcgccgggctggccctgtggctgttcaccggtgacgtggaggtcccgatggtcaccctgacgaaggtgggcgtcgtactgatgtgcgtcggcggcgcgcagaccgcctggggcctgtacggtgcggcgcgccggcacgtctgacacacggagtcggtccggggggcccgccgggaagcgccccgaaggggcgcggggaacggcgcgaccggccacgacggagccgcagccgaaggacggcaccggcccccccggcacaccccgcggagcgtctagcgctccccgcccggcacccacagcacgtcgccgacctccttgttggccacccgggccaggatgaagagcaggtcggagaggcggttgaggtaggtcgccgtcagcgggttcatcgtctcgccgtgggcctccagcgccgcccaggtggagcgctcggcccggcggaccaccgtgcacgcctggtgcagcagggccgccccggcggtgccgccggggaggatgaaggagcggagcttctccacctccgcgaggtaccggtcgcagtccgcctccagcttgtcgacgtagaactgctcgacccgcaggggcgggtactccgggttctccaccaccggcgtcgacaggtccgcgcccacgtcgaacaggtcgttctggacgcggacgaggaccttgacgacctcctcgggcaggccgccgagggcgatggcggtaccgatcaccgcgttcgcctcgttggcgtcggcgtacgcggagatcctcaggtcggtcttggggacccggctcatgtcgccgagggcggtggtgcccttgtcgccggtccgggtgtagatgcgcgtcaggttgaccatggggccagcgtagttacgcgcccgccgttcggaagacgcgtgtgcccaccgtcacggccagcgcggtgaaggccagggcgacgaggacgccgtacagcatgtgcgccgtcgcgtaggagccgacgtaggcgtcccgcaccgcgtccaccagatagcggaagggcatcaggtgcgacagcacgtccagccacgccgggcccagggtcatcgggagcatcaggccggacagcagcatcgacggcatcgtcagcgcgttgatcgtgggcccgaactcctgcggggtgcggaccttcatcgccagtgcgtacgacagcgaggccagcgagaccgtgagcagcgcgacgaaggcgaagccgatcagcacgccgggcagcggcgcgcgcaggcccatcaccagggccgcaagcaccagcagcaccgcctggaaggcgaagacggtcgcgtcccgcaggacccggcccaggagcagcgccaggcggctgacgggcgtgacgcgcatccgctcgaccactccctggccgttctcgatgatgatcgagaacccggcgaaggaggcgccgaacaggccgagttgcagcaacaggccggggaccagcacctgccaggagctgccccgcccgccgagcggcaggtcggtcagcagcgggccgaagaagagcaggtacagcagcggcatcagcacgccgaacagcagcgcgaagcgggagcgcagggactggcggagatagcggccgtagacgaggccggtgtcgtggagcagcatcgggtcggttcccaggggtgctagacggctacgggagtggcgtcggccggagcggcgccgcggccggtgacggccaggaaggtgtcctggagggtggcgtcgggcgagccgccgtactcgagcttcagggcggccggggtgccctcggcgaccaccgtgccgccgtccacgacgaccaggcggtcggagagggcgtcggcctcgtcgaggtagtgcgtggtcaggaagaccgtggtgccgtgcgcgtcgcgcagcctgcggaccaggtcccacaggtcggcgcggctgcccgggtccagaccggtcgtcggctcgtccaggaacagcaccttcgggcggtgcgtgagcgccatcgcgatgtccagccgccgccgctgcccgccggagagcgcgccgcaccggcggtcgagcaggccggtcaggcccaggtcgcgggccagctccccggcacgctcggcggcccgcgccctggacaggcggtacaggcggccctgggtgaccagctcctcccggaccgtgatctgcgggtccaccccgcccgactgcgccacgtacccgcacgccgcacgcaccccggccgggtcggtcgccaggtcgtgcccggcgacggtggccgcgccgccggtgggggcgagcagggtcgtgagcatccgcagggtggtggtcttgccggcgccgttggggcccaggaagcccaggatctcgccctcgcggacggtgaggtcgatgccgcgcaccgcctcgaccggcccgcgcctggtcgcgaaggtccgggccagcccggccgtactgatgattgccatgcgctccagaaaaacagagacgctgaaattttgcaatgaccccaagttttcagcggccccagccagtggcgccggcgcggctaggatgcggtcatggccgagggactcagggaacggaagaagcggcagacccggcagtacatctcggatgtcgccaccgggctgttcctggagcgcggcttcgaggccgtgacggtggcggaggtcgcggacgccgcgaacgtctccgtcaacaccgtgtacaactacttcccggccaaggaggacctgttcctcgaccggtccaagggcgtcatcgaccggctctcccgctgggtgcgcgggcgccgcgacggggagtccgcggcgggcgccgtcctgcgggaactgcgcgacgaggtcgagtcggtctccccgcgcgtcggcctgatggacggctacgccacgttcatgaaagtgatccaggactcgcccgccctgcgctcacggatgtgggccatcggccaggaagtgctcctgaacctggagcacaccctgcgcgaggagaccggcagcgcggacgacgacatgacccccaccctgatggccggtcagatcaactggctgcacggcacggtcctcgcggccatcggcgggcgcatggtcgccggcggcaagccctccgaggtctcccgcgacatgctcctgctgctggacgagatggaggagctgttgagcgagaaggtgctcaactacgccgtacgaggcgcgctgtgacacccggacggcacccctcggtgtgacgtccgtcatttgagacgtgacgcgcgttactaaccggtcacacagcgcctcacgcccgctaatctccggccgagagacgagaatcagcgcgtatcaggggagtcgcacagtggcacggaagctcgccgtcatcggagccggtctcatggggtccggcatcgcccaggtctccgcccaggcgggctgggaggtcgtcctgcgcgacgtcaccgacgaggcgttgcggcgcggcaccgacggcatcagggcctcctacgacaagttcgtcgccaagggcaggctcgacgccgacgacgccgaggccgcgctcgggcgcatcaccgcgaccaccgacctggacgccgccgccgacgcggacgtcgtcgtcgaggccgtcttcgagaagctggaagtcaagcacgagatcttccgtaccctggacaagctggtgaaggacggggcgatcctcgcgtccaacacctccgccatcccgatcaccaagatcgcggccgtgacggagcgccccgagcgggtcgtcggcacccacttcttctcaccggtgccgatgatgcagctgtgcgagctggtgcgcggctacaagaccagcgacgaaacgctcgccaccgcacgcgagttcgccgagtccaccggcaagacctgcatcgtcgtcaatcgcgacgtcgccgggttcgtgaccacccggctcatctccgccctcgtcgtcgaggccgcgaagctgtacgagtcgggcgtcgccaccgccgaggacatcgacctcgcctgcaagctgggcttcggccacgccatgggacccctggccaccgccgacctgacgggcgtcgacatcctgctgcacgccaccggcaacatctacaccgagtcccaggacgagaagttcgccccgccggagctgatgcgccggatggtggacgccggtgacatcggccgcaagagcgggcagggcttctacaagcactgaggtcacatcagccccggcaaacgtcacacgccggggtgaattcggtatcggttcgcttacagacggcaacctccggtcgtttcggccagtcagagggtgcagtgcctgatatcgccgagagaccacaacgcacggaacgcaacgccaagacgaagaagacgacgaagaagacgcacgccggggagcgcatatgcacatcaggggcgaccacgtcgagctggtcgtcgggggccgcctcgacgtccgcagcgcggcggacgcccgtacggtcctgcactcggccgtcgacgacggagtcggcgacctggtgctcgacctgtcagagctggactcctgggacgccaccggactcggcgtgatcatgggagcccaccggcgggccggccgctgcggccggcggctggtgctgcgcggcgtgccgccgcagatgcagcgcctgctggtggccacccggctgcaccggatcctcgccatcgagggcggcatcggtgtggagaccctgccccgcgtgtaagtgaaggttcacacctccgacacacgcaatcctcacgagaccgtgacctctcgggccgtccggcaccccggactgtcggagatactgggcgaaggtttagggtctggctgcccgctgcctttgcaaacccgccggcgggcccggaccagaagcgacagcgcggtgtgcggcaaggccgggagggtggtccctgccggggccctgcacacgacgcttttggggggcttgaaccaatggacccgaacaaccggggccctgaggagtacggccaggacggcgaccaccaggcgccgcgcccgcgcccgcacagggaccccatcacctccgacttcggacagcacgcgcccgcgctcgcccgcacggtgcagctggtgtccggcgacttcctgctcaccgtcaaccccgtcgacggcagcgagatcgaggtctgcccgcccgcggagcggcccgcccggcccgagaagctcacagcggccgaacgcgccgacgcggagcgcgccgcgcggccgcccgtcccaccgggaccggtccgcacggtcctcggcctgctggcccgcgaggacgaacgcgaacgcctggtgcggctgctcgcccgcggccgctccgtgcgcctcaccggccccgccggctccggccgcaccagcctcctcgacgtcgtcgccgaggactgcgccggcctcgcgcccgacggcgtcgtccggctcaacggccaccaccgcaccgccgacgacctgctccacgacctcttctacgccgtccacggcgcgcccctgcaccgtcccggtcggacggaactgctcggacacctgcgcgaggtgggcgcggtcgtcgtcctggacgacgccgagttcggcggcaccgccctcgacgaactcctcgacgccacccccgagtgcgccttcgtcatcggcaccaccccggacgtggccccaccctccgccgactcggccgtcgaggaggtcttcctcaccggcctggaccgctccgacggcgtggagctgctcgagcgcgccgccggacggaccctcaccgaggaggaggccaactgggccggagacctctggttcgagtccgagggcctgccgctgcgcttcgtccaggccggtgccctgctgcgccgccgggaccgggagcgggccggtgccgacgccgtcgacgagttcggcgtcttcgccgacgcccgcccggccgacacccgccccgccgacgacagcccctacgacgccgccgagaccgacgacgtgcccctgccgtccctcggcgaggccgccgcgcccgcaccgctgctcgcctcccggctgagcgcctccgcccgcgccaccctggagttcgccgtcgcgctcggcggcgaggtgccgcaccaggcgcatctgcccgccctggtcggcgagacccacgcggacgccgccctcggcgagctggcggactgcggactggtctccccggtcgcctcccgctaccggctggccgccggcgtgctcacccagctggagagcgccggatacgccgacgccgtacgggagcgggcgacggccgccgcccagcactacgcctggtgggccgggcacccctcggtcaccccggagcgggtctgcgcggaggccgacgccgtactggcggccctcgccgtgctggtgcccgcgaccacccgcaccaccgaggacgaggagagcccggccgtccagctggcccgcaccgcggcgcccgccttcgccgccgggctgcactggagcgcctgggaacgggcgctgcgttcgggtaccgaggcctcccggctcgccggtgacgtcgccgaacaggcctacttccaccacgaactgggcgtcctcgcgctgtgcgagggccagttggaccgggcccgcaccgagctggaggcctccgtcggactgcgcggcgcgctctccgacaggcgcggtgccgtggccggccgccgcgccctcgcgctggtcgccgaccgcaccggcgacacgccgggcctgggcagcggcgcgggcgccttcgccgcggcggcgcccgccgccggacccggtgccgtcggggccggactcggcccgacggtgggggaggaggtgcccgacgcccgcaacgaggagtcggcgtcgccgtccgcgggcgtccccgcccccttcccgccgctccagccgcgtccgcagtcccccaccctcgtcacccgccgcgagcccgacgaggagccgtcccgcaccgttgccggcggcatcaagggcttcgcacggcgcaacctggtggccgccggagcgggcgcgctgctcgtcgccgtgctcggcacggtggtgaccctgggggccacgtccgagaacgacggcggcgatccctccaacgaggtcggcgtcaacccgtcggccagccagggcgtcgacgacggcagcctgggcgccgaccggccctcggacgacggtcagggccaggagacgcccggcgccccgaccggctccgccacccccggcacgtccggggcgccgacggccacggagtcgggggcgccttcgcaggggccgagcagtacgggcagcaccgaccccggggacgacgagagccccgacgcccccggctcgccggacgagccgagcaagtcgccgagttcgccgacgacgaagccgacctcgccgaagccgacggacaccgagccgacggaccccgggacgcccaccgagtccgacggcacgtcaccgacgcccacggagaccgagacgacctcgccgtccaccccggagacgtccgacaccgccagtggtgccgacagccctccggccaccgtctcgcagagcagcaccgaggacaccggcaccggcacgggagcgccggccggctcggacccggcgaccggccagatcatctgaccccgcccgggaaggcatcagcacgagagggccgggtccgccgcacggacccggccctcctcgcgtcgtacgtgacgcgccctcaggacgcgtcgcgccctcagaacagccgcagcttgtcgtcctcgatgccccgcagcgcgtcgtagtccagcacctggcagccgatgccgcggtccgtggccagcacgcgagcctgcggcttgatctcctgggcggcgaagacgccgcgcaccggggcgagatgcgggtcgcggttcagcagctccaggtagcgcgtgagctgttccacgccgtcgatctcgccgcgccgcttgatctcgaccgcgacggtcccgccctgggcgtcccggcacaggatgtcgaccgggccgatggcggtcatgtactcgcggcggatgagggtgtagccctcgcccagggtgtcgatgcggtcggcgagcagctcctggaggtgtgcttccacgccgtccttgatcaggcccggatcgacgcccagctcgtgcgaggagtcgtggaggatctcctccatcgtgatgatgagcttctcgcccgccttgttgacgacggtccagacgccctcctcctcgcccgtgccctccttcagggcacagggcggcgacatccagttgaggggcttgtaggcccggtcgtcggcgtggatcgagacgctgccgtccgccttgaccaggatcagccggggggccgagggcaggtgggcggtgagccgtccggcgtagtcgacggagcagcgggcaatgacgagacgcatggtcggcaacgctactcgacgggccgggcccgacgcgattcgcccgtacccgggcaccggagtgcgctgtcccacttctcccattggccccgtcttgcgcactggccgattgtgggcctaccggatggtgtccatctgggcattctcctggtgccgtcacgatcggttgcttacggtattgaacgggaggtcgcggcctgtgtacgcagcgtgttcggaatcgcgcactcccttaactgtccggcaacccctgctggtcgggggtgcgagaggagaacccatgtcgctcgacgtctcaccggccctactcgaacaggccgagcgaggcgaggtcgacgaagcagacttcgtcgactgcgtccggacctccctgccctacgcatgggagatggtcagctccctggtggcacagctgaaggtcgacggcggagcgttcgccgacaaccagacgcccccgccggacgagcaggcgcgcggtcagctcctgcgtgcgctcgcgagtgacgccatacgcggtgcactgcagcggcacttcggggtgcggctggccttccagaactgccaccgggtggcggtgttcccgttggactcctctgtcgacgagacgctgaccaagttcacctcggtgcgcagccagttgctgaaccagtcgccggaactgcgcgactgctgaggcccgcggtccctgcttgccgctccgtacgcgggaggtgcagttctgtaccggagcggcaagctccccgcccgggggtcagcggagctgggggagtacctcggccccgagccgccgtacgttctcctcggtcgccgccaggtctcccgagccctcgacgagcagggcgaagcgggagatgccggtccgctcgccggtcgccgcgagccggtccgcgcacagccggggcgtgcccaccgggtgcagcccgcagagcagttcggtgtaggcgtgcgggtcgcgcatctgccgggcccggccgtccaccgtgacgtgggcgcccagcccctgccgcagccagcccggcatcgccttgagcagggtctcggccgcgtccgtgcgccggtcggcgatctggcagacaccggccgagacgtgtccggcgccgtggatctccgccgccggacgcccggccgcacgcgcgtggcgccgccacagggcgaccatctccgccttctcctcgtcgccgacgtgcatcccgaggagcatcggcagcccccgctcggccgccatccgcacgctcgacggcgaggtgcaggcgacgacgacctccgggcccggctcctccgacagggactccgacgggcgcggcacgaccggcacctcgcggaagcggtatcggtcgcccgaggcgccgacggccggctcgcgcagccagcgcagcagcaggtcgagcgagtccggaaaccccttctcgtacgcctccagacccgcgccgaacacctccaggtccacccacgggccgccgcggcccacacccagcgagaagcggccgccgctggtgacgtgcagcagcgcggcctgctcgccgagcgccacggggtggacggtgggcagcacactcaccgcggtgccgaccctcacacgccgggtgcggcccagcagcagcgcggccagggtcacggccgacggacacgtgccgtacggcacgaagtggtgttcggccagccagaccgtgtccagcccggcctcctcggcgacctcggccgagcggaccgcgcggtgcagcgcctccccctgaccctggcccgggaactgggcacccaacacgaaacttcctacgcgcattgccttttcctgcttcctcggccccgacatggagctcccccgcacggcataaccgcctgacacgtgccgaggacacggccggacgaaggactttgcggattgtcttcagaatcggccgttgtgggacggcgcgtgggctcggacggacaacaccggtcggggggagttgcggtgtttggcgccgtacgcctacccgtgtccgtgccgcgtaggctggatgccgccctgcttcctgtatagctccgtgaggtgtcctgtgtccccgcgtcgcaaccgacccaagggagccggttcctccggccggagcgcagaggaggacggctccggccgctacggcggctggcagtccgcggagaactggcagggcgaggagtggagcgtacggcacgtggcgggcgcgagcgcgcagggcaagtcgtaccgctgcccgggctgcgaccagctcattccggacggtgttccgcacgtcgtggcctggccggcccactcgggcgtcgacgaccgccggcactggcacaaggcgtgctggaacgcgaaggaccgccgcaccacgcgggtgcagcggtcccgtaacgcgccgaggttctgaagccccgtttacacgtcccgcttctccagcagggcgaaggcggcggcgaacgcggccgcggtcacgccgagcacgatccacagcgggtcccagcccgagggcccggactcggagagcgagttggcgtagaagatgctcatctggttcgggatcgagtactcgaacagcgcctgctgcacgtccttgagcgactcggagaacatgaacagcgcgatcaccagcggggcgagcaggacgccgatcatgatggtgatggcgcccgccgagtgccggatgatcgagcccatggccagcgagagcagcccgagcagcgcgacgtagagcgcgacgccgacggtgcccttcagccactccgcgccggtcgggttctcggcgccgttgccctccagcatggacacgtgggccagcccgaccagcgtcgcgcagatcagggtcaccacgaacgccaccaggaagaacacgatgcccttggcggccagcacccggccgcggctggggcaggcggtcatcgtcgtgcggatcatccccgtgccgtactccgaggcggtggtcagcacgcccagcgtgatcacgcacatgctgccgagcagcagaccgaagaagccgaggctcagcgcgctctcgccggccaggtcggagtccgagctcgccaccaccgcgccggtcagcagcccgatgccgagcaccagcaggacgaacacgccgagcgtccacagcgtcgagcgcaccgacttgatcttcgtccactcggaggccagcgcgtgcacgagggtcgtgcgcaccaccgggatcggcgacgtgtaggtcgggaacggcgaaccgggcgccgcgtgccagtcgggcgcggcctgctgcgtcgggggctggggcgtgctcatcgggcgtcctcgggcttggtcgggtcggtgacgggcgcggcggcgggcgcggggcccgccgcgggcggcgtcggcgcgccggcgggagcctggggcatcggcggtgcctggggcgcctgccgggccgcgtacgggttggccggctgaccgcccgggaccgccccgggcgccaccggggcgccgtacgggcccgcgggggcctggccgggcgcgccctgcggcgcggcgaagggctgaccgccctgctggggcggcggcggcgcgtaccacccgggctggccctgaccggccaccggcatcggcggctgcgcgccgggcggcaggggctgctggagccccgccttctggtcggcggtcgaccggtagtccacggcgccctgcgtcatccgcatgtacgcctcctccagcgaggcctggtgcggcgacagctcccacagccgtacgtcggtgtcgtgcgcgatgtcgctgatgcgggggagggcgagcccggtcacccgcagcgcgccgtcctgctcgggcagcacgtggccgcccgcctcggtcagcgccgaggtcagcttctcgcgcagctggggctcggtgtccggcgtccgcacgcgcgcgaagtcggcggagttggccgagatgaaatccgtcacgctcatgtcggccatcagctggccgcgcccgatgacgatcaggtggtcggcggtcagcgccatctcgctcatcaggtgcgaggagacgaagacggtgcggccttccgcggcgagcgccttcatcaggttgcgcacccagtggatgccctccgggtcgaggccgttgaccggctcgtcgaagagcagcacctgggggtcgccgagcagcgcggcggcgatgccgagccgctggcccatgccgagggagaagcccttggaacgccgcttggccacgtcctggaggcccaccacgccgagcacttcgtccacccggcgggccgggatgccggacagctgggcgaggctcagcaggtggttgcgggcggcccgcccgccgtgcaccgccttggcgtccaggagcgccccgacgtggcgcgcggcgttcggcagcctgcggtacgggtggccgccgatggtcacgtggcccgccgtggggttgtccaggcccaggatcatccgcatcgtcgtcgacttgcccgagccgttgggccccaggaagccggtgacggcaccgggccgcacctggaaggagaggttgtacacggcggtcttgtcgccgtatcgcttggtcaggccgacagcctcgatcatgctccgcacccatcggaaggttcagggacagcagggcacacgcccccgtaagggttaggaggatatccacgcgctgacggttccgttcaagcgcgggcaaaatccggcaccgtacggaggcgcctgccggggttgcggcgcccgctttctaggcgtcccgccgcttcagcaccgcgtacccgccgacgagcgccgcgatcacccacagtgccatgatccccaggccgccccacggtccgtaggggacgtcgtcgtcgatcggcgtgaccacctgcatgatcttgctgccggcctggtcgggcaggaaccggccgaccttctccgtcgccgggacgttgcccaggatgttggagatcaggaagaagaacggcatcaggatgcccagcgacagcatcggggagcgcagcatcgcggcgacgcccatcgagaacatcgcgatcagggtcatgtagaggccgccgccgaacaccgcgcgcagcacgcccgggtcgccgatcgacgccttcaggtcgccgagcatcgcctgcccgaggaagaacgtggcgaaactggtgaccatggccacgaccagcgcgagcgcggtggccaccgcgatcttgctgaacaggaaggtgccgcgtcgcggcacggcggccagcgaggtgcggatcatgccggagctgtactcgttgcccacgaccagcaccccgaacacgatcatcgccagctggccgaggctcgtaccggcgaagctgatgaaggtcgggtcgaaggagagctggtcccgccggctcatgtcgccgaactcgttcttcgacagggccgagatcagcatgcccagggcgatggtgacgaccacggcgaggcccagcgtccacaccgtggacgcgaccgaccggatcttggtccactcggaccggacgacctgtgtcgccgccatgctcatcccctcttccagtcgctgccccacggctgctgcggaggctgtcccggtggctgttgctgctggggaacggcgccgggcggctgcccgtcgtgcgcgtggtactccacggactccgcggtcagctgcatgaacgcctcctccagggaggcgcgctgcggactcagctcgtacagcacgacctggtggcgcgccgccagctcgccgaccgtctccgacttgtcgccgtccacttccaggaccccctcgcccgactcgacgacggtgaccccggccgcgtgcagcgcgtcgagcagctgctcgcgctgcggggtgcggatccggacgtagctgcgcgagttctccgcgatgaactcggccatcgaggtgtccgccagcagcctgccctggccgatgaccaccaggtggtcggcggtcagcgccatctcgctcatcaggtgggaggagacgaagaccgtacggccctgggaggccagggtcttcatcagattgcggatccagtggatgccctcggggtcgagcccgttgaccggctcgtcgaacatcaggatgcgagggtcgcccagcagggcccccgcgatgccgagccgctgccccatgcccagggagaagcccttggtcttcttcctggcgaccgccgacagaccgaccgtgtccaggacctggcgcacccggctcgcgggaatgccgttgctctgcgcgaggcacagcaggtggttgtaggcgctgcgcccgccgtgccacgccttggcctccaggagcgcgccgatgtacgtcagcgggtccttcagctcgtcgtagtgcttgccgtcgatccgcacgtccccggcggtcggccggtccaggcccagcaccatccgcatggtcgtggacttgcccgcgccgttggggccgaggaagcccgtgatgatgccgggtctgacggtgaaggagagattgttgaccgccaccttctcgccgtaccgcttggtcagcccctcgagctcgatcatggcgaccacgctagaacgggacgaggcccgctgccaccccagtgacaacaggcctcgcccatgttcgtacggattcggcaggcgtaccccccgcgcagccgaaaccgcccgggcgcaagggcgtcagcgggactgctgggccgggaccccgcgggagaccgactcgtcctcgaccgacggcgcggccgccaccgcggcgcccgtgagcgacgccagcatctcgcgcacgttggtcagctgcgcgttgatggagtcgcggcggttggtgagggcggccagctcgcgctccgactccgaacggatccggtcggccttggcgttggcgtcggccacgatgtcctcggactggcgctgcgccgtctccacggtctggcgggcccggcgctcggcgtccgtgcgcagcttctccgcctccaggcgcagctgctccgcgcggtgctcgatctccgcgagccgcttctcggccttggcctgacgggaggccaggtcccgctccgactgctcgcggcgcttggcgaggttggtctcgaagtcggcggcggcctgcgcggccttcgcgcgggtctcctcgaagagcgcgtcggcctcgtcgcgcttcgactgcgcgtccttctgcgcctcggaacgcagctgcgaggcgtcgcccttggccttctcgacgatccggacgccctcgtcctcggccttggccttgcgctcggcggcgtacgactccgcgtcgttgcgcacctgctgggccgaggactcggccagctcgcggtgctgctcggccgcgcgccgggcctcctcgcgcaggtccttcgcctcttcctcggcgagccgcaggatcttctcgacccgggcgccgagaccggcgtacgacggctctgcgtcgttgacctgggcctgggcgttctgagtctcgaggtggagctcctcgatgcgcttttccagagcggtgatgcgggcgagagcgctgtcacggtcggagacgagcttggagatgcgttcgtccacctgagcgcggtcgtacccacgccgcacaagctcgaagccgtagggggaagtgtcgctcatggggttcctgtcgaaagagaccgggtgaggtgatagagggaatcctaggcgccaatgcggtgtgtcatcgagcggatgcacgtttgatacggagaatgacacctcttttgagtggctgacccgcggatggcttgccaaagttcaggtgaacggtcccgtcgggactcggccaaagatctccagcagacacccaaaccgccccgaacgctagccgtctgacgacttgccacccgaacgtggggcgcccaccgtcgctccggccttcaccccgttgtccttcgcacccccgggcgcctcgaacgactccagcgcctccagcacgtcctggacccgggagatctccgcgttgatgtcctcgcggcgccggaccagcacctccagctcgcgcttgccctcgtcgaccgtggcccgggcctcgcggaccgcctcggccttcagctcctcggcctcgcggaccagggtggccttcttctgctcggcctccttgagcagcccctcggccttcttgacggcggcgatgcgcaccttgccggcctcggagttggcctccgacaccagctccttcgccttcgcctccgccttggcgagctgctcctcggcggccttgatgagcgcgtcgcagcggtcgccggccgacttcatcgtctcggcggcctcgcggcgggcccgctcgtgcagctcctcgatctcggaggtgagccgctcgcgcagctcctccgcgcgctcccttatggcggtcgcgtcccggcgggcgccgaccagcagctcgtccgcgtccgtacgggccttctccacccgggtgttgccctcgaccgtcgcctcctggacgatccggtcggcctccgagcgggccgcgccgaccatcgtgtcggcctgcgactcggcgtccgcggtggtcttctgggcctgctgctgagcctcggtgagcagcttgtcggcctcggcggcggtctccgtgatgagcgtgtcgacctgctcggcggcctccgagcgccgtttgttggcgtccttgcgggcctcgtcgagggtgcgctcggcctcctcgcgggccgccgtggtgacccgctcggcctccgcggccgcctcgcggcggacccggtccgcctcggtgcggagccgctcggcgtgctgctgcgcggagccgacggtgtcggcggcctcggcccgcagccgctccgcctccccggtggcgtccgagaccagctgctcggcccgggcgcccgcctcggcccgtacccggtcggcctcggcgatcgtctcggtgcgcagccgctccgcctcggtggccgcctccgtcctgacccgctcggactcgctcgccgcctcggcggtgacgcgctccgcctccgcgagcgtctgggtgcggatccggtcggtctcggccgccgtctcggtggtgagccgctccgcctcggaacgcgcctcggtgatcagggtgtccgcctgcgtcgccgcgtcggaccggatgcggttggcgtcctcgcgggcgtccgcccgggtgcgcgacgcggactgctcggcctcggcgatggcgtcggaggcctccgtgcgcacccgctgggcgtgctcggagacgtccgagcggatccggtcggcctcggtgatggcctcggacacggtccgctcggccagcgccttggcggcctcggtctcctcctgcgcctcgcgcctgaggcgtccggcgtcctcgctcgcccgctcccgctccgcgtaggcgtcggcgcggacccggtccgcctcctcctgggcctcggtccgggtgcgctcggcggcgtgctcggcggcgctgcgcagcccggtgatctcctcctgggcctgctcgtgcagcccggcgaccgactcccgtacctgcgccgcgtgctgctcggccgccgacaccatctcggtggcgcgccggtcggcctcctcgaccagccggaccgcctcggcctgggcctcctccacgcggttgcgtgccgaggccagcagctcctcgctctgctcgcggacccgctcgcgctcctggtcggcctcctgccgggcggagccgagcagttcctccgcctcgcggcggcgccgggcggcctcctcctgggcggcggccagcgcctcggacgcctcggccgcgatgcgctcggcggcggtctgcgcctccgcccgcacccggtcggcgctctcctgcgcctccgtcttcagccgctccgcctcgttggaagcctccgagcgcagccgtacggcgacggcctcgccctccgcgcgggaggcggacgcgtccgcggcggcctcggtgcgcagccgctcggcctccgtctcggcctgctgctggagggtacggacccgctccgcggcctcggtgcgcagccgctcgctctcctcggcggcctcgcggcggatccgctcgccctcctcgcgggccccgctcagcgcctcctcggcggcgctgcggcgctcctcggcctcggtgtgcagccgcgtcagctcctcggcggcctccgcctgccgggcctcgacggcgcgctcggtctcctcgcgcagctcgcgggcggcccgctcggcctccgcctggagctcctccacccgctcggcggcctccgcgcggtgccgttcggcctccgcgcgggtgcgctccagggtctcctcggcctgccggcgcagggtcgtcgcccgctcgatggcctcggcgcggaccttctcgccgtccgccgtcgcggtctgccgcagctcgtcggcgtccgccttggccttggcgagcagctcctcggcggtcttcgccgcctcctcgatctgcgccacggcctccttgcgggcctcggcgcggatcttctcgccctcggcgaccgcgtccgcccgcagctgctcggcctcgccgcgcagccggcgcgcctcctcctgcagttcgaccgtcttggcgcggtactccttggtgtcgtccttcgccgcgcccttcagctccgcggcgatgtcgtgcgcctcggcgcgcagccggtccgcctcggcctcggcctcggtgcggatccgctcggcctcctcggtggccgccttcgtggtccgcttggcgtcctccgacgccttgttcagcacgtcctcggccgtcttggccgccttggacagctgggtggccgactcctcggccgtgatcgtgcgggccttctcggcggcctcggcgacgatccgctcggcctcggcacgggcgtccgcgaccacctgctcggcctcggacctggtgctctcggcgtccttggtggcctcgccgaccagccgggcgacctgctccttggcggtgcgggtgcgctgctcgttggtcgcctcggcgctcgacagggccttggcggcggcctcctcggcctgggcgaccaccttctcggcctcggcctgcgccttgcgcagcgcctcctcggcctccgacatgcgctgctcggcggcccggctcagctcctgcacctcgcgccgggtggactccgactcggaggcggtggagctgcgcagctgctccgcgtggtcggtcgcctcctgcgcctgcgtcgaggcggcgttcagcagccgctccgcgtcggtgcgcgcccggcgcaggatctggtcggcctcggcgcgggcgctctccgcgtcgctccgcagccgctgacgggcctcggcggtcagccgctcggcctccgcgcgggccgcggccatggcctgctcggcctcggcccgggactcgtcgagcaggcgccgggcctgctgctcggtgcgggcgcgcagctgctccgcccaggccacgttctcgttgacgtgcgactcgacggtctgccggcgctcggccagctcctggtcgagctgctggcggcgggtgaccgcctcctggtgcagctccgcctggagcctggcggcctgctcggcgtgctcctggaggatccgctgggtctgcgcccgcgcctggctcagctcccgctccgcgtcggcgcgcagctggtcggcctgcgtctgcgcgttgcgcagcaactgctcggcctggtacccgatgtcgccgccgtcgaaggcgggccgggacatgatggtgcggcgcgcctcgtgcagcttggcgcgcagcacctcgacctggtagccgaggtcctcggcgtgctggatcgccttttcccgctcggtcttcagccgcttcatctcggcctcgaaccgagagaggtggtcgacgtcagccgccggctctcgctcctggctctcgtagccccgcactgcgcggtcccatccgtcccctggtcgcaaatcttcccgaacgagctccgtccgtccgacggacggggcccccggggaatggtgtcagatcaacggcggagcatgtgctgctgccccgtcgcccgccccccgaaacacgaccccggcggtcccggcgcccaaggcgacaggaccgggtcaccctggactgagcggcgaccgcacccaaccctaccggcccctatgtacgagggtcagtgctcaggtgactcaacggccgccgaagtgaccagttctgtcagtacgccatggcagtccttggggtgcaggaaggtgatccgcgaccccatggaaccgcgccggggctcgtcgtacagaacgcgtacgcccttgtcgcggatgtccgcggcgtccgcgtccacgtccgccgtaccgaaggcgatgtggtggacgccctcgccgttcttcgcgagccacttgccgaccgcggagtcctcgcgggtcggctccaggagctggaggtacgaggcgcccccgtccgacgtatcgttgatcttgagcatggcctcgcgcaccccctgctcctcgttgacctcggtgtggaacacctcgaagccgtaggtggcacggtagaactcgacggtcgcgtcgaggtcgtggcaggcgattccgatgtggtcgattcgcgtcagcatggtttcagtgcagcgctccggaggtggttacgcaacgtgcgcgcgatcacaccgacagcccggtgacgggcgggataccgctcagtacattcgagtaaaccctcgttcactcctcggcctgtgcgggccggaaaaggggatcgcagcccatgtcttctgcatcgaacggcacgacttccgtcatcgtcgcgggtgcccgcaccccgatggggcggctgctcggctccctcaagtccttctccggggccgacctcggcagcttcgcgatcaaggccgccctcggccgcgccgggatcggcggcgaccaggtccagtacgtgatcatggggcaggtgctccaggccggcgccgggcagatccccgcccgccaggccgccgtcaaggccggcatccccatgagcgtccccgcgctcacgatcaacaaggtctgcctctccggcctcgacgccatcgcactcgccgaccagctcattcgcgcgggtgaattcgacgtgatcgtcgcgggcggccaggagtccatgaccaacgccccgcacctgctccccaagtcccgcgagggctacaagtacggtgcggtccagatgatcgacgccatggcctacgacggcctgaccgactccttcgaggacatcgccatgggcgagtccacggagaagcacaacacccggctcggcatcgagcgcgccgcccaggacgagatcgccgccctgtcccaccagcgcgccgccgccgctcagaagaacggcgtcttcgacgcggagatcaccccggtcgagatcccgcagcgcaagggcgacccggtgctgttcgccaaggacgagggcatccgcggcgacaccaccgccgagtcgctcggcaagctgcgtccggccttcgccaaggacggcaccatcaccgccggctcctcctcccagatctccgacggcgcggcggccgtggtcgtgatgagccgggccaaggccgaggagctgggcctggagtggatcgcggagatcggcgcgcacggcaatgtcgcgggccccgacaactctttgcagtcgcagccgtcgaacgccatccggcacgccctcaagaaggagggcctggaggtcgccgacctcgacctcgtcgagatcaacgaggccttcgcggccgtggccgtgcagtcaatgaaggacctcggcgtgtccaccgaaaaggtgaacgtcaacggtggtgccatcgccctcggtcacccgatcggcatgtccggcgcccggctggtgctgcacctcgccctggaactgaagcggcgcggcggcggtgtgggcgcggccgcgctgtgcggcggcggcggtcagggcgacgcgctgatcgtgcgggtgcccggggcctgacccccgagttacgacttctcactgaacggagctgtgatgcaggacgtctcctcactggtggcccaggcccgagaaggccggccgcgggccgtggcccggctgatctccctggtggagggggcgtccccgcagctcagggaggtcatggaggcgctcgcgccgctcaccggcaacgcgtacgtggtcggcctgaccggctccccgggggtcggcaagtcgacgtccacctcggcgctggtcacggcgtaccgcaagcagggcaggcgggtcggcgtactcgccgtcgacccgtcctcccccttctccggcggcgccctgctcggcgaccgggtgcggatgtcggagcacgcctccgacccgggcgtctacatccgctcgatggccacccgcggccacctcggcggcctcgcctgggccgcgccgcaggcgatccgcgtgctggacgcggccggctgcgacgtggtcctggtggagacggtgggcgtcggccagtcggaggtcgagatcgcctcccaggccgacacctccgtcgtcctgctcgcccccggcatgggcgacggcatccaggccgccaaggccggaatcctggagatcggcgacgtctacgtggtcaacaaggccgaccgtgacggtgcggacgcgaccgcccgcgagctgaaccacatgctgggcctcggcgaggcccgcgccgccggcgactggcgcccgcccatcgtcaagacggtcgccgcgcgcggcgagggtgtcgacgaggtggtcgaggcgctggagaagcaccgtgcgtggatggaggagcgggatgtcctcaccgagcgccgccgggcccgtgcggcgcgcgaggtcgagaccatcgccgtcaccacgctgcgcgagcgcatcggtgacctgcacggggaccggcggctgggcgcgctggcggagcggatcgtcgccggggaactggatccgtaccgggcggcggacgagctggtggcggggctgacgcggggctgacgcgggggctgagcggtgcggggcggtcttccggcgcggggtttcttcgcccccgccgccccttcccttcccgaccctgggggcgccacccccagacccccgctttcggcctgaacggcctcgtcctcaaacgccggacgggctgggggctcaacggcctcgtcctcaagtgccggacgggctgggggggctcaacggtctcgtcctcgagtgccggacgggctaaagtgacccgcgtgttcctcctcttggcctaggacccgccccgcacgcgaccgccgcatccggccgtcgcgcgcatcggtgtcccctagttgccttcctgctgaggaacccttcgcgtgtccacgcctctttcgcggccctcgtacgccgccgtactccgtgtcccccatgcccgccgcacgttctcggccgccctcgtcggccggctgtcgtacggcacggtctccctctccctgatgctctccctgacccggtccaccgggtcgtacgccgtggccgggctggtcatggcgctcttcggcgccacgagcgtcttcctgtccccctaccgtgcttccctcgtcgaccggctcggtccgcgccgggccttgctgcccatggccctgctctacgccgccctgctctgcgtgcttgcgggggcctgccggcgtccgggcacctccgaggccgtcctcgcggtgaccgccgggctcgcgggcgcctgcacgcccccgctcggccctacgatgcgcgcggtatgggccgaactgctcccggaccggcggctgttgcagcgtgcctacagcgtggacggcgttgccgaggaactgctcttcgtctccggtccgctcctggtcggcggcatcgtcgccgtcgcttcgccggtggtcggcgtcgtgctcagcgcggtgctggtggcggtcggcaccctcgccttcgtcacctcaccggcgaccgcggcgctgcgcccggcggggcgggagaagagcgacggcccggcagccggccgaggtggcccggggcagggccgggcgctgctgcagcccgtcgtcgtcgcggcggcggtcggcgtctcggtgagcgccgtcgacctcctcgtcgtggccttcgcgggggagcgcggcctcggggacggcacggtcgcctgggtgctcgcggcgctgtcggtgggctccgcggtcggcggtctcgtcaacggcgccgtcgcctggagttcgcccacccgggcgcggctcccgttcttcgcggccggggtcggcctctgcctcgccgccgcgggcctcgcgcccggactcggcacgctggtcctggccgtcatgtgcgcgggcctgttcgtggccccggcgctgacgacggcgtacctgatcgccgacgagagcgtggcgcccggtttccgggtccgggcgggcgcctggtgcaacaccgccgtgaacgccgggatgtccgtcggcgccgccgcggtgggcctgctggtggaacggctgccgctgccggtgtgcttcgcggtcgccggcgcggtcgccgcggcggcggcactggtgccggggtaccgccgcggggcggcccggcccgccggaagggccggcgggaccggaggggccgctcagtcgtcgtcggtgtcgtcggaactgccggagtcgtcggcgtcgtccgagtcgtgagagccgtgcgcctcgtccgagcggtcggccgtgacctttccggtcttcaggtcgacccgccagtcctgcccaccctcgccggaggcgcgcgtctcgacctcccaggcgggcctgccgtcgccgtggtcgccgtcgtcgtccagttcgacggaggtgacggtgccgtgtccggccgccgccttcgccgcctcggcggcgtccaccgaggcgcccttcagggccgcgcgcacctctgcggtgtcgtcctcgtcgtcgtcccgctcggagccgaggaccttgccggtggccgggtcgacccggacgctgtgccaggtgccgtcgccggcgaggacgtcgacctcccaggccgcgcgctcccggcggtcgtccccgtcgtccccgtcgtcgtcctcgtcgtccagctcggcggagaccgcggtgcccggggtgtccgcgagggcggcggcgacggcgtcggccgccgtcaccttcgcggcggcggcgcgggagtcgtcgcgccggtcgtcgtcgcgccggtcgtcgtcacggtcgtcggcctcgtcccgtacgccgccgtcgtccgacacggtgacggccggtgcgtccgcgacgtccgcgacgtccgcgcgggacgccgtaccccggtcgtcgtcccccgtcgtcgccagggccgtcgccgtaccgcctccgatcagtgcggcggcggtgacggcggcgatcacgatgttgcgcttcatgcggtttcctccgagtcgtccagagtccagcggttttcggtgacttcactgtcgcggaccgacgctgaggccaggctgaagccacctgaagggatcttcagctcggctttgggaccctctacccatgcgcctgttgatcgtggaggacgagaagcgcctcgccgtgtcgctcgccaagggcctcaccgcggagggatacgccgtggacgtcgtccacgacggcctggagggactgcaccgggcgggtgagggcgtgtacgacctcgtcatcctcgacatcatgctgcccggcctcaacggctaccgggtctgcgccgccctgcgcgccgccggacacgacgtgccgatcctgatgctcaccgccaaggacggcgagtacgacgaggccgagggcctggacacgggcgcggacgactacctcaccaagcccttctcctacgtcgtcctcgtcgcccgggtgaaggccctgctgcggcggcgcgggcagggggccggagcctcgcccgtgcacgtccacggcgacctcagggtcgacaccgccgcccgccgggtcttcctcggcgaggacgaggccaccctcaccgccaaggagttcgccgtcctggagcagctcgtggtgcgggccgggcaggtggtctccaaggcggagatcctggagcacgtctgggacttcgcctacgacggcgaccccaacatcgtcgaggtgtacgtcagcgcgctgcggcgcaagctgcgtgccgggctcatccggaccgtgcgcggcgccggctaccggctggagaccgggcggtgagccgcctcttcgcctcggtgcgagcccgtgccacgctcgccgccaccctcgtggtcgccgtcgccctcgtcgcggccggcaccgccgtcctgctctccctgcgctccaacctgctcggcgaggcgggcacccaggccgagcgctcggcgcgggaggtggcgacggagctggccgtcggaaccccgtacgcggacctgtcgctggacgtggacgaccggccggtgcaggtcgtcgacgacgacggcgtgctggtcgccgccagcgaggacctggagcggatcagcggcaccggcgtcgacgcggtgaagccgcggcccgccgcctccccgggtggggaggacgacgacgccgacgacgactccggcgagtccctcgaacccggcgagatcggcggacggatcaccgtcagcgacggctcggcgaccatcgacggggacacggaggactaccgtttcgccgccgtcccggtgaagaccgaggaccggggcacgctcaccgtctacgccggagccccgctctccgccgaacacggcgccgtgaacaccgccctgacggtgatgctgatcggcttcccgctgctgctcgcggtcgtggcatgggtgacctggctcgtcacccggcgcgcgctgcgcccggtggagggcatccggcgcgagatggccgcgatcaccgccagcgaggacctggcccggcgtgtcccggtgccgggcacccacgacgaggtggccaggctcgccaccaccaccaacgagacgctggccgccctggagtcctcggtggagcggcagcgcggcttcgtcgccgacgcctcgcacgagctgcgcagcccgatcgcgtcgctgcgcacccagctggaggtggccgccgcgcatcccgagctgctggatctggacggcgccgtggcggacaccgtacggctccagcggctcgccgccgatctgctgctgctggccaggctggacgcgggggagcggcccgccgacgcccgggtcgacctcgccgcgctcgcgcgcgaggcggccgaggggcgggccggggtgcgggtgcggggggacgagggcgtggtgagtgcggccggctcgcgcgggcagctggggcgggtgctggccaatctgctggacaacgccgagcggcacgcccgctcggtggtggaggtgtccgtgcgctgggacggggacacggcgctggtcgccgtgaccgacgacggtgaaggcgtgccggcggccgaccgggagcggatcttcgagcggttcgtacggctcgacgacgcgcgcagccgcgacgacggcggggccggtctcgggctggcgatcgcccgcgacgtggccgtacggcacggcggcacgctcacggtgcacgacgcaccggcaggcggcgccctgttcgagctccgcctgccgggtgaccgggccggaacggcccgggacatgtgatcagggactcagggtcgtccccgctgcccgcgcaggtgttccgcgatgggcttgagcgccttgtccagctccgtcaggtcttccggggccagcaggtcgatgaagtgcctgcggacggatgccacgtggtgcggcgcgaccttccgcatcgtctccaagccgtgctcggtgaggacggcgaagagcccgcgccggtcggactcgcagttctcccgccggaccaggttcgcgttctccatgcgggtgatctggtgggagaggcggctcttggactgcatcgtggcggtggccaggtcgctcatccgcattctgtcgccctccgactcggagaggttcaccaggatttcgtagtcgttcattgtcaggccgaacggctgcaggtccttctcgagctggtgcgtcaacagcctgttgacctccaggtgggtgcgccaagcacactgctccgtatcggtcagccagcgagtggccgtctcggtctccatgaatgaagtctacctaaaaggttgaaaggcgaactagtgaggggttttccgtgacggtgacggtgcgcacgcgttcgatgtcacactccgcagattaccgctcacagcccgaagcggcgctggaggtcccccagctgtccgggaagccccggtacccccgaccggcctcccgacgctccgggagcccccgcgccgggcacccccgcctgctgcggaggagcccccacggcctgctccgccatcagcgcctcgctcgactgcagcagcaccgtccccgcgcccacgaactcgaactggtgctcctccccggaggccccgccgagccccgtcatcgcacgtagaccgcccagtaggccggtcatgtacccgtggtcgtagtggtggcacggagacgggcagtcggcccagccgaccagggcctgcgggtcgacccggatcggcggttccatgaacaccaccggaccgttggacgcggccacgaacttcccggttccgatcagcgtcagaaagcccggcacgatcgactgcttgagcgcgaggcttggctgaaaagcgagcaggttgcccgagcgaatggtcaggttgccgtcttcgaggtcgtacgaattcacgtcgaaggcccggtcggcgaggagcatcttgcccgagccctccgccacgacccagtcgctcgcgtgcagaggcgaatggaacgaagtgcgcaccagacggtccagccggccgtgcccgatcccgttgaagtcgatcgtcccgtagtaggcgatcatcttccccttctgcaggaaccactggctccccttcagctccacacagaaggtgtacgcgttgacgttgtcgtcggccggcagcgtcgccgggtcgtggtggaccgtgctcacagcttctcctccgacgcctggacgaacaccgtgccgctgccgctcagctccagctggaacgcctcgccggagccgcgtcccaccatgtcccgccagcccagggccgtggacagcttgttgcgcacgtcgccgtggtgggcgacgtaggcctgcggatcgacgcgcaccgggcgctgcggggtgatgggcacctcgaagacgcccccgtgggccatcaccgccaccgagccgtggcccttgagggacgtggtgaacagcccctgcccgctcacctggccccgcaccatgcccatgaccccgccctgggagcccaggaacaccgtgctctgctccagggtgccctcgaaggcgaggaggcggtccgcctccacgtacagggtgtcgcccgacaggttgatcacctggacgtggtggccgccgtgtccgaagagcacggtgccgctgccctcgacggtcatcagcggcgtgtcctcgttcgccacccggcggccgatcatcgacatgacgccgccctgcccgccgcgcagattgggggtgaaggacacctcgccctggtaggcgagcatcgccccgcgctgactgaacagccgctgccccggtgcgacggtcgcccggaccatcttggagttgatctcctcgaaggccatctcacacatcccccgcgatcgtgttccgctcgctcggctgcacgtacaccagtccgtcgccctcgaagcggatctggaaggcctccccgccgccctccccgaacagcgtgcggaaggtcacacccgactggaaggactgccgcaggttcccctggtgcgccacgtacgcccccgggtcgacggtcagcgggtactgcgcgctgacccgcagcaccaccgccgggccgtcggacatgatcgccgcctgcccgtgcccctcgatcgtcgtggtgaacagcccgttgccctgggaggcgccgcgcgtgcccgtgaaactggtcccggtgcgcagccccgcgtcggccgccaggaagttgctcgactcgacgtacagcttgtcgccctggagccccaccagggtgatctccgaggcccggtccgcgaaccagcaggtcccctgccccctcacctccatcaccgtcatctgctcgccggtgatccgccgggtcaccatgccccggatgccctcaccgccgccgctcagcttcttgaaggccatctccccgtcgtacgcgaccatcgagccgttcttcgccttcacggcgtcttgggtcatgtcgacggcgaggaccttgctgccttgaagtcggaacatcgccacgtggtgaaagtagccccgccacgggtggacagaacagggcccacgggtggagaacgaccctgagtccatcccttggggcattgtttgccacaatgggcgaacgattgtgcttccgttcacaaggcggaccgcacaccgcccgcgccaccggcgcatccctcccttccgaaggtgacccgtggacctcaagaccgccaccgccctccgccgcctccgcctggtctcggcccccgaggcgatctcgttcctcctcctgctcgtctgctccgtcctgaagcggaccaccgacttcaacgcggtgccggcgatgggcatgatccacggtgtcctcttcgtgctgtacgtgatcttctgggccgacgcctggaaccgcgccaagtggccgctgaagaccgccgccctctacttcgtcctctcggtcctgccgaccggcggcttcttcgccgagcgcaagctcaagcacgaggccgagagcgcggtcatcgcctcacgcgcccgccaggaagggatcgtcaacgcatgatcgtcgccttctccgtcacaccgctcggcgtcggcgaggacgtgggggagtacgtcgccgacgccgtacgggtggtccgcacgtgaaaggccccgtccgagcacctcggagaagcgcgcggacggggccgggcgccgactcgccgagccgtgttgctcgccctcgctcagcgggtcggggctccactcgtcgcgggtcacgcgggcgtggtcggtgaactcgcgccggaacagttcgtgtccggtgcgtccggtgtgccgtagtgcccagtcctgggcatcgttcggatcgccctgcgggccggacgattcgcctcactcgtaagtgccacagaacagctcggctgtgatgcagccctccggagcgtgtcggatcgtgtggttgacgtagggcaggacggccctcacctggtccacctcctcgctggcgcttgcccgcacgagaacggcccgccaccggatcggggcccgacaacgggccgcgggtggtactcgggcagggctacagggcttcactcaaggcgaggccgtcccattcggcttctggcgcctcctccggcgtcggtccccaagtgatggtcaggcggtcggccagttgcctcgggtggagcgacacccgcaatcccatgcccgccaggaggcgggaccggtccggtacgtcgtacatctcccaggcctgcgccatggtccgtccagtggccacctggacttcccggacgtccgggtcatgtgcggccctcaggcgggcgtgcgtgtcttcgaggtcctgtgccaagctctccagtgttcccagcatcagcgggccagcggtggccatgcgtgcggccagacgctccgcctgttccttcgcttcgagcagttcggcggacaagtcgttgccgccctccagacggatgacggtctcggcgtaggagccgaaggtcgtcaggaactccgactccacgcggctgtccagcgtctccgcgtagatggtgacgtggcccgccttgcagcggtacagggggacgcccttgtccgacgtgcccccgttcagcttccccgcgcatcggtgacagaacgccatgccggaacacatgggcgtagcgcggcgcggggcacggtcctggcccgtggccagggccagcatgcgctcccggaccttgagcaactcggccgcggacaggataggttcggcgaacttcacgggcgtgatgccgtccacctcgcagaccagttcgcccttgtgggcgcgctgccctcgcagtgtgggggacttcaggagccgtcgccactgaggctccgacaggcccgtcaggcgtgccgtggccgccaccgtggagccgttgactagagccgcaacggctttgcggatcttcgcggcctggtcgtcgtcgatggcgaggtaagcggctccatcccgacgctctatgcggtagccgaacgggggacggcctgaggaccaacggccttggctccggcgtgtggcgtgcccgtcggtgatgcgggacgcgatcgcgttgcgctcccactcggcaagagcggccaacactgtggccaccatgcgcccggtcgcagtcgtcgtgtcgatggcgttgtccgtggtggcaatcgacgcgccgtgcgcttcggcccaggcgaccagccgcaggaagtcggacacggacctggcgaaacggtccagtttccacgccacgaccacggtggggcgggcagccatcagggcggccatgcccttccgtgcttccaggggcttcgcgccggacacgctggcgtcgatgtactcgacggcgtccgccgggtcgtacccgtgggcgagtaaccagcggtgagcgaaggacctctgggtttcaaggctggtgctgtcgtcggactcgcgtgataaccggaggtagatggcgatgaccgcccgttgttccgtcatgtgctccaagatatccatatcccaatgagagggacgaggtcatggacgtcgtccggcgggccgtggccgccgtcgaggcacgggcgccgcgggtctcgctggtcctcaaggcggacctccgccccggtgtgacggacggtctcacgtcgaaggtcgagacggtcgagcgccacctcgccccctgaccgtgccggtgggcggtggtatcgaagggcgagacggagctgaccggcatgtgaccggccggtaaggtctcttgccgtgccgaagcccctcagtctctccttcgatcccatcgcccgagccgacgaactctgggcacagcgctggggcggtgtgccctccatggcggcgatcacctcgatcatgcgggcccagcagatcctgctgggtgaggtcgacgccgtggtcaagccgtacgggctgaccttcgcgcgctacgaggcgctggtgctgctcaccttctccaagtcgggtgaactgccgatgtccaagatcggcgagcgcctgatggtgcaccccacctccgtgaccaacaccgtcgaccgcctggtgcgctccggtctggtggccaagcgccccaaccccaacgacggccgcggcacgctggccaccatcaccgacaagggccgcgaggtcgtcgaggcggccacccgcgacctgatggcgatggacttcggcctgggcgcgtacgacgccgaggagtgcggcgagatcttcgcgatgctcaggccgctgcgggtcgccgcgggcgacttcgacgaggactgagcgcgcgggccgggcgggcccggcgagtcgcccgacccggtcgaagatcgcgcgaaacgggcggttacgctcgtagccatgaaaaagagcgtgctgacccgctaccgggtcatggcgtacgtcaccggtgtgctgctgatcgcgctgtgcctcggcatgatcgcgaagtacgtcctggatctgggcggcgccgccgacttcacccaggtcgtcagcatcgcccacggctggctgtacgtgatctacctggtcttcgccttcgacctgggctccaaggcgaagtggccggtgaagaagcagctctgggtgctgctcgccgggaccgttccgaccgcggcgttcttcgtggagcgcagggtcagccaggagctggacgcgaaggtcgccgccaccgaggcgcccgcccccgtcaaggcgtaaccggcccctcacgagccgtcccaccgccgtgcggacacccgtacggcggtaccccatcgacatttacttggacgtcctagtaaatttgaaggcatggacgctcatgccatagaggagggccgccttcgctggcaggcccggtacgacgcggcgcgcaagcgcgacgcggacttcaccacgctctccggagaccccgtggagccggtgtacgggccccgccccggggacgagtacgagggcttcgagcggatcggctggccgggcgagtaccccttcacccgcggcctgtatccgaccgggtaccgggggcgtacgtggaccatccggcagttcgccgggttcggcaacgccgagcagaccaacgagcgctacaagatgatcctccgcaacggcggcggcgggctctcggtcgccttcgacatgccgaccctgatgggccgcgactccgacgacccgcgctcgctgggcgaggtcgggcactgcggggtggccatcgactcggccgccgacatggaagtgctgttcaaggacatcccgctcggggacgtgacgacctccatgacgatcagcgggcccgccgtgcccgtgttctgcatgtacctcgtcgccgccgagcgccagggcgtcgacgcatccgtgctcaacggcacgctgcagaccgacatcttcaaggagtacatcgcccagaaggagtggctcttccagcccgagccccacctccggctcatcggcgacctcatggagtactgcgcggccggcatccccgcctacaagccgctctccgtctccggctaccacatccgcgaggcgggcgcgacggccgcgcaggagctggcgtacacgctcgccgacggcttcggatacgtggagctgggcctcagccgcgggctcgacgtggacgtcttcgcgcccggcctctccttcttcttcgacgcgcacctcgacttcttcgaggagatcgccaagttccgcgcggcccgcaggatctgggcccgctggatgcgcgacgtgtacggcgcgcggaccgacaaggcccagtggctgcggttccacacccagaccgccggagtctcgctcaccgcgcagcagccgtacaacaacgtcgtacgcaccgcggtggaggcgctggcggccgtgctcggcggcaccaactccctgcacaccaacgcgctcgacgagaccctcgccctgcccagcgagcaggccgccgagatcgccctgcgcacccagcaggtgctgatggaggagaccggcgtcgccaacgtcgccgacccgctgggcggttcctggttcatcgagcagctgaccgaccgcatcgaggccgacgccgagaagatcttcgagcagatcaaggagcgggggctgcgcgcccaccccgacgggcagcaccccgtcggaccgatcacctccggcctgctgcgcggcatcgaggacggctggttcaccggcgagatcgccgagtccgccttccgctaccagcagtccttggagaaggacgacaagaaggtggtcggcgtcaacgtccacaccggctccgtcaccggcgacctggagatcctgcgggtcagccacgaggtcgagcgcgagcaggtgcgggtcctgggcgagcgcaaggacgcccgggacgacgccgccgtgcgcggcgccctggacgccatgctggccgcggcccgctccggcggcaacatgatcgggccgatgctggacgcggtgcgcgcggaggcgacgctgggcgagatctgcggtgtgctgcgcgacgagtggggggtgtacacggaaccggcggggttctgagcgaggccggcacccacccggggcgccccctacggcaccgaggcgcggaaggtgcgccggtacgccgagggggccactcccgcctcggcggccaggtggcggcgcagcgaggtggcggtggcgaagccgacctcgtgggcgacccgttccaccggcaggtcgctggactccagcaggtgccgggcccgccgcagccgctgttgggtcagccagcgcccgggactcagaccggtctcctcccggaagcgccgggcgaaggtgcgggtgctcatcgccgcgtgcgcggccagctcgtccagcgacagcggccggtccagccggcgcagcgcccagtcgcgggtcgggccggtgcccgtcccgctcgccggcggcaccggccgttcgatgtactgcgcctggccgccgtcccggtacggcggcacgacgcagcggcgggccacctggttggcgacctcgctgccgtggtcccggcgcaccaggtgcaggcagacgtcgacaccgctcgccgcgcccgccgaggtcagcacgtcgccgtggtcgacgaagagcacgtcggcgtccagctccacccgggggaacagctcccggaagtggtcggtgagcgcccagtgggtggtggcccggcgcccgtccaggagaccggcggcggccagcaggaaggcgccggtgcagatcgacaccaggcgggtgccggggcggacccgggccagggcggcgagcgcccgcggatccggcacggtggcggacgcggccgtgacggcgtacggcggcacgatcacggtgtccgccccggccagcacctcggggccgtgcgccggggtgacggtcaggtccgagtcggtgcgcacgggccgcccgtcgacgctcgcggacagcacttcgtagcgcccgtcggcggatcccaggacccggtgcgggatgccgagttcgaaggggtagacgccgtccagggcgaggacggcgaccttgtgggcgccggggcggggcgccgggcgcatcaaacggtccagttcggccgcgcgggcggcggcgtcggcgagcatggcacgaatgtatcggaggatgaccttcttgccatggtccgggcccgggccgatggccagcatgggggcatgacctcgacggacactcccgcgaacggcgcttccccgcacggcgccccgacgatgctcgccctgcaccagacggccctcggcggccccgaggtgctgcggcccaccgaactgccgcggcccgcaccgggcccgggcgagatcctcgtcgccgtgcacgcggccgggctgaaccccacggacttcaagcaccgcgccctgaagatcttcctgccgcccccgccgctgaccctcggctgggacgtctccggcaccgtggtggagaccggtttcggcgtcaccctcttccggcccggcgacgaggtgttcggcatgctgccctacccgcacgggcacggctcccacgccgagtacgtgaccggaccggcccgcgccttcgccgccaagcccgccgggaccgaccacgtccaggccgccgccctcccgctggccgcgctcaccgcctggcaggccctcgtcgacacggccggcctccgtgccgggcagcgggtgctgatccacgcggcggccggcggcgtgggccatctcgccgtacagatcgccaaggagcggggcgcgcacgtcaccggcaccgccagcgcacccaagcacgcgttcctgcgcgaactcggtgcggacgcctgcgtcgactaccgctccgcggacttcaccgacaccgaggagcgttacgacgtcgtcctcgacacgctcggcggggagaccgccacccgttccgtgggtgtgctccgccccggcggcatcgtcgtctccctgctgccgggcgacgcgcacaccggcgccgcggccgagcgggccggggtccgcgccgtcgtcctgctcgtcgagcacgaccatgccgggatgcgcgccatcgccgatctcgtcgaacgggggagcctgcgcgcccacgtgtccggcaccttcccgctcgccgagggggcccgggcacacgccgagggggagaccggccgcaccacgggcaagctggtcctcaccgtgcgctgagcgggcccgaaccggccgcgtcctacctaccggggcgcggccggttccgcgtcggccccgccgcccgggccgacgcctccgccgtccccgccgtcccccctgtccccgggctccccggcggcgccggccaggccccacagcagtacctgtgtcaggccgcgcacccactcctcgtccgcggcccgggcgctgaccagcgtgcggtgcaccaccgcgcccgccaccacgtcgaagatgaggtccgccgtccgggcggcctcggtcgcatcggtctccggcggcagctcgccgcgggcctgggcgcgggccctgccctccagtaccaggcgcttctgccgttcgacgatcgacgtgcgaatgcgctcgcgcagcgcgtcgtcgcgcgtggactccgcgaccaccgccatcaggccgctcctggcctcagggcgggccaggatcgccgcgaactggagcaccacgccctcgatgtcggcggcgagggagccgcggtcgggcagttccagctcgtcgaagagctccgccaccgcgtccacgaccagctcgttcttgcccgcccagcggcggtagagcgtcgtctttgcaaccccggccctcgtggcgacgtctcccagggcgagcttcgaccagccgaggtcgaccagggcggcccgcgtcgcggccaggatcgcggtgtccgccgcggcactgcgcgggcgcccggcacggccggctggggtgctgctctgcatcccccgaccttaaccggcgggtaacacgcggccggtggtgagacagatcaccgcgacggggtctggcggtggggtgttccgacgggccgtcctggcattacgctacgactcgtagcgaaagcgcgggtccgcccgcgccccagcgacgaccacgggcgtggggtggggacccggcgccgagcagcacacgcatcgggcagtacacacgccgaacagcacacatccgggcgggctttcgacccggttttcacacgcgcgcgccgtacgggggaggatagacccatgcagccacggaacatgtccatgagcggggtcgtcgacctcgccgcggtgaagcaggcccaggaggccaaggcgaaggcggagcaggcgcgcgccgaggcggcccggaccggcggtgcgggcgccgtctccccggccgacctcgtcatcgacgtcgacgaggccggcttcgagagcgatgtcctgcagcggtccaccgaggtcccggtcgtcatcgacttctgggccgagtggtgcgagccctgcaagcagttgagcccggtcctggagcggctcgccgtcgaatacaacgggcgcttcctcctcgccaagatcgacgtcgacgccaaccagatgctgatgcagcagttcggcgtccagggcatcccggccgtgttcgcggtcgtcgccggacaggcgctgcccctcttccagggggccgcgggcgagcagcagatccggcagacgctggaccagctggtgcaggtcggcgaggagcgtttcggcctgaccggtctcgtcgtcgaccccgaggcggagccgggcgccgagcggcccgccgcccccgagcgtcccgccgggccgcacgacgcggccctcgacgccgccgtacaggcgatggacgcgggcgacctgggcggcgccgtccaggcctacaagaacgtactggccgaggagccgggcaacacggaagccaaactgggcctcgcccaggccgagttgctccagcgagtgcaggacgccgatccgcagaaggtccgtcgggaagcggccgacaagccgggcgacgcccaggcgcagatcgccgccgccgacctggacctggtgggcggtcacgtggaggacgccttcgggcgcctcatcgacacggtgcgcgtcacggcgggcgacgaccgggacgccgtacggctgcggttgctggagctgttcgaggtggtcggcgccgacgacccgcgggtggccgcggcgcgccgggcgctcgcccgcgccctgttctaggcggcttgcgggccggcgctccggatcggcgtcctaaacgccgtcggcgtgttgcgtatgtgaaggagctgtcgaagaggcgtcactgcggccgcgctttaccaaaacttggtaatcgcggccgctgttactgccagtaagtcggcggcgtcgatctgtcggactctgtccatcgatcaatagttttgttccgtcctcatggcacacccagcgtcgccgaccgggcccggtgcgtcgtcccgcggtcacccggccgctactagccagtaacgaacccccttgtgccgacggcgagaatgcaccacgatcggcgacgctcggtccattcccgtaccccgacagccggtcgggccgcgggggttcctgggtccccaccgagcagggtcggcggcagtgacgccggcccttggacaggggggtcttcgctcatccggcgaagcctgtccagcagggttgtgcgtgatgcgtgtcaggcgcgaccagtggttgtcgctcgggggtgatcgccggttgttcgggcgcgttgtacgtgccgccgaggacaggcgctctccttcccgaggacgtagcacttctcccatccctgccgggccgagtcgccgactggcgacggggccgaggccaggagatgtacgtccgagaaggaggaaatatggagtcccaggtgcgtggcgggaccagatggaagcggttcgccgtggtgatggtgcccagcgtggccgccacggctgcgataggcgtcgcgctcgcgcagggcgctctcgccgcgtcgttcagtgtgtcgggccagtcgttcaaggtgacggccaaggagctcgtgggtacgggcttctcgcagtacggggcctacgacaagggcgtggacggcaaccatgccgtggcggtctcggcgttcgacaaggccaccatcaccaagatgtgccagtcggtcgtcaccccgaacatcccgctgatcggcaccgtcacgctgaggctggatgcgggcgacagcaacaaggattcgggcaaggtccacgccaagcagctctacatcgatgttcaggacctggaggcggacgccaccttcacgaacatcgacatcggcgtggctgccggggccatcaacaagggccccaggcagaagcagggtgaggtcgagggcaagcagaccagcccgggcggcttcgcgcagcaggcggaccaggccgtgctgaaggaggtgaagcagacggcgtgggcgaccaccgccggtaccttccagctcagcggtctgaagatgtcgctgaagaagggctccggcgaaggcgtcgagtgctactgagccctcgctgacgggcgggggccggttgcgcccccgcccgtcggtccttcggccgccccgcgacgtggcggcccagatcaccaccacagcaacgctgtaccagggagctgttttccatgagcgccgagactcctgccgccgtcggccagttcacccgccgcaggctgcagttccgaggctggcggggcgccaggcccttctgggccggtctgctcgtcctgctcggtggcttcccgatcatgtacttcccgtacgcgcacctgcagttcggaaacctgacggtggcgatggccaccacggccggcgccggttctctgattatcggcgtgctactggtcgtactcggcgtcagcctctggttccagaagcacgtacgggtcttcgcgggaatcgcggcgattctgctcgccctggtgtccattcccgtcgccaacttcggtggcttcatcatcggcttcatgctttcgctcgtcggcggtgccctggccgtggcgtgggcgccgggggggccggtcgagtcggggtcggccaagggcgacaagggcgagggcggcgccttcgaggtctcgggggacgactcggcttccgccccgtccctgagcgcacccgggggcgacgatcggtcaggaacgagcccggccaacggggcgaacgggaggcacagtgccggctgacgaggtgaagcacgggatggacgaggagacgtcccgtgcgagaacggggccacgtcacgcggcgcccaggaagccactgttcaccaggttccaggtgcccaccggcaaggcgatagccctggcggcgatgcccacggcggtcctcatggggctggggttcacaccgaccctcgccctcgcggacgggaacgaccagggcgcgccgtcgtccaacagcctgacggcggacgagtacaaggcctgtgtcgaggccatggcggacgccgagaaggacgcgtcccagtcgcccgaaccttcaccttccgcgactgacgacggcaagcaggacgagacggagcccagcgcctcgccgtcggccggggacacgggcgagaagccgggaacggacaaggacgcgtcctcttcgtcggattcaggttccgacgacaaggacgacacggccgccggtgacaacgccgccgacggcgacaagtccgaacccgctccgagcccttccgcgtccgaaggcaaggaatcggtcggcgcgagcgccgccgagccctccccctccgaatcggagaggggcggcctgctggagggcatcggcgacgccatagagggcatcttcaccggtggcgagaaggccgaggagaccgcgagcccgacgccgaccccctcggcgtcccagagcgccggcgacgacgcgtccgacgtcgtgaaggagaccaccgacaaggtcaccggcacggtgaaggacaccgtggacggcgcgaccgacgcggcgtcgaaggcggccgaggacaccaaggacacggtggacaaggccacggaggacgccgagaaggccgcggaggaggcgaaggacgaggtcaccgcctcgcccagcgccgacccgtccgagagcgccgcggtggacccggaggactgcccggccgccaccgatgaggagggcggtgtcgacaacacgctgcccgtgccggaggacccctggtacctggaggccagctcactcacgctgaagggcgcctcctacaagggcatcgtcgaggtgaagacggccagtggggcgacgaagaaggtcctgaagtacgtcatctccaaaggtaccgacatcggcgacctgcaccagatcgtcaaggacgacacgaccggtaggactcaccacgtccaggcggccaagggctccacgtccacgatccgcgacggcgacacggtcatgtacaccgagagtatttcgggcaacctgctcgggctgatcccgatcaccttcgacccgaagaacccgccgccgttggacatcccgctgatctacttcaccaacgtgaaggtggtgcaggccggccagttcggcggcaccctgcacgttcccggcctgcaccagtacatcaccgactgataccgcggtcgcgagccacaaccgccgagggcgccccctgcgacaggggggccctcggcgcgtacgacggggaggggggcggtcagccgcgccgtgtctcgcccaggtggaggacccgcaccatgttggtggtgccggacacgccggggggcgaaccggcggtgatcacgacggtgtcgccgtcgctgaaccggccgaggcgggccgtctcctggtccaccaggtccaccatctcgtccgtggtgttcacgaacggcaccacgtgcggctccactccccagctgagcgccagctggttgcgggtggactcgtcggtggtgaaggcgaggatcggctgggccgcgcgatagcgggagagccggcgggcggtgtcgccggactgggtgaaggcgaccaggcccttgccgcccaggaagtcggcgatctcggcggccgcacgggccaccgaaccgccctgcgtgcgcggcttcttgcccggcaccagcggctggaggcccttggagagcagctcctgctcggcggcggtgacgatcttcgacatcgtcttgacggtctcgatcgggtaggcgcccacgctcgactcggcggacagcatgaccgcgtcggcgccgtccaggatcgcgttggccacgtcggaggcctcggcgcgggtcggccgggagttcgtgatcatcgactccatcatctgggtcgccacgatcaccggcttggcgttgcgccggcacagctcgatcaggcgcttctgcaccatggggaccttctcgagcgggtactcgacggccaggtcgccacgggcgaccatcacgccgtcgaacgccatcacgacgtcctccatgttgtcgaccgcctggggcttctcgaccttggcgatcaccgggacccggcggccctcctcgtccatgacgcggtgcacgtcggcgacgtccttggcgtcccggacgaaggagagggcgaccaggtcgcagcccatgcgcagcgcgaaccggaggtcctcgacgtccttctcgctcagcgcggggacgttgaccgccgcgcccggcaggttgatgcccttgtggtcggagatgacgccgccctcgatgacgatcgtcttcacccgggggccctcgacctcggtgaccttcagctcgacgttgccgtcgttgatgagcacctggtcgcccttggtgacgtcaccgggcaggcccttgtaggtcgtgccgcagatcgtcctgtcgcccgggacgtcctcggcggtgatggtgaactcgtcaccgcgcaccagctcgacggggccctccgcgaaggtctccaggcggatcttcgggccctggaggtcggcgaggacgccgatggcccggccggtctccttggcggcggcccggacccggtcgtaacgaccctggtgctcggcgtgggtgccatggctgaagttgaagcgggccacgttcatgccggcttcgatcagcgtgacgagctgctcgtgggagtcgaccgcggggccgagagtacagacgattttcgaacggcgcatgggtgccatcctatcggtttgtttcggcgcggaatattccgtctggcggaaaatacaaaagggcgggatgccgctcaggtgagatcgggattccccgattcacttaccagcgcgtaggtctgtgtcgcgatctccatttcctcgtccgtcggtaccaccgccacggccacccgcgcccccgcgggcgagatcagccgggctccgtcgccgcgtacggcgttcagcccgccgtcgaccgccaggccgagcccctccagtccggccacggccgcctcgcgcacgggtgccgagttctccccgacccccgccgtgaacgccacggcgtccacgcgtccgagaacggcgtaataggcgccgatgtacttcttgagccggtgaatgtagatgtcgaaggccagccccgcctgctcgtcgtcctcgtccacccggcggcggatctcccgcatgtcgttgtcaccgcacagaccgaacagaccgctcctcttgttgagaagagtgtcgatctcgtcggcggacattccgccaacgcgcatcaaatggaagatgacggccgggtccatgtctcccgagcgcgtacccatcacgagtccttccaagggcgtcaggcccatggaggtgtccacgcaccggccgccccgcacggccgaggcggacgccccgttgcccaggtgcagcacgatcacgttcacgtcgcccggcgccctgcccagcagccgcgcggtctcgcgggagacgtacgcgtgcgaggtgccgtggaagccgtagcggcggatgcggtaccggtcggcgatcttcgggtcgatcgcgtagcgcgccgcggactccggcatcgtggtgtggaacgcggtgtcgaagaccgccacctgcggcaggtcgggacggagcgcctgcgcggtgcggatgccggtgaggttggccgggttgtgcagcggcgcgaccgggatcagccgctcgatctccgtgagcacgttctcgtcgatcagggtgggctcgctgaagaactcgccgccgtgcaccacgcggtgcccgatcgcggccagctccggggagtccaggcccagaccgtcccggcccagctcggcggcgaccgccttcagggcggcctcgtggtcggcgatcgggccctcctgctcccgggtgtcgccggcggccacgagggtgtgcctcagccgcgacgtccgctcaccgatgcgctcgaccagcccggccgccagccgctccccgtcgcgcatgtcgatcagctggtacttcaccgacgaggagccggagttgaggacgaggacacgcgtggagctcactgggcggacgccttctcggtcggggactgctgggcctggatcgccgtgatggcgacggtgttgacgatgtcctgcacgagcgcgccccgggacaggtcgttgaccggcttgcgcaggccctggagcaccgggccgaccgcgatggcgccggccgagcgctgcaccgccttgtaggtgttgttgccggtgttcaggtcggggaagatcagcacgctggcctgcccggcgaccgcggagccgggcagcttggtcgcggcgaccgacggctcgaccgccgcgtcgtactggatcggcccctcgacgctgaggtccgggcggcgcgagcggaccagctcggtggcctcgcggaccttgtcgacgtccgcgccggaaccggacgtgccggtcgagtacgacagcatcgcgatccgcggctccaccccgaactgcgcggcggtcgaggcggactgcgtcgcgatgtcggcgagctgctccgcgtccgggtccgggttgaccgcgcagtcgccgtagaccagcaccttgtcggccaggcacatgaagaagacggaggagacgatggccgcgtccggcttggtcttgatgatctcgaaggcgggccggatggtcgccgccgtcgagtgcaccgaccccgacaccatgccgtcggcgaacccctcctgcaccatcagcgtgccgaagtagttcacgtccgagaccacgtcgtacgccagctccacggtcacgcccttgtgggcgcgcagggcggcgtacttctcggcgaaggagtcgcgcagctcgctggcggccgggtcgatcagctcggcgccgccgaggtcgatgccgaggtcggcggccttcttgcggatctgctcgacggggccgagaagggtcagctcgcacaccccgcgccgcagcagcacctccgccgcgtgcagcacccgctcctcggtgccctccggcaggacgacccggcgcaggtcggagcgggcctgttcgagcagcttgtgctcgaacatcatcggcgtgacgcggtcgctgctgggcgcggagacccgcttgttcagctcggcggtgtcgacgtaccgctcgaagaggccgagggcggtctccgccttgcgcggggtggccgcgcccagcttgccctccagggagaagagccgttccgcggtgggaaagctggtgcccgtcaccgagagcaccggcgtgccgggggccagccgggcggcgagggtgaggatgccctcgccgggcacctcgttcagcgtcagcagcaccccggctatcggcggggtgccggcgctgtgcgcggccagcgtgccgatcaccaggtcggcgcggtcgccgggcgtgatgaccaggcagcccggggtcagcgcggccagcaggttgggcagcatggccccgccgaagacgaagtccagcgcgtcgcgggcgagcccggagtcgtcgccgaggacgatctcggcgcccagggcgtgcgcgatctgggagaccgtcggcgccgacagggcgggctcgtccggtaccacccagcacggcaccggcagccggtgcgcgagccgctcggcgatctcgtcccggtcctcgcgcgcgacccggttggtcaccatggcgagcacgtcgcagccgaggccgtcgtaggcacggaaggcgttgtgggtctcggccagcaccgagtcggcggtctgcttgcggcccccgacgacggggaggaccgaggcgccgaactcgttggcgagccgcgcgttcagggacagctcgtccgggaactgggtgtcggcgtagtcggtgcccaggaccaggacgacgtcgtagtcccgcgcgaccaggtggaagcggtcgaccagcgcggacaccagctcgtccacgccctgttccgcctggaggagggaggcctcctggtagtccatgccgtagaccgtcgcggggtcctgcgagagccggtagcgggcgcgcagcagttcgaagagccggtccggcccgtcgtgcaccaggggacggaagacgccgacccggtcgacctgccgggtcagcagttccatgacccccagctcgacgacctggcggccgtcgccgcggtcgatgccggtcacgtacacgctgcgcgtcacgcgtgctctccgtttcgtaggggtgagcggaatcctcttgacagtacccccggcgatggttaaggcgcccgtcagcgtccaccgccgcccgggccgtggaacaattggatcggctcaccggtgtcaacagcgagcaggagacacagcacgatgcgtatcggagttctcaccgcaggcggcgactgccccggcctgaacgcagtgatccggtcggtcgtgcaccgagcggtggacaactacggcgacgaggtcatcggcttcgaggacggctacgcggggctgctggacggccgttaccgcgccctggacctcaacgcggtcagcggcatcctcgcccgcggcggcaccatcctcggctcctcccgactggagcgcgaccggctccgcgaggcctgcgagaacgcgggcgacatgatccagaacttcggcatcgacgccctgatcccgatcggcggcgagggcaccctcacggccgcccggatgctgtccgacgccgggctcccggtggtcggcgtgccgaagaccatcgacaacgacatctcctccaccgaccgcaccttcggcttcgacacggcggtcggtgtcgcgaccgaggccatggaccgcctcaagaccaccgccgagtcccaccagcgcgtgatggtcgtcgaggtcatgggccggcacgccggctggatcgccctggagtccggcatggccgccggtgcccacggcatctgcctgcccgagcgccccttcgaccccgccgacctggtcaagatggtcgaggagcgcttctcccgcggcaagaagttcgccgtcgtctgcgtcgccgagggcgcccaccccgccgagggctccatggactacggcaagggcgcgatcgacaagttcggccacgagcgcttccagggcatcggcaccgcgctcgccttcgagctggagcgccggctcggcaaggaggccaagccggtcatcctcggccacgtccagcgcggcggcgtccccaccgcgtacgaccgcgtcctcgccacccgcttcggctggcacgcggtggaggccgcgcaccggggcgacttcggccggatgacggcgctgcgcggcaccgacgtggtgatggtgccgctggcggaggcggtcaccgagctgaagacggtcccgaaggaccggatggacgaggcggagtccgtcttctaggcctcccctctaggggtgcctctcgaccgccgtccagaagtggtccacgatccggtcgaggaagtcccggcccccggcgctcgagtcgggggcgccgccgccccagctgagggtggcggccatccgcccctggtagtcctggtgcagcacctggaggacgttctccaggacgcgccggtccagcggtgccagcttggcgatcgggcgcacacaaccctgccagcgcgtggtcaccgcgctcgtcagcaggtcggccagcttctcctcgcgccccgtgacggtcacgaagtcgggcagcgtgagccccagcacgtcggcgagctgggccgactggcggtcggtgccgcgccagtcgtccgactcctccatccgcaggtaggcgggaagaccgagcccgaccgcacgggccacgtcctcgggtgccagaccgcgggcgacgcggtgctcgcgcagggactgcggccgcccgatcagctcaccgggcgagcaccacagcaccccggcgagcgcggtcagctccggcccctcgggcaaggcggtcccccgctcccaggcgatgacgaggtcgggggagacgtacggcagcccgtacgagacccgtatgccgtgggcgacgtgctcgggtcccatgttgagggcggcacgcagccggcgggcggcgagggcgttgaacggagggcccgactggctcgggccgggtgagggtcggcgcacgcgccacaccgtaggggtccgcggcgatgctgactacgggctgttcggccagcgatacggattgtaggaacgtacgggggcgcgcggacccgggtgcgcccccgccccacaccccggctcctaccccttcaccgcaccgcccagcgcgaagccgccgcccagtcgccgggagatcagcacgtacagcagcacgaccggtgtggagtagacgatcgagaacgccgccagctgtccgtacgccaccatgccccggttgccgaagaagtcgttgatgctgaccgaggcgggcatctggtcgggggagagcagcagcatgaaggggacgaagaagttcccccacatcatcacgaacgagaacaccgtcaccaccgccacccctggccccatcagcggcagcacgatccgcagcagcgactggaaggacgacgccccgtccgtccacgccgcctcctccagctccttcggcaccccgtccatgaagttcttcatcaaccagatcgcgaagggcagctgcgaggcggcgaagaagaagatcgtcccctgcatggtgtcgatcatgttcacccgcacgaacagggcgtagacgggcaccatgatcgccgtgatcggcaggctggtcgcgaacaggatcgtcagcaggaagggccggttcagccgcgaccggaagcgggagagcggatacgccgcgagcaccgcgcacaccaccgtcagcagcgtcgccccgccgcacaggatcaggctgttgagcagcggggtgaaggtgatctccggggtgaggatcgcgtcgaagttgtccagcgtcaccccgtcggggaccttcacccgcagactcgcgtgcgggtcgagggcggacagcaccacccaggccagcggcagtacgaaggccgcggccgccaccagcagcccggcgtcggcggcggtgcggcgccggttgcgccgggcggcgggggtcgtacggcgggccgcccgggacgtccgagaagccgggcgaggcgcgaccgtgtccgtcatctcagacctccgtccgcagcaggcgcaggtacacgaccgagaacagcgagccgatcagcaacagcagcagcgccaccgccgtgccgtacccgatcaggctgttctggaaggcctgctcgtacatgaacagcggcagcgtctggctattgccgctcggcccgccccgcgtcatcacccagatcagcccgaagaccgacagggtctggagcgtgttgagcatcaggttggtgccgatggagcgccggatcatcggcagcgtgatgtgccacatccggcgccagccgctcgcgccgtcggcctcggcggcctcggtgacctccttggggatctcgttcagcgcggccgagtacaccagcatcgagaacgccgtgccgcgccacacgttggcgaaggacaccgccaggatcggcagcgtgaacagccagttctgggagggcaggtggagccagtccaggatggcgttgagggtgccctcgcggcggaagaaggcgtagagcaggaagcccgccaccacctccggcagcacccaggccgtgacaacgatgccaccggtgagcgtgcggaccggcttcgaggcccgctgcatcagcgaggccagggcgagccccagcgtgttctgcccgatcagcgaggacagcacggtgaacaccagggtcagccatacggcgttgaggaacgcctcgtccttgaaggcgcgggtgaagttgtcgaacccgacgaaggactcctgcgcctgcccggtgagctggaggtcggtgaaggcgatgacgacgcagtagacgatcggaccggcgaggaagagcagcaggaggacgacggcgggggagacgggcagggcgcggaagagggagcgccggacggtgccgggccgggtgccggagggcggagacgcgggcgccttccgcacctccggcccggcgtgctccggcgcggtggccgtcacttgctcaccacctggttgtcggtggcctccttgagcgcctcgtcgtagccgcgcgccgcctcctcgaccgacttgtccccggtcgtcacgccctccatggcctcctggatggcgacggacaccttcgggtacgccgggtaggcgggccggtagtgggtgtcggcgacgaggtcggtgaagaacttgatgccgggctgggcgtcgacgtaggcggggtcctcggcgacgtcctcgcggacggagatgccggagttggcgacgtaccacttctgggcgttcgccttggtctgcatcgtcttgacgaactcgaaggccaggtcggggttgcccgccttggccggaatggcccaggtccagccgcccgacatgctcacccgtcccggcgcctgcccgttctgggtcggcatggcggcgagccccagctccttcgaccactcgggccactcgtgcccgctgccctccagccagtcctgcggcagccaggagccgtcgagcgcgatcccgagcttgccctgcggcagcagctcaccgcgcaccttggtgccgaagttggggtcgagcgcgtcggagacctccggaccgagcttctccttgtacaccgtctcgacgaaggagagggagtcctcgaacccctgccccgccgtgatccacttcttgctgcccttgtcgtacagcggatcggagccgccgctccccgtgcccgtgccgtacagcagcatctcgaagccctgcatggtcgcggcctcgccggcgggcttgccggtgtagacgttgagcggtgtgacgccggggaccttctccttgatggtgcgggccgcgtcgagcacctcgtcccaggtcttcggctgccagtcggcgggcagcccggccttggcgaacacgtccttgctgaaccacaggccccgggtgtccgtcccgtccggcacgccgtacgtcttgccgtcctcgcccttggccgcggccttcgccgtgtcgatgaactggtcccagtccttccagtcggcgagatagtcgtcgagcggcttcagatacccgctggtgatgtcggagttgatgaggaacgtgtcctcgtagaccaggtccggcgcggtcttgggggagcggagcatctgctggagcttggtgtagtactccgagtccggcgccttgatcggcaccagctcgaccttcttccccgggttggccttctcgaactgcttcttgatgtcgccgaggtaggtgtccatcaccttgatggagttgtccgtcgactgcttgaaggagaccttcaccgtgtccggatcgctgccggagccgctcgagcaggcggcgagcgaggtggcggcgagcgcggtgagggagaacagggcggtgaaccggacggtgggacgcacgggcatgacctcctacgggcacacgacactgtggcctggacggctgcgtggcgaacgtaagaggaatggtctagtcaggtcaatgagcgtgcgcgggattacccctggaggaggtgatcggccttgccggctttgaacgggatgacgcgcaggttcacgttctcgctgtcggagatgcgcagcaggtgcaccgactggcgccgcgcgaccgctggggacgtcgatgtcgtccgaggacaggcgggggatcaccgccgcgaagaccgcccgggcgtgatccccggtctggagcagccccggcgggtggacggtgacggcgatacgtaggcgggtggcatgccactccatctcggcgatgtccgggcggcaaccggcgataggaggaggggcggtgcagccccttcgtcctcgtcgggggagaggtgcgggagcaggcgacccggatcctccgatcggccggtgaagcccggtgaccggggtggcagggcggcggtcgctcgggggaccggaccgtgagcgccggccctaacgccgccggtcccccttgccggtgacggggctgtggaaggtgccgccccggaagtcgatgtggtctccgccgtacgtcgctcccctggcccggagctcttggggctcctccccggagtcggaggaaccctcacggggccggtgcttgtgcagcactgcgaccgtcaccgccgcggcctgctcggcggcgcgctgctgtgaacccgaggcgtcggccccgtgcttctcggcgtcggcccggtcgctgatgccccggatgaccagggcgttcaactggccgttcaggtgggccgcccggagggcgcccgagccctccatctcgatcgcgcccgcgtcgttgtagttccggcggaggaagcgggcgatctcggactcggcgtccgccaggacgacatcccccgtggcgatcggcatgaagtgcgcccgtacgcggggcatgtcccgcaccgcggaacgggccgcctgctccagcgcgtgcgagcccggcagagccttcggccggaccaggaagccctccggggcctgcttgccgccgtggatctcgtacacctgcgtgcccacgacgacgtcgccgatcccgacgtcgtccttcagactgcccgcgaccccgacgaacagcacggcctcggggcgcagccagtggatgagctgggtggtgagggcggcggtgcgctcggcgcccatgcccagttcggcgagggcgacgtgccaggaggtgtccggcagtcggccgatctcaacccgggtgccgtcccggtgcactcgctcctcccgctcctccacgtgcgcgcggaccgcggcgtattcgagcgggagtgcggtcagcaccagaacggtgggctgcgtgtccggcatagtcataagttaccgctgggagaagggattcgagtgccggaacaggacgtcacggtggggcagttgctgctcgccgagtacgagagcgtgaagagcgagcagagggccagaatcgggttccgggacaacctcctctacgtgacgctcgccgtcgtggccgccgtcatcgccgccaccgcccaggcggagcagccgtcgatgctcctcgcgctgccgccggtgtgcctcgtcctcgggtggacctacctcgtcaacgacgagaagatctccgcgatcgggctatatgtgcgggatgatctgggacccaagctggccgaactggcggcgcacacgagcgggttcgcgaccttcgggtgggaggcgtaccaccggagcgacacccggcgccggtcccgcaagacgatccagaccgtgatcgacctgacggcgttctgcgcggtacccctggcggcgctggtcgttttctgggtgaacggggacgccacccggctgctcgtcgtgctctcggtgctggaggcgctcgccgtggcggggctcgccgcgcaggtcgtgtggtacgcgaaggcggcgtgatcgtccctccggcagggaggtacggcgcggatggaaacggcattgctggcggccctggccgagggtgcgggcggggacggtggacgccgggcggtggaggcgctggcgcgggtgctggggctcggtgccggcgcgtccgtacgagacatcgcgaaggcggcggcggaaccggcgcgacgggatgccgtacgggagtggggcgagacggtggcggagctgctcgccgccgggccgtccggcgtcgccggtgccgtcgcacgggccatggagcggtccgcgccgggcagcggggcgtcctggtacggcggcgaccacaccgacttccgggacggggtcttcctgcgcgaggtgatcggcgtacaggtcgtggtccaggagggcgggacggccgtcccggaggcgatgacgggcctgccgccgaggcccggcgggttcaccggtcgggaccgtgagaccgaggacctgttgcgggcgctggacccggacggtgcgcagtccgccgcggcgccggtcgcctccgtgtccggtctcggcggcatcggcaagaccgcgctcgccgtcgagaccgcgcacctcgcccgggaacggggctggttccccggcggaatcctcttcatcgacctgcacggctacgaccgggaacccgtcaccgcggaccgaagtctgcgaaccctgctgcatgctctcgggatcccgccggagcacatgcccacgacgacggacgagcgggccgcgctctaccgctcgacgctggccgttcgggccggtgagcgcggcgggatgctggtcctggccgacaacgcctcctcggcggagcaggtacggcccctcctgcccggcgacttccggcaccgcgtcctggtcacgtcccgcgaccggctgccccaactcggtgcacggctcctccccctggacgaactcgggacgagggaggcgtacgaactcctcgaccgcgccctgcggatcgccgatccgcacgacggccgggtgggcgacgaccccggcacgaccggccgactcgcgagcctctgcgggcaccttccgctggccctgcagatcgcggccgccctgctggcggccgatccggccaagccggtgagcgagctcgtggcggaactggccgaggcccacgaccgcctggaccacctcgacgacggcgaacgcagcgtccgcgccgccttcgagctgtcctaccgccgtctgccgcccgagcaggcccggctgctgcgcctgcttgcactcgcgccggggcccgaggtgagcgacgaggtcgtcgccgccctggtcggcgccgaccgacctccagtgcgtgaccaacacgcccttgcccgggcgcacctagtggagagggggcacacgcgcggatcgtggcggttgcacgacctggtgcgggtgttcggggcgggagtggtggcccgagcagagggtgacgccgcgcgggcgcgtgtgctgcggcactacctggagcgggcccgcgcggcggacgcccgcctgaagccccgcacggaggacgacgaggggacccggccgttccggagccgtgaggaggcactcgcctggttcgacgcggagcgtgccgggctcgtggccgccgtccagtgggcgacggaccggcagctggccgccgacgccgtacggctcgccggcgcgctcggtgagtacctggactggcggcgccgcttcgacgactcggtcaccgtgtgcggggccgtgtgcgccgccgcgcgccgggcgggcgacgaggccgccgaggccgccgcatggaacaggacggggaccgcgctgcggggcaaccgccgtctcagggaggcgtacgacgcccaccgacgggcgcacgatctgtacgacgccctgggccacgacaacggcagggccatggcgttgtccaacctcggcgccatcctgggcgacgtcgggcaggtcgacgacgccgtggacgccttccggctcgcgctcggcctcttccgtcgcaccggcgaccggcacagcgaggccggcgtgtggaacaacctcgccctgatactgcgcaagtccgggcgcgtggacgaggcactcgacgccctgcgatccgctctcggcctctaccgggagacgggggaccggccccgcgagggcagggcccggcacaactacgccgtcgccctcaacgcacgcggccgtacggcggaagccgtgaccgcctgcctcgacagtctggacatctgcgaggagttcgaggactggcacggtgccgcccggacgctgtacgccctcgggctcgtgcacgagacggccggggacgcggagcgggcgcgcgtacgtatgacgcaggccgcggacgcctacgagcgcgcgggctcgcccaaggaggccgagcaggcccgcagggcggcacggctcaccggccccgcacccaccggtacaccagctccggccgccccacctgaccgtactgcggactccggcccgcccggcccgcgtccaccaggtgttccaggtaacgccgggccgtgatgcgggagatgcccaccgcttccgcgaccccggcggccgtgaggccctcggtcgcgccgcgcagggcgcccgtcacccgctccagggtcgggccgctcaggcccttgggcagggccgcggggccgggggcgcggagggtggccagggcgcggtccacctcgtcctggccgctggcctccccggcggtgccccggaactccgcgtagcggaccaggcggtcgcgcagggtggcgaaggtgaagggcttcaggacgtactggacgacgcccagcgacaccccctcgcgcaccatcgtcaggtcccgcgccgacgtcaccgctatcacgtcggtgtggtgtcccgccgcgcgcagtgaccgggccagctggagtccgtgcacgtccggcaggtgcaggtcgagcaggagcaggtcgaccggcgtgcggtccagcatgcggcgggcctccgcaccggtgtgcgccttgccgaccgcgacgaaccccggcacccggccgacgtacatcacgtgcgcgtcggcggcgaccgggtcgtcctcgacgaccaggacccggatgggctgcgagtcggcggtgctcacagcgcacccccggcgcccggtctgcccgccgcggcggccggtgccgctccgtcccccagcggcagccgggcctcgaagcgggcgccgccgccctccgcctccgtgacggtcagggcgccgccgtgccgccgcaccgcctgccggaccagggcgagccccaggccgcgtccgccctccccggccggcttggtcgagtagccccgctggaagaccaggtcggcgtgggcgggatcgaccccggcaccggtgtccgacacccgcagcaccagctcggagccgccggcgccggaagcctccgtgtacgccgccaccgtcacccgcgacggcaccgccccctgcgtcgcgtccaccgcgttgtccaccaggttgcccaggatcgtcaccaggtcccgggcgggcagcgacggcggcagcagtccgtcgtccagtcggctgtcctgggacaccaccagctccactccccgttcgttggcctgcgccgtcttgcccagcagcagcgccgcgagcaccggctcgctcaccgccgccaccacctggtcggtgagggcctgtgccagttccagctcggccgtcgcgaactccacggcctcctccgcccgccccagctcgatcagcgagacgaccgtgtgcagccggttcgccgcctcgtgcgcctgggagcgcagcgcctgggtgaatccgcgctccgagttcagctcgcccgtcagcgactgcaactccgtcacgtcccgcagcgtcaccaccgtgccccggcgctcaccgccggagaccggcgaggtgttcaccaccagcacccgctccgccgccaggtgcacctcgtccacccggggttccgaggccagcagcgcccccgtcagctgcgagggcagccccaggtccgccaccgaggcgccgaccacgtcaccgcgcacgccgagcagctcccgtccgccgtcgttgatgagcgcgacacggtactgcccgtccagcatcagcagcccctcccgcaccgcgtgcagcgccgcctgatggtagtcgtgcatccggctcagctcgtcggcgttcatgccgtgcgtgtgccggcgcagccgcgcgttgatcacgtacgtcccgaccgcgccgagcagcagcgcccccgccgccacccccgacagggccgtgagctgctcctgcgcccgcttgctgatctcctcgaccttgatcccggcactgaccaggccgacgatccggccgtcgtccacgatcggtgtgaccgcccgcaccgaggggccgagcgtgcccgtgtaggtctcggtgaaggtctggccccgctgcgcacgctcgatgtggccctggaagaggtggccgatttccgtcggctcggggtgggtccagcggatgccctccggattcatgatcgtcacgaagtccacgtccgtgtcccgcatgacccgcaccgcgtacggctggaggagtgccgtcgggtccggggtgcggatggcctccgccacggacggcgagtcggcgatcgccagcgacaccgccctggcctggcgcccggccgcctcctccgcctgcccccggtcgctgatgtagctgaacagcgcgtacccgaccacgacgaccgctatcaggacggcctgcatggcgaagagctgccccgccaggctgcggggtctcgggacgcggaggtgcatgccgccagtctccctcgtggctggattgtgaactaaatgaacgcaagggtgaccgcgctcacacgccgggagatagtcacccagtccccgctacacacccccggacgtgagccgcacgccggtgatgccgacgacgtcgtcaaggagggccgccgtgaccagcgaagccgctacggcacctgccgcacccaaagccaagcgcgaccgcacgcactatctctacatcgccgtgatcatcgcggtcgccctcggtatcgccgtcggtctggccgcccccgacttcgccaccgagctgaagccgctcggcaccggcttcgtgaacctgatcaagatgatgatctccccgatcatcttctgcacgatcgtgctgggcatcggctcggtccgcaaggccgccaaggtcggcgcggtcggcggcatcgccctcggctacttcctggtgatgtcgctggtggcgctcgccatcggcctgatcgtcggcaacatcctggacccgggcacgggcctcgcggtcaccgacgccgtcaaggagaccggccaggcgcaggtcgacgcggaggccaagggcaccgtcgacttcctgatgggcatcatcccgaccaccatcgtctcggcgttcaccgcgggcgaggtgctccagaccctgctcatcgccctgctctgcggcttcgcactccaggccatgggcaacgccgggcagcccgtcctgcgcggcatcgagcacatccagcggctggtcttccgcgtcctggcgatgatcatgtgggccgccccggtcggtgccttcggtgccatcgccgccgtcaccggctcggccggcgtcgacgccctcaagagcctggccgtgctgatgctcggcttctacgcgacctgcgtcatcttcctcttcgtggtgctcggcacggtgctgcgcgtcgtcgccgggatcaacgtcttctcgctcttcaagtacctgggccgcgagttcctgctgatcctgtccacctcctcctccgagtcggcgctgccccgcctcatcgcgaagatggagcacctcggaatcagcaagccggtggtcggcatcaccgtcccgaccggctactcgttcaacctcgacggcaccatgatctacatgaccatggcctcgctgttcatctcggacgccatgggcacgccgatgtcgatcggcgagcagatcccgctgctgctcttcctgctggtggcctccaagggcgccgccggtgtctccggcgccggtctcgccacgctggccggcggcctccagtcgcacaagcccgccctggtggacggcatcggcctgatcgtcggcatcgaccgcttcatgagcgaggcccgcgcgctgaccaacttcggcggcaacgccgtcgccaccgtcctcatcggcacctggaccaaggagatcgacaaggaccgggtgaacgaggtgctggccggccgggccccgttcgacgagaagaccctcctggacgacggtcacggccccgccgacggtgacggcgccggtgcgccggacctgcccgagcagggcggcgagaaggagctggcgaaggcctgacggccgtacgacgcccccgcgtgccggggcggctcccgcacaccccgggcggctgaggtgctccccccgttgctcagccgcccggccccccgaagaagccccgcgcaccccccgcgcggggcttcttgccttgacgtccgcgtcaaggcttacgttcgtccccatgcgaatcggcgagctggccgcacgggccgggaccaccacgcggacgctgcggtactacgagtcgcggggtctgctgcccgcgcggcggggcggcaacggctaccggacctacgacgaggacgacctgaagctgctgcggcagatcaggaccctccaggacttcgggttcgacctggaggagacccgccccttcgtggagtgcctgcgcgccgggcacccggagggcgactcctgtccggcgtccctcgtggtctaccggcgcaagctggccgagctggacacgctgatcgagcagctcacgtcggtgcgcgcgcaggtcgccgcacagctgacgcgggccgaggcggcggctccggggggtccggagcccaagtgcgaactgggaggacacggatgaagaccagcggggtgcccgaggtgacggacgcggacttcgcggcggaggtgatcggctccgagctgcccgtgctggtggagttcaccgccgactggtgcccgccgtgccggcagatggcgccggtgctcagcgccctggccgaggaggagggtgaccggttccgcgtggtgcagctgaacgtcgaccagaacccggcgaccacgaacgcgtacaaggtgctgtcgatgccgacgttcatggtgttccgcggcggtgagccggtgaagtcgatggtcggctcccggcccaagcggcggctgctggaggagctggccgacgtggtctgaccggcccggcgcgcggactggccggcgcagaaaaaatcccccgagcaattgcgctcgggggatttctctgcgtatattcgttgattcgtgacttcacaggaatgaggtcgcgaagaagttcagtaggcacagtatatgcggccgggagtggaattgtcaaacaccgaatttccggacgatgaattgctgcacgagcaggaattcatcgacggactgtacgcgcgcgtggacgcgctgcgcggcgacgccgaggactccgtgaccgacgcgctcgcgcagggcaacaccccccagcaggcccgtctggagcgggacatcctggtcgccgagcgctccgggctgctcgccgcgctcaacgcggtggacggctccctctgcttcggccggatcgacctcacctccgggcagggccaccacatcggccgcatcggcctgcgcgccgacgacgccgaacgcacccccgtcctcatcgactggcgggccggtgtcgcccgccccttctacctggccaccggccacaccccgatggggctgcgccgccgccggcacatcaccagcgagggccgcacggtcaccgcgctgcacgacgagatcctcgacctcggcgacgagaggcgcaccggccacgaggacccctccggcgacgccgtgctgctcgccgcgctgaactccgcgcgcaccggccgcatgggcgacatcgtgcagaccatccaggccgaccaggaccgcatcatccgcgccccgcaccgcggcgtcctggtcgtcgagggcggccccggcaccggcaagaccgccgtcgccctgcaccgcgccgcctacctcctctacgagcaccgcgaactgctcgccaagcgcgccgtcctcatcgtcggccccaacccggccttcctcggctacatcggcgaggtgctgccctcgctcggcgagaccggcgtgctcctcgccaccgtcggcgagctgttccccggcgtgaaggccacggcgacggacacccccgaggcggcggccgtgaagggccgggccgagatggccgacgtgctcgcggaggcggtccgcgcccggcaggcactgcccgacccggtgatcgcgatcgagcacgaccgcgacatcctcatgctcgacgacgacctggtcaacgtcgcccgcgagcgcacccgcgccgccaagctgccgcacaacgcggcccgcgaacacttcgagggacacatcctcaacaccctcaccgacatggtcgccgagcgcatcggcaccgacccctacgacggcagcaacctcctcgaccccagcgacatcacccagatccgcgacgaactcgccgagaaccccgaggtctggtccgccgtcgaccggctgtggccccggctcacgccgcagcgcctggtcgccgacctcctcgccgccccggagtccttcctccccgccgaggacgccgccgccgtccgccgcccggtcacccggcgctggaccgtcgccgacgtgcccctgctggacgaggccgccgaactgctcggcgtcgacgaccggatcgcccgctcccgcgccgaacgcgagcgggaggagcagatcgcctacgcgcagggcgtcctcgacgtgtcgtacgcgtcccgcacctacgagttcgaggacaaggacgaggaggacgccgaggtcctgtccgcgcacgacatcatcgacgccgagcgcttcgccgagcgccaggaggaggacgaccaccgcagcgccgccgaacgcgccgcggccgaccgcacctgggcgttcgggcacatcatcgtggacgaggcgcaggagctgtccccgatggcctggcggctgctcatgcgccgctgccccacccgctcgatgaccctggtcggcgacccggcgcagaccgcggaggcggccggtgtcggctcctggtcgaagatcctcgccccctacgtcgaggaccgctgggagcacacccgcctcggcgtcaactaccgcaccccggccgaggtcatggacctcgcggcggccgtggtccgcgccgacgacccggagttcacgccgccgagttcggtgcgctcgaccggcgcacgcccctgggtccgcgcgaccggcgacctcccggccgccgtggccgaggcggtccgggagctgacccccgaggagggccgcctcgccgtcatcgccccgcgcgagctgcaccgggtcctggcagcccgcctggacggcgtgacggcggacgccgagcccgacctcacccaccgcgtcgtactgctcgacccgcgccagtccaagggcctggagttcgactccgtcctggtcgtcgagcccggccgctacggcaccagcgacctgtacgtcgccctcacccgcgccacccagcacctcggcgtcctgcacagcgagccgctgcccaagggcctggaggacgcgggctgaccggcgggccggccggtcaggccggacgcagccacaccgtcgccaggggcggcagggtcagccggatgctcgccgggcggccgtgccaccctgcggctccggcttgaccgggtccgggttgaccacgtcgccgccgccgtaccgcgccgcgtcggtgttgagcacctcgtgccaggccgggacctcgtcgggcacgccgaggcggtagccggagcggaccaccggggcgaagttcgacaccgcgagcagcggagtgccgtcggcgtccagccgcaggaacgccaggacgttgtcctcggccgcgtcgccgaccacccaggagaaaccggaagggtgggtgtcgcgccgccacagcgcgggcgtcgcccggtagacggtgttcaggtcccgcaccaggtcgcgcacgccccggtggtccgccgacgccccgtactccgggtcgagcagccaccagtcggggccgtgcgcctccgaccactccgcgccctgcgcgaactcctgccccatgaacaggagttgcttgccggggtgggcccacatgaagccgaggtacgcccgctcgttggcgcgctgctgccaccagtcgccgggcatcttcgacaccagggacctcttgccgtgcaccacctcgtcgtgggatatcggcagcacgtagttctcgctgtacgcgtacaccatggagaaggtcatctccccgtggtggtgcttgcggtgcaccggctcgtggctcatgtagtcgagcgagtcgtgcatccagcccatgttccacttcagcccgaagccgagcccgccgaagccgctcggcccctcgtggtgcgtggcccgggtgaccccgtcccaggccgtcgactcctccgccaccgtcacgacaccgggcacccgccggtacagcgtcgcgttcatctcctggaggaacgccaccgcgtccaggttctcccggccgccgtgctcgttcggctcccactcgcccggctcgcgcgagtagtcgaggtacagcatcgaggcgaccgcgtccacgcgcagcccgtcgatgtggaactcctcgcaccagtacacggcgttggccaccaggaagttgcgcacctcccggcgcccgaagtcgaactccagcgtcccccagtccggatgcgcggcccgcagtggatcggagtgctcgtacagcgggcgcccgtcgaactcggccagcgcccagtcgtcgcgcgggaagtgcgccggtacccagtccatcagcacgccgatcccggcccggtgcagccggtcgaccaggtacttgaagtcgtcggggtcgcccagccgggccgtgggcgcgtagaacccggtgacctggtacccccaggagccgccgaaggggtgctcggcgaccggcatcagctcgacgtgggtgaagccgaggtccgcgacgtaggcggggagctgctcggccagttgccggtaggtcaggccggggcgccaggagggcaggtggacctcgtacacggacatcggcgcctcgtgcgcgggcgcgtccgcgcggtgggccagccactcctcgtcgccccacgtgtagtccgaggcgtgcacgacggaggacgtggccggtggcacctccgtacgccgggccagcgggtcggcgcggaaggtgcgcgaaccgtcgggcctggtgatctcgaacttgtacagctcgcccgcgccgacgcccggcaggaacagctcccacaccccggtcgacccgagcgagcgcatcgggtggccggtaccgtcccagaagttgaagccgccggccacccggaccccgcgcgcgttcggcgcccacaccgcgaaccgggtgcccgccaccccttcgtgcgtcgtcgggtgcgcgccgagcgcccgccacagctgctcgtgccgcccctcgccgagcaggtggaggtccagctcgcccagggtgggcaggaaccggtacgggtcctcgacctcctgttccgtcccctcgtacgccacgaggagacggtgggccgggacgtccttcagcggcaccaggccggagaagaagccgtccccgtcgtcgtgcagcccgacccgcagctccccggacagcacggtcacggccagggcgtacggccggaacacccggaacgcgaccccgccgggcacccggtgggcaccgagcaccgcgtgcggatcgtggtgcgtgccggcgagcagccgctcccggtcggcggcgtccggggcgggggagacggcgacctctgccccggagacggaggtggtggcggacgcgttggcggaggcggtggtcctccggggcgccttcttcttcgcggccttggccggcttcttcccggtcggcgtcttcccggccggcttcttcccggtcgtcttcctcgggtcgggaccgctggacgaggggcggggggtcacgggtggggcctcctgggcacagtgggagcggacgcggacgtcatgccggctcgggcacggacaggcggcgcaccgccgccaggggcacctcgagccactcgggacggtgccgggcctcgtacaggacctcgtagaccgccttgtccgtctcgtaggcgcgcagcagcaccgggtcggtgcgcgggtcgtggccgcccgcctccgcgtacccggtgcagtacgcggcccggcaggactcggcccagcccggtacacgtacgtcggccgagtgcgcggcgtagtcgaaggagcgcagcatccccgcgacgtcccgcaccgcgggctgcggcagccggcgctcggccaggggcttcgccggttccccctcgaagtcgatcagggaccactccccgtcgggggagcgcaggcactggccgaggtgcaggtcgccgtggacgcgctgtgccgaccaggctcggccctcggaggccaggtccgccaacgccgtgaacgccgtccgcagcccgggcgcgtacgaccgaagcaggggcacggcccgcgccgccgcctccagccgctcggtcatgccgtcggcgagctgccgggcctgggcgtggccgagggtgacggtcggcagcgcgcgggccagcgcggtgtgcacctcggcggtggcccgcccgagtgcccgggcctcggcggcgaagtcctcgcccttggccagctcgcgcagcgccagctcccagccgtcggtcgcgccctgcagatagggctggagcacgcccagcacccaggtccggccggccaggtccgccaccatccaccccgccggtgcgggcacccgggggcagccctcgcgggccagggccagcggcagttccaggtcggggttgacgccgggcacgatccgccgcagcaccttgaggatgaacgtatctccgtacacgaccgacgagttcgactgctcggcggtcatcagccgcggcaccagccccgcgcgtatgacgtcgtccggtgcccgctcgaagcgcagcccgccgatgcgggcccgcgtgcgcagcgcctccagcagcacctcggcgggacgggtgtcgtacagggcgtcgtaggcggtgcgcccggccgccgggccctcggtcacatgaccgatcagggcgggcgcgagccggggcggcagcgcctcgcgggtgccgatcaggagctggtagcagtcgcccggctcctgagccccgcctccggccggggtgtgccgctggtgggcgcggaccagcacgtggtggaggccgaggcgggagtcggcggggagcagttcggtcgcggcgaccagggagaagccggtgaccgggcggcccttgccggcgaaccagcgttgccgcggcagccactcccgcaacagggggtcgagggacgcgaggagtcccggcgggctggtgtcggtgcgtatgacggcttccggcatggcgtgtcgcgtcctttccctcaggcggcgtccttgcgcaggcggaaccagtagaagccgtgaccgcccagggtcagcaggtacggcaggtcaccgaccgccgggaagcggaccccgccgaacagctcgaccggatggcgtccgtcgaaggcgctgaggtccagctccgtcggctgcgcgaaccgggagaagttgtggacgcacagcaccaggtcgtcctcgtgttcgcgcaggaaggccaggacggcagggttggacgacggcagctcggtgtaggtgcccaggccgaaggccacgttctgcttgcggatctcgatcatgcgccgggtccagtgcagcagggaggagggcgaggccatggacgcctcgacgttcgtcacctggtaaccgtggaccgggtccatgatcgtgggcaggaacaggcggcccgggtcggacgacgagaagcccgcgttgcggtcgggcgtccactgcatgggggtgcgcacggcgtcgcggtcgccgagccagatgttgtcgcccatgccgatctcgtcgccgtagtagaggatcggcgagccgggcagggacagcagcagggcggtgaacagctcgatctggttgcggtcgttgtcgaggagcggggcgagcctgcgccggatgccgatgttggcgcgcatgcgcgggtccttggcgtactccgcgtacatgtagtcgcgttcctcgtcggtgaccatctccagggtcagctcgtcgtggttgcgcaggaagatgccccactggcagccggacgggatggccggggtcttggcgaggatttcggagaccgggtagcgggactcccttctgaccgccatgaagatgcggggcatgacggggaagtggaaggccatgtggcactcgtcgccgcccgccgcgtagtcgccgaagtagtcgaccacgtcctccggccactggttggcctcggccagcaccaccgtgtccgggtactgcgcgtcgatctccttgcgcacccgcttcaggaagtcgtgcgtgcgcgggaggttctcgcagttggtgccctcctcctggtagaggtacggcaccgcgtccagccggaacccgtcgatgcccaggtccagccagaacttcagcgcggagatcatctcctcctgcacgaccgggttctcgtagttgaggtccggctggtgggagaagaaccggtgccagtagtactgcttgcgcaccgggtcgtaggtccagttggacgcctcggtgtcgacgaagatgatccgcgcgtcctggaactgcttgtcgtcgtcggcccagacgtagtagtcgccgtaggggccgtccgggttcctgcgggactcctggaaccacgggtgctggtcgctggtgtggttcatgacgaagtcgatgatcacgcgcatgccgcgctggtgcgccgcgtccacgaactccacgaagtcggccaggtcgccgaactccggcagcacggcggtgtagtcggagacgtcgtaaccgccgtcgcgcagcggtgacttgaagaagggcgggagccacaggcagtccacgccgagccattgcaggtagtccagcttggcggtcaggcccttgagatcaccgatgccgtcgccgttgctgtcctggaaggagcggacgaggacctcgtagaagacggctcgtttgaaccagtccgggtcccggtccttggcgggggtgtcctcgaaggtgtccggcacgggctcgttgacgatcatgtggtgtgtgaccctccgatctgcgggtgggacggtcgcagaaccgtgcagacgtgcgcgggcgtacggcccggctccaggcgcacatagttggccctgccccagtggtaggtctcgccggtcagctcgtcgcgtaccggcaccgactcgtgccagtccaggccgagttgcggcatgtccaacgagaccgtcgcctcctgggtgtggcgggggtcgaggttcacgaccaccagaaccgtgttcgacccctgccgcttcgagtaggcgatcacctcttccttgtccgtggggtggaagtgcagatcgcgcagttggcgcagagccgggttctcgcgccggatggtgttgaggcgggtgacgaggggggcgatggtggtgccctcgcgggcggcgcgggtccagtcgcggggtttgagctggtacttctcgctgtcgaggtattcctcgctgccctcgcgcaggggggtgttctcgcagagttcgtagccgctgtagatgccccaggtgggggagagggtggcggcgaggacggcgcggacctcgaaggcggggcggccgccgtgctggaggtaggcgtgcaggatgtcgggggtgttggcgaagaagttgggccgcatgtaggaggcggcctcccccgacagttcggtgaggtactcggtcagttcctgcttggtgttgcgccaggtgaagtaggtgtaggactgctggaagccgatctgggcgagggtggccatcatggcggggcgggtgaaggcctcggccaggaagatgacgtcggggtccgtgccgttgatgtcggcgatgacgcgttcccagaaggcgacgggtttggtgtgggggttgtcgacgcggaagatgcgcacgccgtggtccatccagtggcgcaggatgcggacggtttcggtggcgaggccgtcggggtcggcgtcgaaggcgatggggtagatgtcctggtatttcttgggcgggttctcggcgtgggcgatggtgccgtcggggcggtggtggaaccactcggggtgtttgtggacccaggggtggtcgggggagcactggagggcgaagtcgagggcgatctccaggcccagtttcccggcttcggtgacgaagtggtcgaagtcgtcgagggtgcccagggcggggtggatgctgtcgtggccgccttcgggggagccgatggcccaggggacgccgacgtcgtcaccggtggcggagagggtgttgttgcggcctttgcggtgggtggtgccgatggggtggatcggggggaggtagacgacgtcgaagcccatggcggcgatggcgggcagccggcgggcggcggtgcggaaggtgccgtgcggggtgtggggggtgccttcggagcgggggaagaactcgtaccaggcgccgtagagggcgcgttcgcgttcgacgagcagggggagggggtcggaggaggtgaccaggtcccgcagcgggtggcgggccaggaccgcgtccacctgaggcgtcaacgccgccgccagcctggacgcggccggcctgctctcgtcccgcagcgcgtccacggcggccagcagttcacgccggtcctcgcgtccgggcacgtcggcggcggcccgctcgtacagccgggcgccctcctccaggaccaggtccgtgtccaggcccgccgggatcttgatccgggcgtggtgccgccaggtggtgaccggatcgccccacgcctccacggtgtacgaccacgtcccggtctcgcccgcggtgacggtggcgccccagcggtcggtgcccggggccagctcccgcatcggcgtccaggggcccggccggccccgcggatctctcaggacgacgttggcccccaccgcgtcgtgcccttcccggaacacggtggcggagacctcgaacgactcaccggtgacggccttggccggcctgcgcccccgctggacgaccggacggacgtccaggacggggatgcgcccgacgaccgtggggcgctccgcggaggtggctgacgagtggtgcgtggcgggcatgaccgctcctgtccgcgtcaactgggtgggcggatgactgctggggaggtgggtcctgcttggtgcgtgcggggcgtaccgcaggagccttcccacactcttccggtgggcaatccggcactttgttaactactcgcgcgtatgtcgacatcacgacacaccacgcgatctgaccgtcgctttcccggatgccgctcccgcaatcagcgttcgtcgcgacatgtgcagctttccttgcgggccgaagcgccacaagaaggccgagggggaaagatccggccatatcgacacgccgtgcgcgtcagttcccgtccggcgcatcagggcgaaggccccaacaagggacacatcgcgcggtaacgtcgtgagggtgaaggcgatccgtcgactgaccgtccgtcccgttctccccgaccccctccggccgctcagtgatctggcccgcaatctgcgctggtcctggcacccggagacccgcgacctcttccactccgtcgaccccgagtgctggaccgcgtccggcggcgacccggtacggctgctcggcaccgtccggcccgcgcgtctcgcggagctggccgaggaccggcgcttcctgcgccggctcaccgcggtggcctacgacctcgaccactacatgaccggcgaccgctggtaccaggcccagtccggccgactccccgccgccgtggcctacttctcgcccgagttcggcatcaccgccgccctgccccagtactccggcggtctcggcatcctggccggcgaccacctcaaggcggccagcgacctgggggtgccgctcgtcggcgtgggcctgctctaccgccacggctacttccgccagtccctctcccgggacggctggcagcaggagcactaccccgtcctcgacccccacgagctgcccctcgcgcccctgaaggagcgcgacggcaccccggcgcacgtcgccctcgcgctgcccggcggccgggagctgcgggcccgcgtctggctggcccaggtcggccgggtgccgctgctgctgctcgactccgacgtcgaggagaacgaccccggcgaacgcggcgtcaccgaccggctctacggcggcggcagcgagcaccggctcctccaggagatgctgctcggcatagggggtgtccgggcggtacggacgtactgccggatcaccgggcaccccgcgccggaggtgttccacaccaacgagggccacgccggcttcctcggcctggagcgcatcgccgaactgtgcgacgcgggttcggacttcggctcggcgctggaggcggtgcgggccggcaccgtcttcaccacgcacactccggtcccggccggcatcgaccgcttcgaccgcgagctggtcgcccgccacttcggccccgacgccgaactcccgcgcatcgaggtcgaacgcgtcctcaggctcggcatggagacgtacccgggcggcgagccgaacctgttcaacatggccgtgatgggtctccggctcgcccagcgcgccaacggcgtctccgtgctgcacggcggggtcagccggggcatgttcgccgggctgtggccgggcttcgacgccgacgaggtgccgatcacctccgtcaccaacggcgtgcacgcaccgacctgggtggcccccgaggtgttccggctcggcgcccggcagatcggcgtgcagcgggccgaggacgcgctggccgtcggcggttcggaccgctgggactcggtcgccgacatccccgaccgggacatctgggagctgcgccgcaccctgcgcgcccagctcgtggaggaggtgcgcgagcggctgcgcgcctcctggcggcagcggggcgccgggacggcggagctgggctggatcgacgacgccctcgacccggacgtgctcaccatcggcttcgcgcggcgcgtcccgtcgtacaagcgcctcacgctgatgctgcgggaccgggagcggctgacggagctgctgctgcatcccgagcggccgatccagatcgtcgtcgcgggcaaggcgcacccggcggacgacgggggcaagcggctggtgcaggagctggtgcggttcgcggacgacgcacgggtgcggcaccgcatcgtgttcctgccggactacggcatggcgatggcgcagaagctctacccgggctgcgacatctggctgaacaacccgctgcggccgctggaggcctgcggcacctccggcatgaaggcggcgctcaacggctgcctcaacctgtcggtcctcgacggctggtgggacgagtggtaccagccggacttcggctgggcgatccccaccgccgacggcgccggcaccgacccggaccggcgcgacgccatagaggccgacgccctctacgacctgctggagcagcggatcaccccgcgcttctacgagcggggcgcgagcgggctgcccgaccggtggctggagatggtgcgcaggaccctcagcctgctcggcccgaaggtgctggccggccgcatggtccgcgagtacgtcgagcggctctacacccccgccgccgaggcgcaccgtgcgatggacccggactccgcgcgggggctcgccgagtggaaggcgcgggtgcgggcggcctggcccggggtgagcgtcgaccacgtggagacctccgccgccaccgccagcgccgaactcggcaccacgctcgccctgcgggtgcgggtgaagctcggcgacctcgcgccggaggacgtggaggtgcaggcggtctccggccgggtggactccgaggaccggatcaccgacgcggcgaggacgtcgctgaaaccggtgggcggacccgacctggagggccgctgggcctacgagggtccgctcgccctggaccgcaccggccccttcggctacacggtccgcgtcctgcccgcgcaccggctgctggcctccggcgtggagaccggcctggtcgcggtgccctcaggcgacctggtggaggcggcgggcctgctgatgcggtgaccggagcagcccggcggcagtgggcggtggcgacgaggagggctcagtcctgctcgtcgccaccgctcagccgcctgaggacggtgccgcaccggcgggcgtaggcgtgctggaaggcgcgggccgccggcccgccggccttggcgtaccacgtggccgggcggctgaaggcgtgcaccgtcagccagaccgtcccgtcacccgtgcggtccaccacgaaggcctcctcgccggactccgggtggccgggcagcgtgccgtaggcccagccggcccggcgcggctcctccagggtccacaccacccggcagggcgccttgatcaggccggcgagggtgacggtgacgtcgacgccgggcgcggcgcgctccgcacccgcctcgatgccgacgcccatctcccggtgcatctcccaggtcagcacggcctcggccgcccgccggaacaccggttcgccctccccgaggcgggtgcgtacgtgcatggggcggaagccgggcgggcaggcgccctgctcgcgggtggcgccgacgtcgtcgtacgtgaaggacatgggcaccaagggtagggcggcacccgggaaccgctggttccgggtgccgccggtcatgtcggtcgcgggtcagctcacgttgatcgcggtccaggaggcgcccaccgtcttgtactcggtgctgtcggcgccgtacaggtcggacgccgcgctcagggtggccgtgcgggcgtcggcgtagtcggtcgtcgacgtcatgtactcggtcagcgccttgtaccagatctgcagggccttgtcgcggccgatgccggtgaccgtggagccgtcggaggtcggggagtcgtagtccaccccgtcgaccgtccgcgccccgctgccctccgacagcaggaagaagaagtggttggccggaccggacgagtagtgcacgtcgacgccgccgagaccggagtcccagtagtccttggacgcgccgtccttgctgggctcgtccatgtagcgcagcggggtgccgtcgccgttgatgtcgatccgctcgccgatgaggtagtcgcccttgtcggcggagctgttcgcgaagtactccacgccggtgccgaagatgtccgacgtcgcctcgttgaggccgccggactccccgctgtagttgagccccgcggtgttggaggtgacgccgtggctcatctcgtgcccggccacgtccagcgaggtcagcgggttggtgttgcccgtgccgtcgccgtaggtcatgcagaagcagctgtccgaccagaaggcgttgacgtagttgctgccgtagtggacgcgggagtaggcggccttgccgtcgttcttgatgccgctgcgcccgaagctctccttgtagaagtcccaggtgacctgggcgccgtaggcggcgtcgacggcggcggtctggtcctgcgggtcgctggaggcggcgccggtgccccaggtgtcgtcggcgtcggtgaacagcgtgccggtgccggaggtcttgcgggccaggttgtacgtcttgtggccgccgcgtccggtgtcgtagagctggtacgacgagcccgaccgggtggtgccgagttcgaccgtgcccgagtagaggctcttgccggagccggtctcgatgccctggtactcgtacagcttggcgccggtgtcggcgtcggtgatgacgtgcagttcgttcggggtgccgtcgtcctggaggccgccgaccacggtctcgtaggcgagcacgggcttgccctgggcggcccagatcaccttgcggggcgcggagtcggccgcggtcttcgacgacccggcgtccttggcggcggacagcgcctgctgctcggccttggccgccttcaccttcggggtgacggtggccaccttgacggcggcctcggtcgccttggtgacgcctctggtggcgccggactccgagcggtgcacgacgaggtcgccgccgaggacgggcaggccgtcgtaggtgcgctcgtagcgggtgtgcacggagccgtcgcggtccttcaccacgtccttgacgaccagcttctccttggcgccgaggcccatctcccgggcggtaccggccgcgccggcctgctgctcctgtatgagcgcgctgcgggcgctgcccgacagcaggacgggcgcacccggaagcgccgacggcgcggcgctgtcggcggcggcgttgcccgcggtgaggccggtggtgagcatcgctccggcggcgaccgcggtggcgagggccagagtggtgcgcttgtggcacgcgaagagggaagacacacaagctccttcggtggggggatctccggacggcgtggggtgtccggccggttgctgcgaagttgtgctgtgggtgacggaagactgacaccgaaggcgcgtacatgtcaggagggcgcgatgatgttggccgaaaaccgacggttgggtgtctgttgcgggaatgtgaaggccgtgtgacctcggtcaagtggcaacaaggccggcgtaagtgcttggcaaaaaccggtagtcggcggcggacatggagagggcgccgctccggaggattcgaacctccggagcggcgccctgacttgggggtggtgcgtccgcgggccggtcggcctacgggaaggtgagccgccaggcgtcgatgtagccggtgtccgccgggccctggtcctggacgcgcagcttccaggtgccgttggccgattcggaggaggcgttgaccgtgtacgtctcgtgcacgtcctccgccgggtcgtagccgctgttcttcaggcggtacgtcgacccgtcgggcgcgaccaggtcgatctgcaggtcaccgcgccaggtgtgctcgatgtccacgcccacctggaggttgctcggcgcgttgccggtgcgtccggagaccgtgagggacgaggtcaccgcggacccgtagtcggggatgttcacgttcgtggtgctctcgaacgtggtgccgtcaccggggtcgccgccaccgggccgggcgccgacgttgatgcccgcccacgcgttcgccaccgcggtgtactcggcgctgtcggtgccgtacagctcaccggccgccgcgagggtgccggtgcgggcgcccgcgtagttggtggtcgacgtgaacttggtggtgagcgcgcggaaccagatcttctccgccttggcgcggcctatgccggtcaccgggaggccgtccgaggtgggcgagttgtacgtgacaccgttgatggtcttggtgccgctgccctcgctgagcaggtagaagaagtggttggccgggccggacgagtagtggacgtccaccccgccgatccccgagtaccaggagtccttggacgcgccgtccttgctcggcttgtccatgtagcgcagcggcgtgccgtcgccgttgatgtcgatctcctcgccgatgaggtagtcaccgacgtccgaggagttgttggcgtagaactcgaccgcggtcgcgaagatgtcggacgtggcctcgttcagaccgccggactcgccgctgtagttgagccccgcggtgacggaggtgacgccgtggctcatctcgtgcgcggccacgtcgatggacgtcagcgggttggcgttgccggagccgtcgccgtacgtcatgcagaagcagctgtcctgccagaaggcgttgacgtagttgttgccgtagtggacccgggagtaggcgcccaccccgtcgccgcggatgcccgagcggccgtgcacgttcttgtagtagtcccaggtcagcgccgcgccgtagtgggcgtcggcggcggcggtctccgcgttggaggcgctgccgttgccccacacgtcgtcggagcccgagaagagcgtcccggtgccggaggtgccgcggttgaggttgtacgtcttgtggttgccgcgcgccgtgtcggtcagcgtgtacgacgaacccgactgcgcggtgcccagcgtgaccgtgccgctgtagagggtgttgccggtgccgttctcgatgccctggtactcgtacagcttggcgccggtggcggcgtcggtgatgacgtgcagctcgttcggggtgccgtcctcctggaggccgcccacgaccgtctcgtacgccaggaccggagtgccgctcgccgcccagatcaccttgcgcggggcgcggtcggcgtccggctgctcggcaccggcggccttcgcggcggacaccgcctgggactccgccttggcggcggagatcttcggcgtcacggtggccggcctgagcgccttcgccgtggccttcacgacctgctcggtcttccccgcgtccgtggccaccacgaggtcgccgccgaggacgggcagaccgtcgtaggtgcgctcgtagcgggtgtgcagggtgccgtcgcggtccttggccacgtcccggacgaccagcttctccttggcgcccagacccagctcgccggcggtcttcgccttggtggcgtcggcgtcgcggatcagctcggcgcgctgggccgggctgagcctgaccagctcgttgcccttggcgggcgacgggtcgggggccgcggtggcggtgccggactggaccgccgtggcgatcagcgcggcgacgccggccagcgcgacggccgcggcacggcggtgcgcggtacggcgcgaggtgtgggaggtggtgtgggaggtgcgtctgtggggagtgctgctgctcaacactgactccttctgcgtggccacgggttgcgcggccaggggagaccggtcggcgggtggccggccgggcggaactgtgcggtacgcagaaacctggtgctaggagctggccgcggcacagcgctcgtggggaagctgtgggggcactgtgaaggggccgacggaagagtggcaggagaaagcgctacttgtcaggagcgcgtcagcaagttggctggaaatggttcgttgaccgggcgttcacgttcgataaacggaatcgttgctgtcgcggtgcggttactgtccggtcagtcagtaaccggcggacggctccccgtgccaggagccccacagggccgcgtacgccccgcccgccgccaccagctcgtcgtgcgtgcccagctcggtcagcagaccgtcctccatcaccgccacccggtcggcgtcgtgcgcggtgtgcaggcggtgcgcgatggcgatgacggtgcggcccttcagtacggcggccagtgcctgctccgtgtgccgggccgtcgtcgggtccagcagggccgtggcctcgtccaggatcagcgtgtgcgggtcggccagcaccacccgggccagggcgagctgctgggcctgcgagccgtccggggagtgccccttcgcgcccagctcggcgcccaggcccccgggcagctcccgcacccatccctcggcgcccaccgcggcgagcgcggcccacaactcctcgtcggcggcccccggttcggcgatcaggagattgtcgcggaccgtccccaggaacacatggtgctcctgggtgaccagcaccacctgccggcgcagccgctccggacccagggcgaccacgggcaccccgcccaccgtcaccgaaccctccgtcggcgcgtcgacgcccgccaggagcctgctcagcgtcgtcttgcccgcccccgacggccccaccaccgccagccgctcgcccggccgcacggtgaggtccactccgcgcagcacctccccgccccggtcgtaggcgtaccgcaccccggacacgtcgatacggtcgccgtccggaaccgccgcctcgtccgccgtcgcccgcggggcccgcgccagcccctccacccgggcgaacgaggcggcaccggcctgcagttgctcgacccgcatcagcacctcgtcgagcggccccgccagctgctggagatacacggcgcaggacaccaccgcgccgaggctcgccgacccgtgcgcgtgcaggaccccgccgagcagcagcacgcccgccacgggaaggacgtaggagatgtccaccgccgggaagaacacactgcgcaggaacagcgtccgcaaccgggtgcgcagcgagacctccagcgccccgcggttggtggcgacgcgccgctcggccagcccgaacgcctcgaccgtgcgggcccccgccaccgtggccgccaggctctccgcgacgtcggagttggccgcgccctcggcgaggtaggccgcccgcgcccggcgcagataccagcgcagcgcgatccaggccggagtcagccccagcaccccggccaggccgagcagcgggtcgagcacgaacaccgcggcggtgaggaacagcgcctgcaccgcgttgaccagcagctcgggaccggcgtcgcgcagcgtcgtgccgacggcggtcacgtcggcggtgccgcgcgtcgtcaggtccccggaccccgcccgctccacgaccgacgcgggcagcgccagcgcccgttccacgtaccgctcccgcacccgggcgagggtccgctccccgaaccggtgccccacgtaccgcgcccagcgggccagcagcaactgcgccagcgagcacagcaggatggcgagggccatccggtccacggcgccgaccccgcccccgccgcgcacctcgtcgacgatccggcccagcagccacggacccgccaggccggccagtgcggccagcgcgttgagaccgaggacgaccgcgaaggacctccggtcggtgcgcacgaggccggccgcggcccggcggacgtcggcgccctcggcgacgggcagctgtgtcatcgcgccggttccccttcttcggcggcctcgccgtcctcggcgtcccgtgcgaccagggctcggtaacccggttcggagtccaggagttcgcggtgcgtgccggtggcggcgaccttgccgtcgaccaggtggtgcacgacgtccgcgcggtcgaggagcaggggcgaggtggcggccagtacggtcgtacggccctggcgggccgctctgagccggtcggccacggtggcctccgtgtgggcgtccagggcggaggtgggttccgcggcgaggaggacttccgggtcggtcagaagggcgcgggcgagtcggatgcgttggcgttgtcctccggacaggtctcgggcctgggccgcgacctgggtcttcaggccgtccgggagggcgcggacgatgtcttcggcggcggccgcgtttatggctgcggtgagatgcggcgcctcgtctgccccggtgggttgttggccgggtgcgggtgcgggtgcgggtgcgttgtggcttgtcgcgcagttccccgcgcccctcgggtcagtgtccggtacgcctattacagcgctcagcgtgcctgcgaaaaggtcggcttccgggtccgccaccaggatgcgtgcccgtacctgtgtcagcgggatctcggccagcgggatgtccccccaggtcgcgtccgacggggtgtagcggcccagccggtccaggatgccggtggcgtcggacgggtgggccgtgaccagggcggtcaggcggccgggggtgatccggacgcccgaggccgggtcgtagagcaccgagggttccgcgggggcgtcccgggtgccttcgtccggggccggttccaggcccaggaaggcgacgacgcggcgggcggccaccacgccgcggctgagctggtggcccatctcgatgaggaacgccaccggccagcccagcgcgacgacgtagccgtacaccgacaccagttcgcccacactgatgtgaccctgcgcggcctggcgggcgcccagccaggtcaccagggccaggaacagcaccggcagccccaccccgagggcctggatccagctggtcaccgcgccgacccggtagccctgctcgcgcagccggcccgagtcccggcggaaggcgtccgcgaccaggcccttgccgcccagcccgttcagcacccgcagcccgcccgcgaggtcgccgatccgcgcggtcaggacggactgccgctcccggtactccgcctccctgccctggagccgtcccatgagcgggccgaggagcaccccgagcgccgggaccccgagcagcaccaccagggcgagccggggcgacaccgacagcatcagtccgccgaccgccgcataggcgacgaccgcgccgacgcccggccccacggccgtcagggacgtgctgatcgtctgcacgtcgcccaccccgatggtgacgacctcgccggtccccacctgcccgcgcagcgccgcgccgagccgcgtggcgtgcccgacgaccaccttcaccgtgcggaagttggcatccatccgcaccttcgtcatcgtgcggtgccgcatcatgcccagccacgcgttgaccccgccgacggcgaccatggcgcccgtccagcccgccagcgcgcccaggtcaccgggctccagaccgtggtcgacggcgcgggccatcagatacggcgtcgccgccagcagcaccatccagacactggccagcaccgcccccgccaggcaccggggccactggcgcctcaccagccacgccaggtaccgccagccgccgcggcggtccggagcaccggggtcctcgtatgcgtcgatcctcacgccaggctgtcccgccaggcgcggtgcagatccgcgaaccggcccgtaccggcgatgagttcgtccggcgcgccgtcctcgacgatccggccgtgctccatcaccagcacccggtcggcgatctccacggtggagagccggtgcgcgatgacgaccgccgtacggcccttcagcaccgtcgtcatcgcccgctgcaccgcccgctccccggggatgtccagcgaactggtcgcctcgtccaggatcagcaccgccgggtcggcgagcagcgcccgcgcgaacgccacgagctgccgctgaccggcggagatacggccgccccgcttgcgtacgtcggtgtcgtagccgtccggcagcgcggcgatgaagtcgtgggcgccgatcgccttcgcggcccgctcgatctcctcccgcgtcgcctccggacggccgatggcgatgttgtcggcgaccgtgccggagaacaggaacgcctcctgcgtcaccatcaccaccccgcgccgcagttcgggcacggccaggtcgcgcaggtcggtgccgtccagcaggacccgccctgcggaggggtcgtagaaccgggcgagcagcttggccagcgtcgacttgccggcgccggtcgagcccacgacggcgaccgtctgaccggccgggagcgtcagcccgaagcgcggcaggacctcaccgccggtgcggtagccgaagctcaccgagtcgaagacgacctcgcggccggggtgctccgactccagcggcggcagctccttcggcgcggtcggctccggcaccgacggcgtctgggccagcagcccggcgatcttctccagcgaggcggccgccgactggtacgagttgaggaacatgcccagccggtcgatcgggtcgtacagccggcgcaggtacagcaccgccgccgccagcaccccgagcgccagcgtgccgtccgcgacccggtaggcgccccacagcacgatgcccgcgacggccgtgttggcgaccaggcgggaaccgaccacgtaacgcgccatctccagcagcgcgtcgccgttggtccgctcgtgccggtggttcagcaccgcgaagtcggcgtcattggcggcctcccggcggaaggagcgcaccggccggatgccgttcatcgtctccacgaacttcacgatcaccgccgcgatcgccgtggaccgctgccggtacacccgccccgcgcgccgctggtagagccggaccagcgcgtacagcggcacgaacgacgccaccgccacggcgcccaggcccaggtccagccagagcagcagcgcggcgatgtagacgaaggacaggatgaccgtcaccagctcctggagcccctcgtcgagcagctcgcgcagggactccacgtccgtggtggaacgcgagatgaggcggcccgaggtgtagcgctcgtggaagtcgacgctcagcgcctgcgcgtgccggaagatgcgcccgcgcaggtcgagcagcacgtcctggctgacgcgggccgccgccgcgatgaaggcgtactggagtccgcccgccgccagcgagcacagcaggtagccggcgcccaccgcgatcagcgggccgtggtcgtcgtcccgcagcgccggcacggcgtggtcgatggcgtacgccaccagcagcgggcccgcctgcacggccgcctgctggagcagcaggaggaggacggtgagggcgacccgggccttcatgggcatcagcagggagcgcagcagggcgccggtcgcacccggcgggctgggcaggacgtcctggtcgaagccgtcgtcggcggcggtgccggtccccgcctcggccgggtccccgggcccggggcgctccggctgttccctgcccggcgcggtggccgtgggcgcggtcatcggccgtctccttcctggggcccctcgtcgccctcgtgcccgtcggacccggacatcagatgggcgtactcggggctggtgcgcagcagttcgtgatgggtgccgacggcggcgatgcggccctcggacagcagggcgacgcggtcggcgagcaggacggtggaagggcggtgggccacgatcagcgcggtggtgtccgcgaggacctgccgcagggcggcctcgacggcggcctccgtgtgcacgtccagcgcggacagcgggtcgtccaggacgaggaacctcggtctgcccaccacggcccgcgcgagcgcgaggcgctgacgctggccgccggagaggctgaggccctgctcgccgacctgggtgccggtgccctgcgggagcgcgtgcgcgaagtcggcctgcgcgacggcgagcgcgcggtccagcgcctcgtcgtcggcgccctcacccgcacccatcagcacgttctcaccgacggtggccgagaagagggtgggctcctcgaaggccacggcgaccatcgaacgcagctcctcgcgggacagggcggtgatgtcctcgccgtccagcgtgatccggccctcggtcacctcgtgcaggcgcgggacgagcgcggtcagcgtcgtcttgccactgccggtggcaccgaccagggccatggactcgccgggacggatgtgcaggtcgacgtccgtcaggagcggcgtggagtcgggagcggcgtcgggataccggaaccggacgtgctcgaagcgcaggccttgtggacgaccggcgttggcgctgacctcggggagggggcgctgctcgctggacggtgcctcccccggtgcccggacggcctgggaggtacccccatcgtccaccctcccccgctctcggcttcgctcgagcggggggacccccatcgccccggcggcacgaccgcccgcagccgggtcggcttccacctccgcgtccatcacctcgaagtaccggtccgtggccgtcgccgcctcctggctcatcgccagcaggaagccgatggactccaccggccaccgcagcgccagcgccgtggacaggaacgccaccagcgtccccgccgacagcgccccgtccgccacctggaccgccccgaccaccagcgccgcaccgatcgccacctcgggcagcgtcacgatgaccgcccagatggccgcgagcagccgcgccttgcgcagctccgtgccgcgcagtgtgtgcgacagttcgtggaaggcgcgggcctggctgcggtgccggccgaagcccttgacgatccggatgccgagcacgctctcctcgaccacggtcgtcagatccccgacctggtcctgcgcgcgccgcgccaccgcggagtacttcttctcgaagatcccgcaggtgatcatcaccgggatggcgggccccaggatgaccagcccgagcgtccagtcctggaccagcatgatgcccacgccgaccaggatcgtcacgccgttgaccagcaggaacgtcagcgggaaggcgaggaacatgcggagcagcatcaggtcggtcgtcccgcgcgacagcaactgccccgaggcccagcggtcgtggaaggccaccggcaggcgttgcagacgccggtagagatccgcccgcatgcccgcctcgacacccgccagcggcctggccaccagccaccgccgcacaccgaacagcagcgcctccgccagcccgaggagcagcaggtacagcgccccgagccacacgcccgccggatcaccgtcggcgaccggcccgtccaccatccacttcaggaccagcgggatcaccagacccacgcaggaggcgaggatcgctatgaccgcggccgtccccaaccgcgcgcgcaccggtcgcacatagggccacagccgcagcagggcacgtacggtggaacgcttctcggcggcgtccggggcggcgtccgggacgagatccgtggcgggtgcaggtttcgtgggcatcagcagcgagcctacggtttgccactgacactgcccaccgagttttcgggtccgcccggggtcgtacggaagcctcgccggggtcgtaccggcgcatcaaccgatcggctgatgcgccttcgagcgcgtcggccgatgtggcggaccccggcccgccgggacgctggtgccatgcccgtcatcgaagtcaccgacctgcgcaagtcctacgggggccgccccgtcgtcgacggtgtgtccttcgccgtcgaggagggcgagatcttcggcgtcctcggccccaacggcgccggcaagaccaccaccgtcgagtgcgtcgagggactgcgcgtccccgacgccggccgggtccgggtcaccggcctcgaccccgtcgccgaccaccggcgggtcgccgaggtcctcggcgcccagctccagcagagcgaactccagcccaaactcaccgtccgcgaggcgctggagctgtacgccgccttctacccgaagcccgccgactggcgcccgctcgccgagcggctcgacctcgtcccgatgctggacacccggttcgccaagctctccggcggccagaagcagcgcctgttcatcgcgctggccctggtcggcgacccgcgcgtcgtcgtcctggacgagctgaccaccggtctcgacccgcgcgcccgccgggagacctggcagctcatcgaggacatccgcgcgggcggcgtcaccgtcctgctggtcacccacttcatggaggaggcccagcggctgtgcgaccggatcgcggtgatcgaccgggggcgtatcgccgcgctggacaccccggccggactgatccggcgctcgaccggcgccaccgtcatcagcttcaccccgtccgcgccgctggacgaggcggacctgcgcgcgctgccggagctggcctccgccgagttcagggacggccgcgtcaccctgtccggcaccgacgagaccgtcaacgccgtcatcaccctgctcgcccgcacccgcgtcaccgcgcaccagctccgggtcaccgacaccacgctggacgacgccttcctggacctgacggaggccaccgcatgaccaccgacgtcttcgacaccgccgtactgaggaccgagctgcgcctgttccgccgcgaacccggcgcgctgttctggatgctggtgttcccgaccctgctgctggcgatcctcggttccatcccgtccttccgcgaggccgacccctccttcggcggactgcgcccggtcgacgcctacgtgccggtggcggtgctgctcggcctgaccgtcggcggcctccagggcatgccgcaggtcctcaccggctaccgggagcggggcatcctgcgccggatgtccgccaccccggtgcgcccggcggcgctgctgtccgcccagatggcggtgtgcggcggggccgccctggtctcggcgctgctcgcgctcgccgtcggacggctcgccttcgacgtgagcctgcccgagcagcccctcggctacctcctggcactgctcctcgccgtgctcgccgcgctctccctgggcgccgtgctctccgccctgtcccgcaccacgaagatcgccggcgcgatcgggtcggccgcgctgttcccggcgatgttctgcgcgggcgtgtggctgccggtgcaggccatgccggacctgctggcccggatcgtgggctggaccccgttcggcgcggccgcccaggccctcaacgaggccgcggcgggcgactggccggactggtcccacctggcggtcctggttggctggacggtgctgctcaccgcggcggccgcgcgctggttccgctgggagtgaccggagagaccggagtgagcgaggaaggccgagtgagcgaggaaggcggccgcgtgtccgacaatgacgccatgacgcggacggcggcggtcgacgagcggtgggcggcgttccaccgctggggcccgtacgcgctgctggccgtcgggacgctggtcgcctggtcggccgccgacgccatcggcatgacgaccggcgagcggcgggcgagcggcgcactgatcggcgcggccgtcgtgctgcaactgtggtggaaccgggcggcgcgcacccgccccgggccgtccccggccggcacctgctactacgccgtccgctgggccatcggcttcgccctcacctggctgaacccgctgttcgccttctacgcggtcgtcggctacttcggcgcccagtacctgctgccccgcaggctgtgccgggccgggctgttcgccaccgccgtcaccctcgcgggttcgcagtccggcgggctgccgccgaacggggtcatgggctgggtgctcttcggtgcgatcctcaccgtcaacagcatgctggtggccctcttcgcgcacttcgccgcgctggaggaggcccgcagccgcgcccgcgtcgagaccatcgccgaactggagcgcaccaacgccgccctccagcaggccctcgacgagaacgccgccctccacgcccagctcctcgtgcaggcccgcgaggccggggtcgccgacgagcgcaggcggctggccgccgagatccacgacaccctggcccagggcctgaccggcatcatcgcccagctccaggtcgtggcggccgccccggacccggcgctgggccgggagcacctggaccgcgccctcgccctggcccggcacagcctcggcgaggcccgccgctccgtgcacaacctctcaccggtcgcgctggccgaggacggactgccggacgcgctgaagaagacggtgacggagtggggcgcacgcaccggcgtccaggcccggttcaccgtcaccggcaccgccgagcacctgcacgacgaggtcgccgccacactgctgcgcatcgcccaggaggccctgtccaacacggcccggcacgcggccgccgaccgggtgggcgtcaccctctcctacatgggcgacgaggtcaccctcgacatccgcgacgacggccggggcttcgacccgctgaccgcgcgggagtgcggtcccggcggcggcttcggcctggacggcatgcgggcccgcgccgagcgcatcgccggttcgctcaccgtcgaggcggaaccggggcacggcaccgccgtctcggctcgcgtaccgttggtccgccatgaccgatgacgaagcgattgccgccgcggcggccgacgacgccgtgatctccctgctcatcgtcgacgaccaccccgtggtccgcgacggcctgcgcggcatgttcgagtccgcgcccggcttccgcgtcctcggcgaggcggcgggcggcaccgaggccgtggaacgggccgccgcgctcgaccccgacgtggtcctcatggacctgcggatgccgggcggttcgggcgtggccgccatccgtgagctgaccaggcgcggcgcccgcgcgagggtgctcgtgctcaccacgtacgacaccgactccgacacgctgcccgcgatcgaggccggcgcgaccggctacctcctcaaggacgcgccccgcgacgacctgttcaccgcggtccgcgcggcggcccaggggcgcacggtgctgtccccggcggtcgcctcccgcctggtctccgccgtccgcgccccgaagacccccggcgccgagcccctctccgcccgcgagcgcgaggtgctcgccctggtggcgcgcggcacctccaacaaggagatcgcccgggagctgttcatcagcgaggcgaccgtgaagacccacctcacccacctctacgccaagctgggcgtcaacgaccgggcggcggccgtcgcgacggcgtacgaccggggcatcctcggctgaacgggcccgcgccgcggcgccgatgcgccccggtcggccgggcccgcgccctcaccccgccctcagcagcagcaccgtccgcgccgggaccgtgatctccgctcccgcggggtgtgcggtgcccggtgcctcgccctgttcctcctgcccggtgtcgacgaccacctcgtaccgctccgcccacggggcgcccggcaggacgaagccggccggctccccgcccgcgtgcagcacggccaggaagctgtcgtcgacgaccgggtcgccgtgctcgtcgcggcccgggatgtcccgcccggacaggtacatgccgagggtggcggcgggggcgtaccagtcccgctccgtcatctccgtgccgcccgcggtgaaccaggccaggtcgcgcaggccgtccgcggagtgcgcgcggccggagaagaaggcccggcggcgcagcaccgggtgccggtggcgcaggccgatcagccgggaggccagcgcgaacaggggggcccactccgggtcgtcccgcaggctccagtccacccagccggtctcgttgtcctggcagtaggcgttgttgctcccgcgctgggtgcggcccatctcgtcgcccgccaccagcatcggcaccccggtcgacagcagcagcgtggtcagcaggttgcggagctggcgccgccgcagcgcgcggacctgcgcgtcgtccgtctcgccctccgtgccgcagttccaggaccggttgtcgtccgtgccgtcccggttgccctcgccgttggcctcgttgtgcttgcgctcgtacgacaccaggtcgcgcagcgtgaagccgtcgtgcgcggtgacgaagttgaccgaggcgtacggcctgcgtccgccccacgcgtacaggtcgctggagcccgacaggcggtagcccatctcccggacgtccggcagcgcgtgccgccagaagtcccggaccgcattgcggtagcggtcgttccactcggtccacagcggcgggaaggcgccgacctggtagccgcccgagcccacgtcccacggctcggcgatcagcttcacccggcgcagcaccgggtcctgcgcgatcaccgcgaggaacggggagagcatgtcgacgtcgtgcatcgagcgggccagcgccgcggccaggtcgaagcggaagccgtccacgcccatctcggtgacccagtaccgcagcgagtcggtgatcaggcgcagcacgtgcggctggaccacgtgcagggtgttgccgcagccggtgtagtcggcgtaccggcgggcgtcgggctggagacggtagtagccgcggttgtcgatgcccttcagggagagcgtcgggcccagctcgcccgcctccgccgtgtggttgtagaccacgtcgaggatcacctcgatgccggccgcgtgcagcgcgcgcaccatccgcttgaactcgccgacctgttcaccggtggtgccggaggcggtgtagccggcgtgcggggcgaagtagccgaccgagttgtagccccagtagtttctcaggccgcgctccagcagatggctctcgtgcgcgaactggtgcaccggcagcagctccaccgccgtcacgcccagccgcgtcaggtgcgcgatcgccgccgggtgggcgaggcccgcgtaggtgccgcgcagctcgggcgggatctccgggtggagcttggtgaagccgcgcacgtgcagctcgtagatgaccgagtccgcccacggcgtcttgggccgccggtcgtccgaccagtcgtcgtcgtcatggaccacgacgcccttggggacgtgcggcgccgagtcgcggtcgtcgcgcacggtgtccgcgacccgctgctccggccagtcccgcacgtggccgtacacctcgggcggcagaccgaagtcgccgtccacggcgcgggcgtacgggtcgaggagcagcttcgccggattccagcgggcgccggtccacgggtcccagcggccgtgcacccggtagccgtaacgctgcccgggccggacgcccggcacgaaaccgtgccagatctcgtgcgtcagctcggtcagccgcacccggctctccctggcgccggggcccggcccgtcgaacaggcacagctcgaccgcctccgccccgcccgcccacagggcgaagttggtccccgccacctggtccgggccggtccggaaccgggcgcccagcggcaccggggtgcccggccgggccggcacggcgggcggcggagcggcgcgccgcgcaccattgaccacgacggcggggcgcccgtccgcggcggcccgctccccgggcaccgcctcccgctcggctgcgctggacacctgtcggcctcccacggctcgtggaacgacgtccggcaggagggcgcacggcgtcccggccgctgctccccgtcgcgtcgtcctccccacagttctgcccaccgggtggctcgcactcacgtttccccagggccgaccggtcgttacgggtggatgtgaggcacgtacacgagcgcgcacggcgcgcgggcgccgctctggccgcccttctgacatgggcaggactgctggccggggccaccggatgcacctcggacggcggcggcgtcggttccggcatcggctcgggcatcggcgagatgttcggcaagcaacccgccgccgaggacgtcatccgcgtcacccccgacgacgggagcaaggccgtccggccggacgggaagctgtcggtgcgggtgcccgacgggcgcctggagtcggtgcgggtcgtccggtcgcaggacgcgcaggagaccccggtgcccggccggatctccgaggacggcctgtcctggcggcccgacgacggccggctcgccctcgccgccaagtacacggtcgacgccgtcgccctggacggcggcggacaccgctcggcccggcacaccacgttcaccacccaggtccccgaggagcgcttcatcgcctacgtcgcccccgagaaccgctcggtcgtcggcaccggcatgatcgtctcgctggagttcaaccgggagatcaccgaccgcgccgccgtcgaacgcgccgtcacggtcaccgcggagcccgccgccgagatccgcccccactggttcggcaaggaccgcctcgacttccgcccgaagacgtactggaagcccggcaccgaggtcatcgtcgacctggacctgcgggacgtcgagggcgcgaagggggtctacgggctccagcacaagaaggtcgccttcaccgtcggccgcagccaggtctcccgcgtcgacgcggtcgagcggaccatgcaggtgcgccgggacggcaccctgctggccaccgtgccgatcaccgcgggcgctccgacgacgcccacctacaacggccggatggtgatcaccgagatgctcgaggtcacccgcatgaacagccgcacggtcggcttcggcggcgagtacgacatccccgacgtcccgcacgccatccggctgaccagctcgggcaccttcctgcacggcaactactgggcgcccgccgacaccttcggccgggccaacgtcagccacggctgcgtcgggctgcgcgacgacaagggcggcggttccgacaccccggcgggctggttcttcgaccgcagcctcatcggcgacgtcgtcgaggtggtccacagcaaggacaggacggtggcccccgacaacgggctgggtggctggaacatgaagtggaaggaatggaaggcgggcagcgcggtgaagtgacgcccggacgtcctgcggcactcctttggcacccggccgccaactcggtacggaacggtgacaattcacctgtccctcaaccccctggcctgcggttacgatgcgccggtgcgcgcgggcgcactggggcgcgggcccggccaggcccggcgaggggagaacaaggtgaacgtgcgtccgatagcgggggcggtactcgggctgctgatgctgaccgtcaccgcatgcggcgggggcggctcgggcccgggggccggggacggcaagggggacaaggccaaggacgccaccgcggcacagagcgagcagtccgaggccgtcgtcaccatcgcccccgagaacggggccaaggccgtcgacaccagcggcgccctgaggatcggagccgcgaagggcaggctcaccgaggtcgtcgtcaaggacggcaagggcacgaaggtcgacgggaagataaccggggacggcgccagttggacgccgtccacccacctggccgcctccaccacgtacagcgtgcacgcggtcgccaaggactccgagggccgcacggccgccgaggactcccgcttcaccaccctgacgccgaagaacaccttcgtcggcaccttcacaccggaggacggctcgaaggtcggcgtcggcatgccgttctcggtccgcttcacccggggcatcaccaacccggaggacgtcgagaaggccatcaccatcaagaccgagccggccgtcgaggtcgagggccactggttcggcaacgaccgcctcgacttccggccggagaagtactggaagtccggcaccaaggtcaccgtcgacctcaacctcgacggcgtcgagggccgcgacgacgtctacggcaagcaggccaagaccgtctccttcaccgtcggacgcagccaggtctccgtcgtggacgccaagaagcacacgatgcaggtcgtgcgggacggcaagaccgtcaagaccgtccccgtcaccaccggcgcgcccggctacgagacctggaacggccagatggtcatcaccgagcgcctcgcggtgacccgcatgaacggcgagaccgtcggctacggcggcgagtacgacatcaaggacgtgccgcacgccatgcgcctgtccacctccggcaccttcatccacggcaactactggggcggcgacgccttcggcaaccgcaactccagccacggctgcatcggcctgcgcgacgtacgcggcggctgggacaagggtgcgccggcccgctggttcttcgagaactcgatcatcggcgacgtggtcgtggtcaagaactccgaggacgccaccatcgcccccgacaacggcctcaacggctggaacatgtcctgggagaagtggaaggcgtgacggggggccactgccaccgcgcgtgaacgcccgctaacctgcggagcatgaccgtacatctcgaagtcgccgagggcgtcggcacgctgcgcctggaccgtccgcccatgaacgcactggacgtcgccacccaggaccggctgaaggagctggccgaggagatcacccggcgcgaggacgtgcgcgccgtggtgatccacggcggtgagaaggtgttcgcggcgggcgcggacatcaaggagatgcaggtgatggaccacgcggcgatgatcgcgcggtcttgcgccctgcaggactccttcaccgcggtggcccgcatccccaagccggtggtcgcggcggtgaccggctacgcgctgggcggcggctgcgaactcgccctgtgcgccgacttccgcatcgcgggggagaacgccaagctgggccagcccgagatcctgctcggcctgatccccggcgcgggcggcacccagcggctgtcccggctgatcggcccctccaaggccaaggacctgatcttcacgggccgtcaggtgaaggccgacgaggcgctggcgctcggcctggtggaccgggtggtcccggccgccgaggtgtacgagcaggcgcacgcctgggccgcgcggctcgccaagggccccgccatcgcactgcgcgcggcgaaggaggcgatcgacacgggtctggagacggacatcgagaccggcctcgccgtcgagcgcaactggttcgcgggcctgttcgccaccgaggaccgcgagcgcgggatgcgcagcttcgtggaagagggccccggcaaggccacgttcctctgacacccccgcaagaagtacaagtttcatccgaagtcgcgttgcagcacgtgcaattgacgcgatgtctgatccgggtccctcgttggggcggtttatggcagccttaacgcaccattaagcgcgtcttgtcgagggagtccgtcgcttgtctccggccgagccgttcgcgcaggtcaaaggggctgtttccggccccgaactgcctgtggcatatgccgatcgaccgtcgtccgaccgggctccggcggaggcgtattccccgggaacggccccggaggcccccgggggcggccatgatgggggcatggcggggctggatggtacggaacagccgcggggagccggacgtgcgaccgcggcgcgctggtcgccggcggtcgaggacgagcgcgcgctcaaggcgctggacctgttcggcaacccgacggagcacgaagttccgttaccctcccggcccgagtccgccgccaccgcccgccggctggcccaggtcgtcgccctgcgtcagtggcagctcggccccaaggtcacggaggacgccgtcctcctcgtctccgagctggtcggcaacgccgtacgccacaccggtgcccgggtcttcggcctgcgcatgcggcgccgccccggctggatccgggtcgaggtccgcgacccctcccgggggctgccctgtctgatgccggtgcaggagacggacatcagcgggcgtggcctcttcctcgtcgacaagctctccgaccggtggggcgtcgatctgctgccgcgcgggaagaccacgtggttcgagatgcgggtcctggaccgctgaggacccctcctcccatctgccgctgacatcaacccggttcgacggacacgccacctacgggtgagaatccggaatgcgtcgctccgcggccgggatcgtatccgcatgatcaccactagtctgcgccgccggaccgccgccgcggtcctgtcgctctccgccgtcctcgccaccaccgcggccaccgcccccggtgccgccccggcaccgtcggctgcccccgccaaggccgccccggcctgcccccagttcgacgaccggaccaaggccgccgccgaccgcggcgtcgacgtcgaccgcatcacgcccgagccggtctggcgcaccacctgcggcaccctctaccgcagcgacagccgcggcccgcaggtcgtcttcgaggagggcttccacgccaaggacgtccagaacggacagtacgacgtcgagaagtacgtcctggtcaaccagccctcgccgtacgtgtcgacgagctacgaccacgacctgtacaagacctggtacaagtccggctacaactactacgtcgacgcccccggcggcatcgacgtcaacaagaccatcggcgacacccacaagtgggccgaccaggtcgaggtcgccttcccgggcggcatccagcggaagtacatcatcggcgtctgtccggtcgaccggcagaccaagaccgagatcatgagcgactgcgagagcaacccgcactaccagccctggcactgacaccggccgtcctggctcaggggcgcaggaacagcgcctccgagcccaccggccggtaacccgccgcctggaacgcccgcagactgcgggcgttccccgccgaaacctgcgcccagaccacctcacccccggccagctgccgcgccgccgtcaccagccgccgccccagcccccggtgccgggcgccctccgccacctccacggcgacctccagccgcccgccgaccccgcggcccagcaccagcaccccgccgtccgccgcccacacccgcaccccgtcgcgccgccgccgggccgcgaccacccggggatgcccaggatcggcgacctcctccagcgccccctccgggcgtccgggcagcggcgccccggtcagcagcacgtcgatcgtgtccgtcgcccggcccgtgcgctcggcgaaggccgccaggaaccgggcgttcatcgtcgcggcgaggggatcgcagcccagcgacgcaagcgtcctgcgtacccatccctcgtcctcgtcggtgaagaccaccgagtgcgccgtgaaggcgatgacccccgcgtcccggccgccgaactgcggcacgacgctcgtgccgccgtccgccgcggggaacaccccccgcgccgccgcgtccagaatctcccgcaggctctccgccacaccgcgctccttgagtctccacccactggaaggcccacactcccagacatgaccgacgacggcaccggcctcatgaccatcggcgaactggcccgcaccaccggcctcacggtgcgcaccatccgctactggtccgacgagggcgccctgcccccgcacgcccgctccgcgggcggctaccggctctacgacgccgcgtccgtcgcccgcctggagctgatccgcaccctgcgcgaactgggcctcggcctggacgccgtacgccgtgtgctggccggcgagaccaccgtcgcccaggtcgcggcggcgcacgtgagcgcgctggacgcgcagatcgccgcgctgagggtgacccgggcggtgctgtcgaccgtggcgcgacgcggttcgaccgccgaggagacgacgctgatgaacaagctggcacgactgtccaccaccgaacgccgccggatcatcgaggacttcatggccgaggtcttcgccggcatcgacaccgcggaccccgacatccgcacccgcctgcgcttcgccgcggccgacctgcccgacgaccccacggcggagcaggtggacgcctgggtggaactggccgagctgatccaggacccggagttccgggtcacgatgcgccggatgatcgagttcaacgcggcggaccggggtccggacgtccccgcgggctcctccctctggttcatgagccgcctggtgcggctcgcgggcgacgcggtgcgcgagggcgtcgcaccggactcgccccgggccgccggcatcgtgcgcacgctgatcggcgacgccgacccggccgtcgtgctggaacgcctcaccgcggtggccaacgtccggctcgcccgctaccgggaactgtcggcgatcgtgaacggcctggagccaccctccgcgcacgaggaccagttcaggtgggtggtcgccgcactgagcgctcggaaggccggttaatctgacctgcgtcagatggacccaatgcacggaacgaggggcggaccggtggccgacatcgaggaagcacgcaagcagttcgagcggatcgacacggacggtgacggcctcatcaccgcggccgagttcaagaccgcgctcgcccagggcggcgactggaacgtcaccgagtcggtggccgaggcgatcatcgccggccgcgacctcgacggcgacaagcagctgtcgttcgacgagttctgggcccacctgaacaagtgacggcacggtgcggggcgcccggcggtcacccggcgggcgccccttcgccgtccgggcacgttgctgcggaggagtgaaagccggacggcggcggaatagcccgcccggcccggaggttgctgctgctcaacggcaggacacgacctccgaaaggccaggcgagtcagcatcatgaagatcggcatcatcggcgcgggcaacatcggcggcaacctcacccggcggctcaccgcactcggacacgacgtctccgtcgccaactcgcgcgggccgcacacgctcggcgcactggccgaggagaccggcgccaccccggtagcggtggaggaggcggcgcggggcgccgagatcgtggtcgtcaccgtcccgctgaagcgggtcccggacctgccgtccggcgtcctggacggcgcggccgagggcgtcgcggtcatcgacaccggcaactactacccgcagcagcgtgacggcaggatcgcgggcatcgaggacgagggcctcaccgagagccgctggaccgaacgccacctcggccacccggtgatcaaggccttcaacggcacctacgcccaggacatcctcgaccgcccccgtccggccggcgcgcccgaccgcatggcgctcccggtggccggcgacgacgaggcggccaaggcgaaggtccgcgccctgatcgacgagctgggcttcgacaccgtcgacgccggcggcatcgacgactcctggcgccagcagccggacaccccggtctacggcctgcgcgagggcgtcgacggcgtcgtcaaggcgctggcggaggcgccccgggagcggcccgcggccttccggggctgaccccgccctcaggcgctctgggcccactccttcagtgcggccttgctcgcgaagtccgccacgttggtgtcgaccgggtcgtcggtgtactggtggaagcgccacttggcctggatgcgcggcttgcccgccgagacgtagtcggcgatccagagcccgtcaccggcgtacgaggtggtgtcgacgttcaaccagaagttccggttgcagtagaggacgacccggttgtccggccgcagcgtcttcagccgccggatgaagctgtccttctccgcgttgctcggatgggtgccctcgccgttcgtctcccagtcgacggcgaggacgtcgcccttgcggtccggggccttggagacgaagtactcggcctgggcggtgagattgcccggccacaggaagtggtagaagccgacgacgagtccggcgtcgcgggcccgctccgtctgggccgcgagtttggggttgacgtacgaacggccctccgtcgccttcacgaagacgaaggagaggccgtccgtgtcgtagttggcggactggtacgcgctgacgtcgatgccacgcagcatggggcctccctgaggggctgtggggggacgggagttggttattccccacgatggcacgggtgatccccgtcggaagcggaaacgtcgacttcgcttcgccggggcgccattgacgcgcgtagcgcggtgccgcacgctgggctccggttcgaaggacgactcgacggtcgggaggccgggatgttcagacgtgtgtcacgtctccttctctcatttgtcatgctcatggccggagcggtggtcggggtgggcgccaccgccggcgccgcgcacgccgactcctgctacacctggaaccgcaccctctcgcagggagcctccggcagcgacgtgacgcagctccagatccgcgtcgccggctgggtcacctccggcgaacggctctcctacgacggccagtacggtgccaggaccgccgccgccgtcaagaagttccaggcggcctacgggctgggcgcggacggcgtcgccggccccgcgaccttcagcaagatctacgcgctccaggacgcggactgcacgcccgtccacttcacctacgccgagctcaacaagtgcaactcggactggtcgggcggcgcggtctccgccgccaccgccaagtcgaacgcgctgaagaccatgtggaagctggaggccatgcggcacgccctcggcgacgtgccgatcaccatctccagcggcttccgctcccgcgcctgcaacagcgcggtgggcggctcgtccaccagccgccacctctacggcgacgccgccgacctcaccggctcgcccagcttctgccggctcgcccagcaggccaggacccacggcttctcggagatcctcggcccgggctaccccggccacaacgaccacacccacgtggccttcgacccgtcgccgtactggtcggcacccaactgcggcatctgagccgccggagccagtccggcgcggaccccgtgcgggccccgtgcggcccctggatcaggacacggacgacgtcgccgcggccgtccgggggtcctcgccggcgggcgcggacccgtgctcctccagggagacgtccttggtctccttggagagcaggagggcggccagcgtcagcacggccatcgccgagaggtacacgccgaccagccacggcgacccgtcaccggcctcccacagcgccaccgctatgaagggggcgacggccgcgccgaggatcgagctgacgttgtacgagatgcccgacccggtgtagcgcacactcgtcgggaacagctccggcagcagggcgcccatcgggccgaaggtcatgcccatcagcgtgaagccgagcaccagccagagcaccacgccgagcgtgcccatgtcgatcagcggcacccagagcagcccgaagaccacgatggcgacggtgatccagaccagggtggcgcggcgtccgtaccggtcggcgagcgggccggagaccagggtgaacacggcgaagaacagcacgccgaagatcatcatcaggacgaacgtggtgtagctgtaccccagtcccggcacgtcggcgtccttggcggcgcgcccgtagctcagcgagaacgtggtcatgaggtagaagagcacgtacgtcgccagcatgatgaacgtgcccaggaccagctgcttccagtggccctggaccacggtggccagcggaagcttccgcaccttcccggcctcgcgggtccgggtgaacaccgtcgactcgacgagccgtgagcgcacccacaggccgatcgcgaccatcacggcggagaacaggaacgggatgcgccagccccagttcgcgaaggcctcggacggctgcgtggggtcggcaccgctctcggagggcagcagcgccccgatgatcaggaacaggccgttgccgatgatgaagccgagcggcgcgccgagttgggggaaggtcccccacagggcccgcttgccgcggggcgcgttctcggtcgcgaccagcgcggccccgctccactcgccgccgagcgcgaagccctgggcgagccgcatcagcacgagcagcgcggtggcgacccagccggcctgcgcgtaggtgggcagcgcgccgatgaggaaggtggcgatgcccatggtgagcagcgagacgaccagcgtcttcttgcggccgagccggtcaccgaggtgcccgaagaagacggcgccgatcggccgggcgaccatcgcggcgccgaagaccgcgaacgacgacagcagcgccgtggtggggtcgctgctcgggaagaagagcttcgggaagacgaggacggcggcggtcgcgtagatgtagaagtcgtagaactcgatcgtcgtccccatgaggctggcgacgaggacccgcgaccggggattgaccggcgtctgcggtgcggggacggaagctggtgcgggcatggccagatctttcacgtgcgaaacatgtactccgcaacgatctcagccgtcttgcttttcggaaagcgggtgtcacgatgtgagacactcgcctcctctccgacccggggcgccgctcaacactcgatgatgttgaccgccagcccgccccgcgccgtctccttgtacttgaccgacatgtcggcgccggtctccttcatggtcttgatgaccttgtcgagggagaccttgtgcgagccgtcgccgcgcatcgccatccgggccgcggtgaccgccttgaccgcggccatgccgttgcgctcgatgcaggggatctggaccagaccgccgacggggtcgcaggtgaggccgaggttgtgctccatgccgatctcggcggcgttctccacctgctccggggagccgccgagcacctcggcgagggcgccggccgccatcgagcaggcggagccgacctcgccctggcagccgacctcggcgccggagatggaggcgttctccttgaagagcatgccgatggcgccggcggcgaggaggaagcggaccacgccgtcctcgtcggcgccgggtacgaagttcatgtagtagtgcaggaccgcggggatgatgccggccgcgccgttggtcggggcggtgacgacccggccgccggccgcgttctcctcgttcacggccatcgcgtagagcgtgatccactccatggccagggcctgcgggtcgccctcggagcgcagcttgcgcgcggtgttcgcggcgcggcggcggaccttcaggccgcccggcaggatgccctcgcgggtcatgccgcggtccacacacgcccgcatcacgcgccagatctccagcaggccctcgcggatctcgtcctcgtcgcgccaggcccgctcgttctccagcatcagcgcggagatggacaggcccgtctcgcgggccaggcgcagcagctcgtcgccggtgcggaaggggtacttcaggacggtgtcgtccagaactatgcggtcggcgccgaccgcgtcctcgtcgacgacgaagccgccgccgaccgagtagtaggtcttggtcagcacctcggcgccctcggcgtcgtacgcccacagcgtcatgccgttggcgtggtagggaagggccttgcggcggtgcaggaccatgtcgtcgtcgtaggcgaaggcgatctcgtgatcgccgaggaggctgatccggccggaggatttgatcgtctcgacgcggtcgtcggcgctctccacgtccaccgtgcgcggtgagtcgccctccaggccgagcagcaccgccttgggggtgccgtggccgtggccggtggcgccgagcgagccgtacagctcgacgcggaccgaggcgacggagtccagcagctcctcgttgcgcaggcggcgggcgaacatgcgggccgcgcgcatcgggccgaccgtgtgcgagctcgacgggccgatgccgatcgagaacaggtcgaagaccgagatggccacggggactcctcagaacgggggtggtgcagagggtggggcactccgggtggggcgacgggccgcttgtggcggacgcggcgccccacccggaggtgtggtgtctacttgttcagacccgggtacagcgggtgcttgtcggccagggtcttcacccgggccttgagggcctccgcgtcgtaggacggcttcagcgcctcggcgatcacgtccgcgacctcggcgaagtcctcggcggtgaagccgcgggtcgccagggccggcgtaccgatgcgcagaccggaggtcaccatcggcgggcgcgggtcgttcgggacggcgttgcggttgaccgtgatgccgacctcgtggaggcggtcctcggcctgctgtccgtccagctcggagtcgcgcaggtccaccaggaccaggtggacgtccgtgccgccggtcaggacggagacgcccgcggccttcgcgtcgtcccgcaccaggcgctcggccaggatgcgggcaccctccagcgtacggccctggcgctccttgaagtcctcgctcgcggcgaccttgaaggcgacggccttggcggccaccacgtgctccagcgggccaccctgctgaccggggaagacggcggagttgatcttcttggccagctcggccgtggagaggatcacaccgccgcgcggaccgcccagcgtcttgtgggtggtcgtggtgacgacgtgggcgtgcgggaccgggttcgggtgcaggcccgccgcgaccagaccggcgaagtgcgccatgtcgaccatcaggtacgcgccgacctcgtccgcgaccttgcggaacgcggcgaagtccagctgacgcgggtaggccgaccagcccgccacgatcagcttcggcttggtctccttggccaggcgctccacctcggccatgtcgacctggccgtcgtcgccgacgtggtaggggaccacgttgtagagcttgccggagaagttgatcttcatgccgtgggtcaggtgcccgccgtgcgcgaggttcagacccatgatcgtgtcgccgggcttgagcagcgcgaacatcgcggccgcgttggcctgggcgcccgagtgcggctgcacgttggcgtgctcggcgccgaagagcgccttgacccggtcgatggcgatctgctcgaccacgtcgacgtgctcgcagccgccgtagtagcggcggccggggtagccctcggcgtacttgttggtgaggaccgagccctgggcctccatgaccgcgaccggggcgaagttctccgacgcgatcatctcgagggtggactgctggcggtccagctcggcgtcgacggcggcggcgacgtccgggtccagctcgtgcaggggtgtgttcagaagcgacatgcgatcgtgactcctcaggcgccggcgaaggcggtgtactcgtcggcggagagcaggtcggccggctcgtccgtgatccgcaccttgaacagccagccgccctcgaagggggcgctgttcaccagcgacgggtcgttgacgacgtcctcgttgacctcggtgatctcaccggagacgggggagtacaggtcggagacggacttggtcgactccagttcgccgcaggtctcgcccgcggtcaccgagtcgccgacctcggggagctggacgaagacgacgtcaccgagcgcgttggccgcgtgctccgtgatgccgaccgtcgagacgccgtcctcggcgcccgacagccactcgtgctccttgctgtagcgcagctgctgggggttgctcatggcctgaattctcctgtacgcgaggaagtggctggtgaagggggtgacgagggagggatgagtgactcgcgtgacccgggggctgccgcggaggggcggcgccccgtgtccactgtctgcttctgtctacttctggcgcttgtagaacggcagcgccacgacctcgtacggctcgtggctgccccggatgtccacgcccacgccctcggtgcccggggccgcgtgtgcggggtcgacgtacgccatggcgatcggcctgcccagcgtcggggacggagcgccggaggtgacctcgccgatcacctcgccgcccgcgacgacccggtacccggagcgcgggacccggcggccctcggcgaccaggccgaccaggacgcggggcggccgggaagcggcgcgctcggcggcctcggtcagcgcggcgcgcccgacgaagtcgccctccttctcgaacttcaccacccggcccagaccggcgtcgaacggcgtcagcgcggtcgacagctcgttgccgtacagcggcatgcccgcctccaggcggagcgtgtcccggcaggacagaccgcacgggatcagccccgcggcctcgcccgccccggtcagtgcctgccacagcccgacggcgtgctccggcttcacgaacagctcgaagccgtcctcgccggtgtagccggtgcgcgcgatcagcgccgggacgccggcgaccgttccgggcagaccggcgtagtacttcaggccgtccagatcggcgtcggtgagcgacgcgaggatgcccggggactcggggccctgcacggcgagcagcgcgtaggcgtcccggtcgtcgcgcacctcggcgtcgaacccggccgcccgctcggtcagcgcgtccaggacgacctgggcgttggaggcgttggcgacgaccatgtactcggcctcttcgagccgatagacgatcaggtcgtccaggatgccgccgtcctcgcggcagatcatggtgtagcgcgcccggcccggcttcacggtgccgatgttgccgaccagcgcgaagttcagcagctcggccgcctgcgggccggtgacggtgatctcacccatgtgcgacaggtcgaagagaccggcgcgggtgcgcaccgcgacgtgctcctcgcgctcggagccgtagcgcagcggcatgtcccagccggcgaagtcggtcatcgtcgcgcccagcgcgcgatgcgtggcatcgagcgcggtacggcgcagttcggtactgctcatcggtcggtcgtctcccaggacaggacggggcgaggtcggtcctccccatctgtcatcggaacctgagaggttcgccacggccaccggagtacggcgatcagggcttgcaccttgggtgggaccgccgtcgggggcggtccgcttttcagatgtgcctcgcccgcgcggtaacggtgcctgagagattcaagggagggacttgctccttcggcgccccggcgcggccggggactctcccgcgcggattcaaacggccggtatgcagttggcgccgccatcattgcacgcccgggcgatccgtggcagaccgtgatctgtaaccggcttgtggcagtaagcgaacgaaaacgcgagacccgcgcattaccttctctttacactcgacggggaggtactcgtgtaccgccccaggggaggacgatcacggtgaacaggaccacggcgtacgccacgacctcgggactcgcgctgcccaagcagccggccgccccggcacccgaggcatgcgccccactgaccgcacccgtcgtccgcgacctgagggaccgcgacggccgcagcccgcacgccctgctcttcggaccccgggacctggtggtgatcaccggcctgcccggcagcggcaagtccacgctgatgcggcgcaccgtgcgcggcggccgcatcgactcccaggacacccgcgaccgctgggaccgccgcgtgccgcgcctcctgccgtacacgctctaccgccccttcgtccgcctcgcccactacgccggactgcgccgcgcgctgcgctccggcgagggtgtcgtcgtgcacgactgcggcacccaggcctgggtgcgcggctggctggcccgcgaggcccgccgccggcacggcaccctgcacctgctgctcctcgacgtcgctccaggcgaggccctggccggccagcgcgagcgcggccggggcgtctcgcggtacgcgttcctgcggcaccgcgcggccaactcccgcctgctgcgcgcggtgaccgaaggcaccctgcccgcgggctgctcctcggcggtcgtcctcgaccgggcggcggccgacaccctgcggcggatcgccttcacggggtgacgcacggtagggctccggggccgaacgggttagcctttcagccacgaacggcggtaccaggcaggcggtaggtaggcagatggacttcccggcacagacgcacccccacccgcacggcgggtggcccggcaacgagctggaggaggtgctgtccgcctccctcggcatcccgtcggccggtggccggatcgtggaggtcctcggccgcagcttcctgtgggtccccctgccgaacggcggcggcccgcacagcggccccctcgacctgccctcgctggagatcgacggccaggcctacgtgccggtgttcagctcggaggagcagctccgccaggtcgcgggcgcgcacatggcgtacaccatcgcccccgccgcggagttcgcccgcggcctgccaccgcaggtcggcatcgcggtgaacccggagggcgtggtcggcatcccgctgccgccgcccgccgtggccgagttgtgccgggccgggcgcaccccgctggacggcccctcctccggcggccgggtccgtctcttcgagccggactggcaggacgatccggtggacttcctggccgcggcctccgccgagttcgccgccaccggcgtcgtacgcagcgcgcgccgctgcctggccgccgtcgagaccgccgacccggtcctgttcgtcggcgtcgaactgacccactgggagggcgacgcccgcaccctgcccctggacgccctcggccgggccctcgccaagtcccccctgaagtaccaggtcaacctggtcctcctggaagcagcccaggacccggtctgcgactggatgcgggagagggtcaggcccttctacgaccgggacttgtagacgcgggcccgggcgagcgccccttcgggggcgcggggctgtgacatgtgcggctccgccgcgtgggcgcgacaagccacgacgtacccgcagccgcacgacgacagcacaccccgagctcataggccccccgcacccggcggagccttaagctggtccccacaccgggggaacttctcgaaggggcgatacgcgtgagcgccagcggcaccacgaccggacaggtcgagcacatgctgcgccaggtgacgcccgggcgctacgacgcctacgaggccctgctgcgcgccctcgccacccccacttccggccaggtctggatgctgctgtggcacggccaggccggctccccggacgcccagtacgggaacatggaggtcgagggctacggctacgcgccctgtgtgacctccgcccaggagctctcggccagcggctggaaccggtcgtacgaagtggtcgacggcctggaggcggcccgcgccctgtacccggaccactacggcctgtggctcaatccgcacgcccccggcggcggcgtcggcatcccctggctcgacctgcgccgcatcgcctccggcctggaccgccagcccgccgggcccctgcggctgtccgaaccggccatcgagatcccccagttctacgccctgctcgcacagaacgcccaccgcaccccggcggtccgcgcgctgcgccgcgcctgggtgcagccggcgctcggagcgccgtacctcgccatcggcctggacgtgtacgacacctccccgccggccgtcgacgcggtgcgcgcgatgatgcagcagtccgtcggcgcggtgccggacgggctgccggtgtcgacggtggcgatgaccgacgcccacgacccggtcgccctgtggctgcgcgccaacgcgcgcccgttctacgaccgcgaggcccacgcgccggcccccgcccaggcgccggcgggcgggtacggataccctccggccggtagccggtactgacggcggcggggtccttctccctgtcggaagaggcgatcttcgcgcgtagatgaggacgcaaagcgccaccttgtccctgatgtcccaactcgcccgcgtccggcccccgttacccactgtccggataacggaacacctcaaacagcatcacggttgcgcatccattccccgtcaagtctggctacagatcgccaaagcgttgaagactcccgcaacaaggggtggatgctcgcctctttgtacgacggactgatcacgccgctacagcggcaagtgcgggccggctaccgccggttgagaggggtccctgccagatgacggcaccattgcacgagccgaccgcggaagcggccccgagtgcggcagaggaagcggcggtcgccggcgccgaggccaagtcggtacaagggcgttccctgggccggatcgcctgggagcgcctgaagcgggacaagctggccctcgcgggcggcatcgtcgtgctggtcctcatcgtggtcgccgtgttcgcgcccttgatcacctcgctctacgggcaggaccccaacgcgtacaacgaggacatgatcgacccgctgttcggtacccccacgggttccctgggcggcctcggcggcgagcactggctcggcgtggagccggtcaacggccgcgacatcttcgcccgtatcgtccacggcgcccggatctcgctgctggtcggcttcctgtccgcgatggtcgccgtggtcctcggcaccgtcctcggggtcctcgcgggcttcttcggcggctgggtcgactccctcatctgccgcatcatggacggcctgctggccttcccgcagctgctcttcatcatcgccctggtctccgtcatgccggacaacatgctcggactgagcggcacgggcgtgcgcctgctcatgatgatcgtggtcatcggcttcttcggctggccctacatcggtcgcgtggtccgcggtcagacactctcgatgcgtgaacgggagtacgtcgaggcggcccggtcgctgggggccggacggttctacatcctgttcaaggaactgctgcccaacctggtggcgccgatcatcgtgtacacgacgatgatgatccccaccaacatcctcaccgaggcggcgctcagcttcctgggtgtgggcgtcaagccgcccacgtcgtcgtgggggcagatgctctcgagcgcgatcgactactacaagtcggaccccatgtacatggtggtccccggtgtggcgatcttcatcaccgttcttgccttcaacctcttcggtgacggcgtgcgcgacgcgctggacccgaaggggtcccgctgaccctgccgtaccgcaaagcgacccgtggcacctgcacggggtctctcatctaatccggaggatccgagatcgtgactacccaacgcacctcagggcggcgcaagcaggctttggccgctgccgcagtggtcgccgcgctgctgaccacggcggcgtgcggcggaggcggcgacgacgacagcggcggcggttcgaagaacggcgcggccggctacgacgcggccaacaacaaggtcgcccaggcctccgaggccaagaagggcggcacgctgaagttcgccagcacgcaggacgccgactcgtgggacaccacgcgcggctactacggcttcatgtgggacttctcccgctactacagccgccagctggtcacgaacaagaccgagccgggtgccgccggcgccgagaccacccccgacctcgccaccgacgtcgccaaggtctcggaggacggcaagacctacacgtacaccctgcgtgacggcgtcacctgggaggacggcaagccgatcacctccaaggacgtcaagtacggcatcgagcgcgtctgggcgcaggacgtgctgtccggcggcccgacgtacctcaaggaggtgctcgaccccaagggtgagtaccagggcccgtacaaggacacgtccaaggacaagctcggtctgaaggcgatcgagacgccggacgacaagaccatcgtcttccacctgccgcaggccaactcggacttcgaggagatgctcgcgctgacctcggcgtccccggtccgccaggacaaggacaccaagtccaagtacggcctgcacccgttctcctcgggtccgtacaagttcgagtcctacaaccccggcaaggacctgaccctggtccgcaacaccgagtggaagcaggcgtcggacccggtccgcaaggcgtacccggacaagatcacgatcaagttcttcaccaacgccaacgacatggacgcccgcctcatcgccggcgactacgacatcgacctggcgcagaccggtctgtccccgcagggccgcaccaccgccctgaaggagcacaaggccaacctggacaacccggtctcgggttacatccgctacgcggccttcccgcagaacgtgaagccgttcgacaacatccactgccgcaaggccgtgctctacggggccgaccacgtctccctgcagaccgcgcgcggcggcccggtcgccggcggtgacatcggcaccaacatgctgccgcccgccgtcccgggctccgagggtcagaagtacgacccgtacgagatgtccggtgccaacaagaagggcaacgtcgagaaggccaaggaagagctgaaggcctgcaaccagccgaacggcttcaagaccaccatcgcggtccgcaacaacaagccggtcgaggtcgccaccgccgagtccctccaggcctcgctgaagaaggtcggcatcgacgtcgagatcgaccagtacgacggctcgcagtacgccagcgtcatcggcagcccctcgaacgtgcagaagaagggctacggcatcatcatcatgggctggggcccggacttcccgtccgtgcagggctacggtctgccgctgtggcacagcgactacatcctcgacagcgcgaacaacaacttcgcgatgatcgacgacccgaagatcgacggtctcttcgccgactacctgacggccaaggacgacgcgggcaagaagcagatcgccacggagatcaaccacaaggtgatggagggcgcgtactacctgcccttcgtcttcgagaagttcatcaactggcgctccagcaacatcgcgaacgtgtacaccaccgacgcctacagcggtatgtacgacttcgtgaacatcggtctgaagaaccccaagaagtaaccggtacacccgccgtacggcacgaaaggcaggtgaaggccggcgcggcgtgaccgcgggccgccggacaacctccggcggcccgcgggacgcagcgggccgcaacccgtgctcgcttacctcatcaggcggctgttcgccgccgcagtgatgctcgtggtcatcatcctggtggtcttctgcatcttcttcctcgtccccaagtgggccggggtcgacatcgccctgaacttcgtcggcaagcaggcggaccccgccgccgtcgagggtgtgcgggagaagctgggtctgggcgacccggtcttcgtccaggcctgggagttcttcaagggcatcttcgcgggtcgcacctacgcggccggcggcgacgtgacccactgcgccgcgccctgcttcggctactccttcaagaccgagcagtcggtctggccggtgctgaccgagcgtttcccggtgaccctggctctcgcgctcggtgccgccgtgctgtggctgatcttcggcgtggccgccggtgtgctctccgccctcaagcgcggcacgctgtgggaccgcggcgccatggtcgtcgccctggcgggtgtctccctccccatctacttcaccggtctgctgagcctggcgatcttctcctacggcctcggctggatcgacggcgagttcgtaccgctcgaggacagcctcaccggatggctcggcggcatgatcctgccctggatcaccctggccttcctgtacgccgcgatgtacgcccggatcacccgcgccaccatgctggagatcctcggcgaggactacatccgcaccgcgcgggccaagggactcaaggaacaggtcgtcatcagcaagcacgcgatgcgatcgaccctgacccccctgctcaccatgctcggcatggacctcggcgccctgatgggcggcgcgatcctgaccgagaccacgttcagcctccccggcctcggccagaaggtgctggacgcgatcaagaaccacgacctgcccttcatcctgggcgtcgtcctgatcacttctctcgcggtgctgatcgccaacctcgtggtggacatcctgtacgccgtgatcgacccccgagtgaggctcgcatgaccgaactgagcaagagcggggcagcggtgggcgagcccaccggcagctcgcccgcgccgaccgccttcctggaagtacgcgacctcaaggtccacttcccgaccgacgacggcctggtcaagtccgtggacgggctctccttccagctggagaagggcaagaccctcggcatcgtgggcgagtccggctccggcaagtcggtgacctcgctcggcatcatgggcctgcacaccgccggccagtacggcaagcgcaaggcgcggatatcgggcgagatctggctggacggcaccgagctgctgtccgccgaccccgaccacgtgcgcaagctgcgcggccgcgagatggcgatgatcttccaggacccgctgtccgcgctgcacccgtactacacgatcggccagcagatcgtggaggcgtaccgcatccaccacaaggtggacaagaagaccgccaagcggcgcgcggtcgagatgctcgaccgggtcggcatcccgcagccggacaagcgggtggacagctatccgcacgagttctccggcggtatgcgccagcgcgcgatgatcgcgatgtcgctggtgaacaaccccgagctgctcatcgcggacgagccgaccaccgccctggacgtcaccgtccaggcgcagatcctcgacctcatccgggacctgcagaaggagttcggctccgcggtcatcgtcatcacccacgacctgggcgtcgtcgccgagctggccgacgacctcctggtgatgtacggcggccggtgcgtggagcgcggtccggccgagaaggtgttctacgagccccggcacccctacacctggggtctgctcggctcgatgccgcggctcgaccgcgaccagcaggaacgcctcatcccggtcaagggctcgccgccctccctcatcaacctcccgtccggctgcgccttcaacccgcgctgcccgtacgccgacgtgcccaaggacgacgtcacccgcacggtccgccccgagctgaccgaggtcggcagcaagcactgggccgcctgccacatgtcgcaggagcagcgggagcgtatctggaccgaagagattgcgccgaagctgtgagcgacgaagccaaggacgaagcggtggccatccccgcgcagagcgacggcaccgagagcacgtccgccggggccgccaccctcaccaagggtgcggcccccggcgagaccctgctcaaggtgaccgggttgcagaagcacttccccatcaggaagggcctgctgcagcgccaggtcggcgccgtccgcgccgtcgacggcatcgacttcgaggtccgctcgggtgagaccctcggcgtcgtgggtgagtccggctgcggcaagtcgaccatgggccggctgatcacccggctcctcgaaccgacggccggcaaggtcgagttccagggcaaggacatcacccacctcggggtcggcggcatgcgtccgctgcgccgcgacgtgcagatgatcttccaggacccgtactcctcgctgaacccgcgccacaccatcggcacgatcgtcagcgcccccttcaagctccagggcgtccagcccgagggcggggtcaagaaggaggtccagcggctgctgtcggtggtcgggctcaaccccgagcactacaaccgctacccgcacgagttctccggcggacagcgccagcgcatcggcatcgcccgcgcgctcgcgctcaacccgaggctggtcgtggccgacgagccggtctccgcgctcgacgtgtcgatccaggcccaggtcgtcaacctgctcgacgacctccagcaggagctgggcctgacgtacgtgatcatcgcgcacgacctctcggtggtccggcacgtctcggaccgcatcgcggtgatgtacctcggcaagatcatggagctggccgaccgcgacctgctctacaagacgccgatgcacccgtacaccaaggcgctgatgtcggcggtgccgatcccggacccggcgcggcgcggcgcgaagagcgagcgcatcctgctcaagggcgacgtgccctcgccgatcgccccgcccagcggctgccgcttccacacccggtgctggaaggcgacgcaggtctgcacgaccaccgagccgccgctcaaggagctgcggccgggccagcaggtggcctgccaccacccggagaacttcgaggaccaggctccgcaggacgtcgtcctgctcaccgccgcgaaggaggcggcggagctggtgtcggaggacgcgctggccgagtcggcggcgacctcggcggcggtggccgcggaggtcgaggcttcggaggccgaggcctcggaggagaccgcgtcgagcgatgcggcctcggacggtgccgcgtcggaggaagccgcgtcgagcgatgcggcctcggacgactccgcgtcggacggtgccgcgccgaaggaagccgcgtcgagcgatgccgcctcggacgatgccgggtcgagcgactccgtgtcggacgatgccgccccggacgattccgcgtcggacggcgacgagcccgccgccgagagtgccgggagcaccgacgaggagcctcccgccaaggagaagtgacctcgttcactaggcccgcccggagctcccgcctttgtttgtaaggcgggggctctttggcaggtaagaatggaagggtgtacgagcaactcttcagccccaccgtccagcacacgctcgacctggtcggcatcttcgtgttcgccatctccggcgcgctgctggccgtacgcaagaacttcgacgtcttcggcatcgccgtcctcgccgaggtcaccgcgctcggcggcgggctgttccgggacctggtgatcggcgcggtgccgcccgccgccttcaccgacctcgggtacttcctcacaccgctgctggcgacgctgctggtcttcttcctccacccccacgtggagcgcctccagaccggcgtgaacatcttcgacgcggccgggctcggcctgttctgcgtcgccggcaccaccaaggcgtacgactacggcctcggtctgaccgcctccgcctgtctgggcctgaccaccgcggtcggtggcggcgtcctgcgcgacgtgctcgccaacgaggtgccctcactgctgcgctgggaccgcgacctgtacgccgtcccggcgatcgtcggctccgcgatggtcgccctgtgcatccgctacgaggcgctcaccccgttcaccagcgggctcgcggtcgtcacggccttcgtcctgcggctgctcgccctgcgcttccactggcgggcgccgcgcgcctggaaccgccggtcgacggtggtggagggggactgaccgccggctccgctcacgggtgcggcatgtccccgacgaagacgaggccgtcgaccgggtccggatggccgggatcgagcggggcgcaaccgaaccaggccgtccgtcctcgaccgggtgcggtcggccgggggagtggagccgctggaggccgccctgcgcgagtggcacgaccgcgtctccgcccgcggccgggcgatggcgaccggttcggcgcgcctggagagctgtccgcgcgcgagggaggagcgagagagaaagctaccgcttagtagtttcctgttgtaccgtgcagtcatgccagaagcagcctccgcagcggccgtacgggtcaccatcggcgacagcgagttcgaccgcgacaccgccgtcacccgacgcgcccccggcgtctacgacatcgacctgtcggccggctggacgatcatcagcgccgtcaacggcggctatctgctggccgtcctgggccgggccctcggcgacgcgctcccgcaccccgaccccttcaccatctcggcgcactacctcaccgcctcccggccgggcccggccgtggtgcgcaccgagaccgtccgcacggggcgctccctctccaccggccaggcctccctcctccagtacgacgacgagggcaacgaggtcgagcgcatccgcgtcctcgcctcctacggcgacctcgacgcgctgcccgacgacgtccgcacctcggcgaagccgcccgcgatgccgccgatggaccagtgcttcggcccggaggacggccccgccccggtcgagggcagctcggccatcgccgaccggctgatgctcaagctggaccccgccaccctgggctgggcgctcgggcagccctcgggccgcggggagatgcgggcctggttcggcctcgccgacggccgcgacgccgacccgctctcgctgctcctcgcggtggacgcgctgccgccgaccgccttcgagctggggctcaagggctgggtgccgacggtcgagctgaccgcgcacgtgcggtgccgccccgcaccgggcccgctgcgggtctccatcaccacccgcaacctcgccggcggcttcctggaggaggacgccgaggtctgggacagcaccgaccgcctggtcgcccagtcccgccagctggcccgggtccggctcggctgacccggcggctcctcgggccggccggtactcagtccagccagtgcgtgcggccgacgctgatcagccgcagttgccgccgtgccgtctcgacggcccggcggcgctcctcttccggggcgtccagagtctccaggaagagggaggccgtgatcagcatctggtcgacgtagaggcccgccagcatgcgcaggtcggtctcgctccagcccgccgccgacgcgtccgtggccagctcggcccgcacctcctcggcgaaccgcgccaactgctcgcgtatcgcccggcgcaccggctgcacgccgccgtgccgctcccgcgcgatgaaacggacgtgggccgggtgtgcggccacatgaccggcgatcaactcgaccgcgcgggcgatgcgttcgtcgtcgtcctcggccggtgacatggtggtccggatcatcgggtgcaggctgcccagcgcctcctcgaccagcgccacgccgagatccgccgtggagtggaagtgccggtagaaggcggtcggggcgacccccacggcacgggtgacctcgcgcagccccaggctgctcagactctgctcctccagcaggccgagcgccgcgtccaggagcgcctgccgggtcttccgcttctgcgcctgccggacaccgggggtgtgactcatgccatgcagttaacaactgttctccggaattgaaaagccgtgcggcgcgctagactgaaaagtcagtgaacaactgtaaccacaaccgttcaccgaagcgtccacgcaaggttgggggacccgttccatgctgtttctcgtagtcgcacttctgctcctcggagtggtcctgggcgccgtcgcccacgcaccgctgaccttctccgtcgcggccggcctggtcatcgccgtctggctcggcatcttcgcggtccgcgagcggcacggccgccggcggggcacctccgcccactgacacacctccaccgacacccggcagggagaacaccatgcagctcaccgcaccggccgaccgcaccaccgagagcccccgcaccacccgtcgtaccggcatccacgacaccgacggcatggccgtcgcctccttcgtcctcggactcctcggactgctggtcctcaacgtcttcctcggcccggtcgccatcgccctggccggcatcgccctgtggcgcggcaccgcccgccgcggccgggccctcctcggtctcggcctgggcgtcgccgacctgctggtcctggtcgccttcatgtccgccgacagcaccctgtcctggagtctgtgaaccgcctcaccgtctcgtcccggccgcggtccgacgagaccggccttggtccgaggccgggcggaaccgccccgtagaatcggccgcaccatggcttacctcgaccacgccgcgaccaccccgatgcttcccgaggcggtcgaggcgctcaccgcgcacctgagcgccaccggcaacgcctcctccctgcacgcgtccggccgccgggcgcggcgcaccgtcgaggaggcccgcgagaccctcgccgaggcgctcggcgcccgccccagcgaggtggtcctcacctccggcggcaccgaggccgacaacctcgccgtcaagggcctgtactgggcccgacgcgacgccgacccggcccgcacccgggtcctggccagccccgtcgagcaccacgcggtcctcgacgccgtccactggctcggcgagcacgagggcgccaccgtcgagtacctgccggtcgacgcccagggccgggtccatcccgaagcgctccgcgaggccatcgcccgcgaccccgggaacgtcgccctcgccaccgtcatgtgggccaacaacgagatcggcaccatcatgccggtccgggaactcgccgacgtggccgccgagttcgacgtgccgctgcacgccgacgcggtccaggccttcggccagctcccggtcggcttcgccgactccgggctcgccgccatgaccgtttccggccacaagatcggcggcccctacggcatcggcgcgctgctgctcggccgggattacaccccggtgcccgtcctgcacggcggcggccaggaacgccacgtgcgctccggcaccctcgacgtccccgccgtcgcctccttcgcggtcgccgggcgtctcgccgccgagcagcgcgagtggttcgcccgcgagatcggcgccctgcgcgacgacctggtcgacgccgtccgtacggccgtcccggacgccatcctcggcggcgacccgtcacccgggggacgcctgccggccaacgcccacttcaccttcccgggttgcgagggcgactcgctcctcctgctgctcgacgcccagggcatcgagtgctccaccggctccgcctgcaccgcgggcgtcgcccagcccagccacgtcctgctggccaccggaaccgatcccgacctggcccgcggcaccctgcgcttctccctggggcacacctcgaccgaggccgacgtggaggcggtcgccaaggcgatcggccccgcggtggaacgcgcccgggcggcggggctgtcgtaggagccggcgtacgtgccgtacgggctgccgcggggctcaggccttggtcggcggcttcgacggaccgctcgtggccgcccgccgcaccagctccagataccggtcccagtcccagtgcggccccgggtcggtgtggtcggtgcccggcacctccacgtggcccaggatgtgcttgcggtccacgggtatgccgtaccgcgcgcagatccccgccgtcagccgcgccgaggcggcgtacatcgcgtcggtgaagtcctgcgggcggtccacgaagcccgcgtgctcgatgccgacactgcgttcgttgtagtcgcggttgcccgcgtggtaggccacgtccagctcgcggatcatctgggtgacgcgcccgtcctgcccgacgatgtagtgcgcggccgccttgtgccccgggtcctggaaggcccgcaccgcgctgtcgaagctgccctgtgtgacatggacgatcaccatgtcgatgccgaagtcgtccggccggtccgcccgccgccagttcgcgtccgacgccgccacccagcgcgcgcccgcgtagtcgaccacgccgtcctcgcggggccgctcgacgcccggtatccgccaccacagccgggacagctcgtcgcgggccagcacaccggtgcccacggccgccgccgccccgccgacgatcagcgcgcggcggccgatacggcggtcgccgtccgcggacccgccgccggccggcccgcccggtgtggacccgctcgtggatccctgcttcgcccccatgcgatcttcaacgcatactcgcgcgctccggttcccgcttcccccgtactctggaggagttatgactgagaccccgcagcgcacccgccccctccgcgtcctcgccgccatgtcgggcggagtcgactccgccgtcgccgccgcccgcgcggccgaggcggggcacgacgtgaccggcgtccacctggccctctccgcgaacccgcagtccttccgcacgggcgcccggggctgttgcaccatcgaggactcacgggacgctcgccgcgccgccgacgtcatcggcatcccgttctacgtgtgggacctcgccgaccgcttccgggaggacgtggtcgaggacttcgtcgccgagtacgaggccggccgcacccccaacccgtgcctgcgctgcaacgagaagatcaagttcgcggccctcctggacaaggccctcgcgctcggcttcgacgccgtctgcaccggccactacgcccaggtgatcctgcgcgaggacggcgtccgcgagctgcaccgcgcctccgacatggccaaggaccagagctacgtcctcggggtgctcgacgaccggcagctcgcccacgccatgttcccgctcggcgacacggtcaccaccaaggacgagatccgcgcggaggccgagcgccggggcctcgcggtcgccaagaagcccgactcgcacgacatctgcttcatcgccgacggcaacacccagggcttcctcgccgaccggctcggcaaggcggagggcgacatcgtcgacgaggcgggcaaccggctcggcacccacgagggcgcctacggctacaccatcggccagcgcaagggcctccgcatcggcaccccggcccccgacggcaagccgcgctacgtcctggacatctccccggtgaacaacaccgtgacggtcggcccggccgaggccctcgacgtcgacgccctccgcgcgatcaagccccgctggtgcggcgccgcccccaccggccccggcacctacaccgcccagctccgcgcccacggcggcgagaccgaggtccgcgccgaactcgtcgacggcaccctggaggtgaccttcagcgagccggtccggggcgtcgcccccggccaggcgatcgtgctgtacgacggcacgcgtgtggtgggctcggcgaccatcgcgtcgacgacgcgcgcgacggccggagccgcctgagccgtccgcccggacgcagggggcgacctcgaaggcgccggctcagcccgcgaggaactccgcgagcaccggcgccagtacgcccggctccaccatgtgggtctgccggtccacggtgccgtacctgccgtcgggagccgcctccgcgatcgcccgggccgcctcgtgccaccacgcgtcgctcgcgccgcccgcgaggaccagcagcggcacggtgatcgcggcgatctcggagcggggcacccggccgtcgcccagcacggcgtcgtcgtacgcgaggctcggcgccaccgactccatcccggcccacatgggggactgccgggcgccccggatcatctcctcgcccagccccgtgtggcggaggaacagctccaccgcgtccccgcgccggccctgccccagcgcctcggccagccgcccggtcggtgtactgggccgcggcccgtacggcggcgtcgtccatggcgtacggcacctcgtagacggcgacccggcgcaccggcagaccgctcgccgccgcccggagcaccagcgcgccgcccgacgacatcccgtacaacgacgcctcgccgcccagcgcctcgatcagcgccgccaggtcctcgatctcgcgttccaccgcgtagggcgcggtgtcgccgctctcgccgcgcccccggcggtcgtacacggtgacgtcgaaacggcccgacagctcggcggccaggggcgccgtcgtggcccccgtcgacatcgcgccgctgacgagcacgaccgccggcccctgcccggagcgttcgtaggcgatgcgggtgccgtcacgcgaaacagtcgtcatctccatgccagtgcagactgccctacggcaggtgattcatcgctcaggacacctcgacttcgtagaaacagaggtggtccttgatctccgcgacctccggcttcgggtccgggtacgcccacaccaggtccgccgcgccgggcagcgaccagtaggacgcgtcgcccttgaaggggcagtgggtctgcgtgtcggacggcgtcagcaggtcgaggcgtacgtcctggggcgggatgtaataccggtcaggcaagcccgtctcgtggagcaccagcgccccgtcgctctccgccagcacctgcccgccgtgcaccacgcgcacgtgccgctcgctcggttcgacggtgatgcggtgtcccccgagtcccttgggtcccttggtcacgatcgtcctcctcggtggcagtggtcttcgtcactacagcgtgcccggacgcccggttcttcccgtcccggcgggccgtacggtggacgccatgaacatctgcgtcttcctctccgccgccgacctcgacgagcactacacgcgccccgccaaggagttcgccgaactgctcggcaagggcgggcacaccctcgtctggggcggctccgacgtcggtctgatgaaggtggtcgccgacggcgtgcaggagtccggcggaaagctgctcggggtctcggtggacttcctggccgccaaggcgcgcgagggcgccgacgagatggtgatcgcgaaggacctggccgagcgcaagcggctgctgctggagaaggccgacgccgtggtcatcatggtgggcggcaccggcacgctcgacgaggccaccgagatcctggagctgaagaagcacgggcacaccgacaagccggtcgtcctgctgaacaccgcgggcttctacgacggcctcaaggagcagttccgccgcatggaggacgagggcttcctgccccgccccctcaccgagctggtcttcttcgccgaggagccggtgggcgcgctcgcctacctggaggagagccagggcatcgagtagcacgccggtggtgcgagcatggcgggcatggctacacatgtgatcaccggagcgggctccggcatcggcgcggccgtcgcccgccgcctgcacgaacgcggtgacgaggtcgtgctccacgcgcgcgacgcgggccgcgcgaaggaactcgccgccgcgcttcccggtgcgaagacgctggtcggcgatctgtccgaccccggcaagctgtcctgggccctctcccaccagagcctgcccgaccgggtggactcgctgctgcacatcgccggggtcgtcgacctcggcccggtcggcgacctcaccccgaagacctggctccaccagctcagcgtcaacctcgtcgcccccgccgagctgacccgcctgctgctgccccagctccgggtggcccagggccaggtgatcttcgtcaactccggctcgggcctcaacgcccacgccggctgggccgcgtacggcgcctccaagcacggcctgaaggcgcttgccgacgccctgcgccaggaggagcacgccaacggcgtccgcgtcacctcggtctaccccggccgcaccgccagccccatgcaggccaaggtccaccagcaggagggcaaggactacgacccggcgaagtggatcgaccccgagtccgtcgccacgaccatcctgatggccctggacctcccgagggacgcggaggtcaacgacctgacggtacgcccgggacggtgagcgcccttccggaaccccggaccggatcactcagcccgtccggcgtttgaggacgaggccgtccaggccgaaagcggggggtctgggggcggcagcccccagggtcggggacgggaaggggcggcgggggcgaaatcaagccccgcgcccctgcgtacgcttgccccgtgaacgacaccttcgcccccgccaccggcatcggcagcctcccgggccacgacgcccgagaggccgccaagaccgccaccggcagcttcgaggacttccccttcctccccgagctgcccgcccgcggccccggcgccgacatgatcggccgcaccgccggcatgctcgtcgagctgtacgcgcgcgtggagcccagcggctggcggctcggcgaccgcccgggccgggacaccaagcgggcccgggcctggctgggcgaggacctcgacgccctggaggagttcacccagggctacgagggcccgctcaaggtccaggccgtcggcccgtggaccctcgccgccgccctggaactgcggggcggcgaggcggtcctctccgaccccggcgcctgccgcgacctcgccgcctcgctcgccgagggcctgcgcctgcacctggcggaagtacggcgccgcgtgccgggtgcccgtgtcgtcctccagctcgacgaaccctccctcaccgcggtcctgcgcggccggatccgcaccgccagcggctaccgcacccaccgcgccgtcgaccgccaggtcgtggagggatccctccgcgaggtcgccggggtgcacgacggcggccccgtcgtggtccactcctgcgcgccggacgtgccgttcgccctgctgcgccgggcgggtgtcgcgggtgtctccttcgacttctcgcttctcaccgagcgtgacgacgacgccatcggcgaggccgtcgagggcggcacccggctcttcaccggtgtcgtgccgggcacggacaccgcattgtcagaccctgccggtagcgtcaggggtgtcagaacgctgtggcgcaggctggggctgcgtccggagctgctcgcggaggcggtcaccgtcactccggcgtgcggactcgcgggtgcctccccggactacgcccggcgcgcgctcgcccactgcgtccgggcggcaagatctctcgcggacaacccagagtaacgggaggacatacggtggccggcgacaagcagggcgacaagcaggcggagacgacgagtgtgcccgccgaggcgcgggagcggcacgcgcagctcgccgagcagatcgaggagcaccgcttccggtactacgtgaacgacgcgcccgtcgtcagcgacgcggagttcgaccggctgctgcgcaccctggaggagctggaggagcggcacccggagctgcgcacccccgagtccccgacccagaaggtcgccggcgcctacgcgaccgagttcacggccgtgcagcaccccacgcggatgctctccctggacaacaccttcaacgacgacgagctggccgcctggttcgagcgcatcgcccgggagctgggcgagcaggagtaccacttcctgtgcgagctgaaggtcgacggactcgccgtcaacctcacctacgagcgcggccgcctcgtccgcgccgccacccgcggcgacggccgcaccggcgaggacatcacgcccaacgtccgcaccatcgccgagatccccgaccgcctggcgggcgacaaggtccccgacctggtggagatccggggcgaggtctacttcccgatggagaagttccaggagctcaacgcccggttgaacgaggcgggggacaagcccttcgccaacgcgcgcaacgcggcggccggttcgctgcgccagaaggacccgcgcgtcaccgcctcccgcccgctgcacatggtggtccacggcatcggcaccctggagggctactcgggcctgacccgcctctcccaggcgtacgacctgctgaaggcctggggcctgcccacctccccgcacaaccgggtggtcgacggcctggacggcgtacgcgagttcatcgcgtactacggcgagaaccggcactccgtcgcgcacgagatcgacggcgtcgtcgtcaaggtcgacgagatccgcctccagggccggctcggctccaccgcccgcgcgccccgctgggccatcgcctacaagtacgcgccggaagaggtcaacaccaagctggtcgacatcaaggtgggcgtcggccgcaccggccgcgtcacgccgtacgcgcaggtcgagccggtcacggtggccggcagcgaggtggagttcgccaccctgcacaaccaggaggtcgtcaaggccaagggcgtgctcatcggcgacaccgtggtgctgcgcaaggccggtgacgtgatcccggagatcctcgggccggtcgccgacctcagggacggcagcgagcgggagttcgtgatgccggccgagtgccccgagtgcgggacgccgctgaaggcgatgaaggagggcgacatcgacctccgctgccccaacgcccgcgcctgcccggcccagttgcgcgagcgggtcgcctacctcgcgggccgggagtgcctggacatcgagcacttcggcggggtcgtggcggccgcgctgaccgggccgctggagccgtccgagccgcccctggtggacgagggcgacctcttcgacctcaccgtcgagaagctgctgcccatcaaggcgtacgtcctcgaccccgacagcgggctgcccaagcgcgaccccaagaccggcgaggagaagatcgccacggtcttcgccaacaaggagggcgagccgaagaagaacaccctcgcgctgctccagcacatcgaggaggccaagacccgcccgctggcccgcttcatcaacggcctctccatccggtacgtcgggccggtcgccgcccaggccctggcccgcgagttccgctccatcgaccgcatcgagcaggccaccgaggaggagcttgcgagcacggacggggtgggcggcgccatcgccaccgccgtcaaggagtggttcgcggtggactggcaccgcgagatcgtgcgcaagtggaaggcggccggggtcccgttggaggaccggtcgacgggggaggacgaagggccgcgcccgctcgaaggactcaccgtcgtcgtcaccggcaccctggagaacttcacccgggacggcgccaaggaagccctccagagccggggcgcgaaagtgaccggatcggtgtccaagaagacgtcgttcgtcgtggtcggtgacaaccccggttcgaagtacgacaaggcgatgcaactgaaggtgccggttctgaacgaggacggtttcgccgttctgctcgaacaaggacccgaagcggcggcggatgtcgcgctttcggctgaggaatagcggttgaaggccacccgatcggcgcatatcagatgcatacgggtggccgggtggcatt

SEQ ID NO: 141 - protein, 503 aa, Homo sapiens [sequence omitted]

SEQ ID NO: 142 - DNA, 766 bp, Homo sapiens
ggggacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaagcttggagcaacaataaaaagcttccagaacagaacaaaaaaaaaaaaaaaaaaaaaaaaaaaaaa

SEQ ID NO: 143 - protein, 1304 aa, Homo sapiens [sequence omitted]

SEQ ID NO: 144 - DNA, 83820 bp, Homo sapiens
tgatttcttcacccatttcagatcacattcctttgggaagcagcagttaaatatacggttttagaaggatgtgtggtgaaggcttcaagagttacagatctcagaagctcatctgtgggcccctctataaatcagtaaatgtccactttaaaagattttctctagtcataatttcaaagccacactgggcaggtggaaccaccacactgtcaagagattctataatccaaacgctttcttctcttgcatcacaatattctaaataggggagactcgtgaaataaaactatcagaaaccattttcccaaagaatttctcaagttagaccctattatattctagtagttttcacatattgaaatactcatcacactttagaccaaaatacctgaacaggcctaaaaggctcatcagattctttccacctagaaaacaggagacagacgattttttcaatatcattccgaggccaaagaatgaaatccatctcctgagtacagccaattacatcctataaaatgattaaaaaaaaaaaagtttacttttaaagaaacagctacatcaagccatgtcacaaattatagggttcccctataaaaacattttataagtacaaaagatctaccatatatcattttatatcttaggaagtaaacataatagtttataatctgaatagctcatgatgtaattttttatttttggagacagagtccctctctgtggcccacactggagtgcaatggtgcaatctccgcttactgcaaattccgcctaccaggttcaagcgattctcgtgacttagcctcccgaatggctgggattacaagtgtgtgccaccatgccccgctaatattttttgtatttttaatagagacggggtttcaccacgtcagccaggctggtctcgaactcctgacctcaggtgatccacccacctcagcctcccgaagtgctgggattacaggctaagtcactgtgcctggctctaattttaatttttatcttacagagagtcacatacactcagtccaatgctcctaacaccaagacctagacttatcagtgcatggtgaaaactccaacaaaatctctgatatctgttgtattgtcagaccctgaacctttatttccacctttaaaaatcaatctatttaaaaagatgtcttagaactcctaatatgaatcactatcctattatagctgaaatgctatttttattttgatagaaaactacttttctccattcctgacttctgcttcattattgtagccagcatattaatttttgaaggtccataatttcttccagaccagtatctggttatctccagcattctccccaagtaactgtggggatctcttggttcaggtatgcccagattaacttttaacatgttgcagaagtttacaaagctggaagcacttccttatattcatattccccccaaaaaaggaaatacaataaacggagacataagacatttatccacaataataatacacaatattatgagcctaatacaacaaagttgtccatgttttactcaaggtcaagttttcaaaaacaaacctacttcaaaaatttttaaactttctgcataacacttaaattattaaaaacagttggctactggcagggtgcagtggctcacacctgtaatctcagcactttgggaggccaaggcaggaggatcacttgaggtcaggagttccagaccagcctagccaacatggcaaaaccccatctctactaaaaacacaaaaaattagccaggcatggtggcgcacaactgtagtcccagctactcgggaggctaaggcaggagaatcatttgaatgcgcgagggcagaggttgcagtgagccaagatcatgccactgcactctagcctcagcgaaagagcaagactttgtctcaaaaaaaaaaaaaaaaaaaaaagtccgagatcatcaacacctaacacagattaaagaaatccctttatatacttcatccacataagaatggtctggcgtaaaaaaacgtgtttttctaatcctataaacacaatgctttaaagtcatgatcccagttatcaacatggcacaaagacaaatttacctgaagagactggtcactatcataactatccactttaaggggggttcggggggcggggaaatgcaaggttaatccacagaaactttatcaagtcaagacttaaggcagaacttacccttctcatagactgatatcgaggagcatggagctgtaccacatccttctgtaaaagctctagggaactttccaaggaatagctggaatctcgcacacctttcaggatattttcttcataattatttgtcatgactggtataacctcagacacttcaaaaagtgctgactttttcttctagaagaaaagaaaatggtgtattaacccacagggagcacagccttttaacactcagttcatattacaatgtcatgtaacattaactccacaaaattcttaactgtctgcagtaacttatacactgaaaacacattttcagataggtaattccttctgttcttcccctacctccccctccaaccatacatgtacaaactgtcattagaatgtttaatgcttgagttttatagcataatggtatccatagcactattttggacaatacttcttaaaattaaaaatctcaccagttttaaaacaacgctattcagacaaatgaatagttttattccttatatgggccaatttccattactttctcaatattacattatcaaaaccatcaatatttctggtttttcttttttttttttgagatggagtctcactgtgttgcccaggctagagggcagtggcaccatcttggctcacttgcaacctctgcctcctgggttcgaggggatctcctgcctcagcctctcgagtagctgggattacaggcctgcgccaccacacctggctaatttttgtattttcagtagagacagggtttcaccatttggccaggctggccttgaactcctgacctcaagtgatccgcctgcctcagcctcccaaagtgctgggattacagccgtgagccactgcacccagccaaaaccatcaatatttgaaagactaaaaagaagcacaccaagttctcttttaatactactcaagaccaagtacgcatcactaaactactttttaaaattctgtactattaagtatatatcatgaattattcagggcaactgcatggacactgtccattcacagaataaaaccagattatcgttggtgttaaagaattaagatggtgcaatttggggcaatatatagattaaatacaaagatatggtctcactacttattatcttggatttatttaaagagcatacactgtatcatcttcaactaaaatccaatctcatcaattttgagtcagcttgtcaacaaaacaaaagtggagatgtaagtccttgataccacccaatcttgggacagtcacttcaaaaattacttaaaaatcacttcacaatgctatacttcagcagctaagaatgttcttaaatacaaataaccttttaggagttaagagttggggctgtgcgtggcagctcctgcctgtaatcccagcactttaaaatgccatgacaggaggatcactttagcccaggagttcaagactagcctgggcaatacagtgaggcctgtctcagcaacaaaaataataagagttaaacagtagggggaaacctggaaaacttccagatacttaatagataccacactaagattgtatttctgatctgaaattagctaacaatttaagcaccaaaatccaagtagcacttccttacattcataacctcatctttggtcaaataagccttgctgataatttaagaaaatgttcattttaagttgcaaaaaatactgctcttatcatcccatccttgactactcacaacttactgtttgctatttaactgcggaactaattctgattaagacctccaccgcccctaaaaatgaaacttcctctaggtcattttgagtttttaaaaactgtacttctatacaaggcaaaatgaactctaagtaaaaaagaaaatcacacttctaaacacaaattaaccatttcagtatttaattgctcctaaaaggtgtattctacttcattaaatgtaagagaaaaggttacctacattacgcagtttaagaaacaggataaactttagcatataaacagtctgattacaatttcacactttcaaccatcttatttatactctacattagataatctttaaattccatcataaggtttcccatgttaactccatataaaattttgtaatcttgcccaccccatgtcaactcagtgtatactactactaagcttcagactcaaatttatttccaaaccaaagaacgctcaagggtcttttcgcatgctgcaactgctcaattcacagaatcacccctaagggtgaaaaaacagagcatacaaagcagactttttttcaaccactctttaacctaatattcataataatttaagagtaacaaataatatacacttacaaaaattacttgtgctaattcaccattaagaactttaaattaccttctccttgaatacaaaggcaatatacatcttgaagtcaaactggtcagctagagattcttttttctttctaagctgagcacgtagtctgttcagagcttgtttcttccgggagtttgggtcccccattttgaaatacaggtggtactaaagcctttggaaattgtcactaaactatgggcactttttcttaagactcaagtacaacagaaacaagtcattttttttcctgctaatatgattgattagcgaaaatcacgactataacccaaaaactgcaccttctgtcaatattagcagactgtcatattacagggtcaagaaacaaaagctgctgtccagtcatgtttggacaataacgtttggggtcagacgggaaaaagggaggaaagaaaggaaagaaagaggagaaaataactaactttctggaaaacacatttggcttaactgccaaaataaaggctttgcggagaaatgaaaagcctataatcaggatttaggtgtgcaataaaacacagctgacaccagaccaatccctaaaatccatccggattttcccccctttttagaaaagggattaaggaacagggagggggaagtgtgatccttgctttccaaaaaaaaaaaaaaaaaaaactcaccaaaaccaaaaccaaaaccaaacaccaaaacagggtaggtgaatgaaactgaaatatccaattagattttacccagccagctccatggctgtagtacctaattcttagttatttcagatttcactattgctatgtattgtcagtgcttgttattgattacacttggtggtgagcatagagaaaagtgcaaaatcggtagagaaggaaagggagaggtacagggtttccctgcaatcaactacagtgtataccgggggcgggcagctgtggcccaaaggagccatgagaaaaaacagcggagtcattaccaacttccccatcacccacattttcaccctcaggcggctgctaacgctgctgccaaggagaatcatgacggcagaaggaaaaggggtatataatacggtattaattattccggctctgtggttagacctgattaatgcccgggttcccaacacccccagcctgcaactagtcctacattccccaagggagacttccctgtggatctgcccccgttcaaaatggtggggagtgcgatttatcttcttgtgagcattgccgaggcaaaggtggcgggttcttctcccaaatcccaggcggtgcccggagaccacctgccttccacccccgcaggtcccacccccaccccttgccttcagcggcagcgactcactcgcaccacgggagacacaggatcactcaggttttcactcatttcatcgtggaaacaattcccgcccgggtggagtgggcgggagagggtaaatgggaaggttcagtgggggaaaaaaagaaaataattgtgttaatattacttctaaagtaagcccacccaccctccccccaaaaaattaagttcccggattagctctctctcacgttgaacagaccatgtttccagagtttggattgtttagggtggggtcgttagttgtttcccgaggggcagggggtggaattgaggcagctagggcggggtgggtgacggggaaatcccctccctgtccccgcggagcccgggactcacggaccgactctagggcggggtttgggccctctagccgcagcctgcgggcggagcggtggcggcggcggaagaggcggcggcggcgggggcgctgctggtagcacgggcaggagccatgtcaagagaaaaccaccagccaactgagcccctccatccccgctgcagtgcgcaccgtgactggaccgcccgcgctgctgccgccgctcagcccccacctgggacccatagtctggctcggcgccctgggcggcaacggaggggaaggacgcggagacagcggcaacagggagagaaaaagaaaaagaggaaaaacaaagagaaagatggggagttggattggtactggcggcggagggggaagggaaaggaagccctgcgctaagggtcagcaaagtaaccccccaaaataaagttatttcagttcaagcatctgctcttgagtctttcttccccctacagtcggattccggctctcaggaaaggtcgaggagacccggaggggggaaaagccgaagcggttggtgagcgtccgcggcagtactgcctcgttcccccccccgccggtggctgcagaagcggcgaaggcctcgggcgcctcgcgggtccggggcagagtcgcgtttgagaaaagaagcgagaacaaacaacttaaaatggcagcgacggccgctgcgtcacccgcctctcaccggcaccgccccggtgtgactgcgactgcgcgccctgcgggaccccaccatttgcgcagaatcaaagggggagaaaggattggaggtgggaaagttttcaaggttaccgaaaaagaggaaaacagatcaagagtacggaatagggacaggtcttttaaaagtggagcctttgaatttaacctctccatttcagtaatcgcccctcaaaaggggagtttgagagttgagactcctctctcctccagtatggagtatccaaggggcgtggaaaggggggggctccccgccactccttccgccccccttcttcaggaagtcccagtctcctgagttggctcttcgccccgccccgatgtcgtcataaaagcacgccctcaaccatcctcaacaaaacacccggatggagtcgcacttcccgagtctcgtcagcctctcagagtcaggctgggcgcgtgacagagccgaactagcgacctgggcgggccaaaactgcggaagtcggcggagagtgggcgagggtaggggcggagcaaagaaggaaaaggaaagtgtgtgttggagattggaagattcttatttcgattcttataattagttagtcctgggggtcggccccgcggtatcctgcggcaacaaacctagaactcaattcgacacctggaatttaaacggcgtgcgggagcagatgtctcatgttagtgctacttgcctctgtccccaccccgccacgtgcgcaggcagggagggcggtcctcaagcttcgaacaaggtcaaagacgttgttcagacgttgctgctgtggcttaggagaggagcagcccagtctgactcgtggatttttacccactgctgtcagaacacactttctgttagaatcccccaagacctcagacctacagcctgccccttaggtggttcactgtcttcatcgaaacgtttgccgccgagtcgcacgtccttggcaccaaaaagcgttgagtccatttttcaaagctctaatgtgctctttaaaacacagttatgtaagtacttagcaaaggtcaatactccacataagcaatgcttatatactcattggctactctgagattttagaagtccattgggaccccaattactacttttcacttcgtgaagtcaaaacagatcagctgtaataacattatttcagccatgagccaaaagaataactggtacccacccttcaatataaattgtccagaaccaaaggatgagtcctgagatttccaaataacttctaatctcggaagatacagcttgcattttgctagtgctttgctgatttgttttcaaaatcatgtaactatggaaagctcacagagataaaacagaaaatgtcacgtagtttagagcattggtttaaaaaagaaagatttttaaaagtaagccgagcatggtggctcacgcctgtaatgccagcactttgggagaccgaggcaggcggatcacctaaggtcaggagttcgagaccagcctggccaacatggtgaaacctcgtctctactgaaaatactaaaatcagcctggcttggtggcaggcgcctgcagtcccagctactcgagaggctgaggcaggagaatcgcttgaacccgggaggcggagattgcagtgagccgagatcgcaccattgcactccagcctgggcaacagagtgagactccgtcggaaaaaaaaaaaaaaacaaacaaacatatgagacatacaagccagtatgatcttcaggtgatccgcctgcctcaacctcccaaagtgttgggattacaggcatgagccaccattcccagccggcttatatgttcttgacctggccttgacttgtatccatgatcaacttcatggaagaatttttaaaataacagctttattgaaatataattcacataccgtatttatctacttgaagtgtacaatccaatggtttttaatatattcagtgttgtgcagccattacattaccccaaaaagaaaccctgtacctattagcagtcacttctcttctttctagtttatgttctgtctatagatttgccgtttctgaaatttcatataaatgaaatcatttaatatgtggtcttttgtgactggcttcttcacttagcataatgttttcaaggttcatccatgttgtagcatgtatcagtacttaattcctttttattgtggaataatatgtattgtatgaaattctatattcattcatcagttgatggacatttgagttgtctctgccttttggctgttataaataatgctgctatgaacatttacttaaaagcttttgtatagacgtatgtttttaattctcttgggcatatacttaagagtggaattactgggatatatgttaactctatctttaaccatgtgagaaactgccagatgttttccaagtctgttgcatcattttacatttcctccagcagtgtattccaatttctccacattcttgttattatgtcttttttagtataaccatcctagtgggtatgatgtatgtcatggtggttttgattttcctttccccaacgattaatgatgttgagcatcttttcatgtgcttattggctgttctaatatcttctttggagaaatgtctattcagaacttttgcccatttttatttatctacttgtttatttatttattttttgagacagagtctcgctatgttgcccaggctgaagtgcagtggcattatctcagctcactgcaacctccgcttcctgggttcaagcagttcttctgcctcagccccgagtagctgggcccacaggcccccaccaccatgcccggatgatttttgtatttttagtagagacggagtttcaccatgttggccaggctcgtctcagactcctgacctcaagtgatccacccacctcggcctcccaaagtgttgggattacaggtgtgagccaccaagctcggccttttacccatttttaatttaaaaaattgtttttttaattattaaggtgtagaagttttttattctagatacaagttccctgtcaaatatatactttacaaatacgctcccctattctgtgggctgtcctttcactttcttggtgatatccttcgcagcacggaagtctttaattttaataaagtccaacttatctatgtttttcatttgtcccttgtgcttttgttgttttatctaatacaccattgaagaattttttcactactataataatcctgaaaaaaacagtatggagcagatgttgaggaaaaaatgaagtttttagtttcagctactgtgaaacagaattggagacacctggtcacagctgagcacatcctatgaaactgtgttatgggactgtgctaggtcttaatgagatgagccaagaaatagcagcaatgtcccctggaggacgaaaacactgctagctcaattttctctgtaacttgaaagggctataaaataagaaggtagtcgaaggaattaaaatttttaaaagccgtgaccaaacgtttctcaatgaaattcagataaaagtcagagagcattcacttaagatttagcttctttaactgtggagaaatgcatttcattgtgttagaaatggcttacttagggttaggctgcttcaaacacaataggatttgtggagtgatgatttgatggtggcaccttggctaaaaatatctgcttaacttcccttttggagttttaaattataccactagatacattgaaatttccctggttgaaatgcagatatcactgcaaaggttacattttaatgaaataacaccttatagagattctgtgcgagcctcctttctgaagaaacacaatgcaggccagcttgggcgggctcctgtgttaacttccaatctttaaagaaggacaacctcggataatcccagtctctgacatttatagcaagttaggaaatgatttctcaaacctgtgcttgtgtagcctaaataaatgacaataagataaacaataaagtatttaacaattggccttcacttttctaaaaagagccagccttttcttttacctttaaaacatacattgtctgtacacacatgctcttcttttacagaaatctagttttctcaacatgctcaagcatattagacttctcagggttctcaaacatcttgtcccttcattagtgctatgaaatttgtcagacatgggccttgaattttggccatatttatgattaacagttcaataagcatgataaacgtctacagcagaacaagtttatggttagactctacaggtcttgagaacaagttctattgctctacagtttgatcctgaaagcagccacaccaaggatcttgtctccagatttcaactctacagatttatcatctaagataattatgatattatgtgttaataaaatttcataatccaatggggattttcacaatatgtactctagcacatacagacctcgcatctacagcagagctgcatggttatgaaaccaaaagggtattaagaggagaaactatgtttgttttgagagctattcttaccctttttaggaggatcaggggatagcttggtagtttcttctttagtctcacccttatttcatgttagcccaaactatagaggtcagtgcttatttgcaggctgatcgttgaatatttattgaaggcctaaaacaagttgtaggcttgaaaaatgagatttgagccgggtgcagtgtctctagcctgtaatcccagcactttgggagactgaggcgggtggatcacctgaggtcaggcattccagaccagcctggacaacatggtgaaaccctgcctcttttaaaaatacaaaattagccaggtgtgatggtggactcctgtaatcccagctactcgggggcctgaggcaggagaatctcttgaacccaggaggcggaggttgcagtgagccgagatcgagccattgccctccagcctgggcaacaagagcaaaactccgtctcaaaataaaaaaaaagaaagaaaaagaaaaaagaaaaataagatttggccaggtagcagccattgtcctggagcttgggacagggttaagaaccagaggcattttcaagtgagtacgtctatcccaccatgtattttctttatttattaacttcttctttcccctgttccttttttttctctcgcctgcctttctttttttcttttccacttctcatgctttatgcccaccagcattatcagaaaatactaattagacaccttttgtttacactttgggttaaagctatacagattgctgtccaaacaaatctgctggtaccatttaataaggaatattttttacccattatctttgcctgttagtctcaatttgttatcaaacacacttctatttagttttccttaaccccgggctctcactgacttttgcttcttgactacttcctaatttcatttcaaatatttttctagattccagatgtcactcccacaattcaaaatgctcttactattccatttaacgtgtctaggaaggttatagtagataaattgaaaaagcaaccttctgacacttttgttagaactccatcatcatccttagaaagaaaatgttaaaatattatagagttcgtgccactcttcttaccctattcccacatacaaagaaggcaaatttgagcaattaacatatgaaggaaagtttaaatgttttagaatttttttcctcccttcccagaacacattccattctctattccacaaagattaggtgttggaaaggaatgggaaagatatatacatgtataacaattttttccacaggtaaggtaattccacttatctaaaatcatgtaagtatactataattatggacgtccattaattctttgtccagtaataagacatgttagtatatatataagcctatgtgcaaatatatacatatataagcatacacagtaccagtacacttttcgtttgaacactgcatgttatctgtttgtaacaaattgccctaaaattttgcagcttaaaataccaaacatttattatctcatattaattgtggatcaggaattcgggagcagctttactgggcaatttgtcgtcagagttcttcatgaggttgcagtcaggattttggccaaggcaccagtcatctgaaggcttgactcaaatgactgttggcaggaggcctcagtttctcaccatgtgggcttcacaacatagtagctggcttccctcaaagtaagtgatcttggagagagggagatagaagccataatgtctttgatgacctgggcaaagaagcaatattccgttgtttccatattggttatacaagtcagctctactcagtgtaagaagagactgcacaagagtgtgagtatcaagaggcagggatcactagagccatcttagatactggctactataaacatcttttatgttatgtacaaaataaaaagtagccatctaaaggtttttaccagagacctctaggtctatcatagtcagcacagatcaggttagaggtcagcaaactttcttaaatggtaaaagtaaatattttaggcttgcagcccatacaatctctgtttcaactacttacctgggtggcagcatggaagtagccatagataatacataaacaaatacatgtgcctgtgttccaacaaaactgtataaaaacaggcagcttgcctgcaggttgcaggttgccctggactaaattatactgaaataaaacccccaaaatctcagcggcttaaactacaaagctttgttattcactcacgatgagtgagttataggctttcaggaattcagaattatggagaatcacatgtttccacgatccctgaagcagaaaacagagacgagacaaatcccacactggcttttaaagcttccacctggaagtgatatcaatctcactctaatttctttggccaaagcaagttacatgactacccctaacttcatgagatcaaggaaatacaaatacaagcctaccaagtgcccaaagaggtggtgaagcagatatatttggtgatatgaacactagaagcatactatttaccattcttttgctcttggtttacctttaaacctttagttgaagctgacactgttagcaacgttaggagaactcactcactatggaaacgccagactataaagtctatttttagtcacattttgcttttgcttttccccaaaccactcttgtcctacctgcttcaactcttctggatgtatctattgtcattgctttcagcagacaatgtttatgctataaaacttaagtttttgcttaatgtagaataattagcaattttttttttctgcctgaaatggagcttcactactcagcttccaattcaaagacagccttcctaatgtttccagaaaaaagaaatataagcagttagttatctacctcctcttctacaacagtagagaagttaatcaattacaaatatttgttgaatacctactatataatcacactgtgctgtgtgttttgaaggctacagaaaaataaacacttgttcccaaagagttttaggtagttaccaaaataataataaacatctaaaaagagtgagtaatactagactgtataattaagaactgaaatgtgattgacaggcattgagcaggataacagtaagataagtaggaggtcaatgaaagctgagttagatgagattcacaaaggaagcgtactcaagttttgaaagttggtaagaattttgctggatttaagtggaagaagagagggaagagaagaatgaaatttctgaaaaggaaacataataattgagggcatgaaggtggattttagcctggtatatccatgagacagtgaagatatcaatctaaatacaatggaagatgcacatttagaaagagcagaaaatgcttgagaaaagatagaatgaagctctggttcaagatggcagcctgaacacacactctttggtctctctctcttgcaatacacaattaaaaacagtaataaataattttcaagtgaacaaagccagaacacctaagagaatgggaggagggcaattagtagacaatagtttttaactaaatgctcataaactgatgctggtgttgacaccccagttaaagccctctttcttggctccctgacactttttcctgaagggaagcctttctgtttagcactctctacttgactgattagaacttcctgtcatgccaggcttggtggctcatgcctgcaatcccagcattttgggaggctgaggcaggtggatcacctgaggtcaggagttcaagaccagcctggccaaactggcaaaacctcatctcaactaaaaatacaaaaattagccaggcgtggtggcgggcacctgtaatcccagctactcaggaggctgaggcagaagaatcacttgaacccggcaggtggaggttgcagtgagctgagattgtaccactgcattccagcctgggcagcagagcgagactccatctcaaaaaaaaaaaaaaaaaaaaaaaaaaaaaacaccaaactgaacttcctgtcagcctcttctattttctggacaattaactagcaggaaaacagctctgtataaaataataaaggaaacacacaggaaaatcagctaatttcctcttcttctttttaacataaaaaagtatccctaaatcactggacacatgaagaaaatcagctacaagcaattcgaaaactggaagaagcaaaaataaaggctgactacacaagaaacaatttggggaacagaaaaatagctttttaagcgtctagttagtattctcagaggtagtttagaaaattaatacatgaaatcacaatgagatgctacaaataaagcacaattagagaacatgaaagagcacttggaagttaataataaacttgtcacatttcaaaattggtcaaaatatgacattagaaaaaaggagaaagaaaaaaactagaaaacataaaactcctagaggtctaatcccagttcaagctctaaccaataggaattccagaaagaaaacctagggaaaaatgcaagaatagaagttactgcagaaaatatgccaaagctgagatacccatgaatcttcagattgaaagggcatactgaaagacaagcaagataatagtagatgaaataaggaaaaagataagattcaaaaggcatccagaacagagacaaataggtcacctacatgggaatgaaaatcagactgacaacaggctaaatatctagaattatcagatatcagaaaacaatagtgtcttttcaacggatagtgctagaacaactgggtatacatattagcagggggagggtcttaaccactacatcaaaccatgcgcaaagactgtgatgactcttggacctaaatgcagtagctaaagcaaaaatatagaaaacacaggaaaatattttcatgacttaagggtgggcaaagttttttagataagacactaaaagcaaaaccttggtagaaacaattgacaaatcaaaatcaccaatttttaaaacatttgtttatcaaaaacattgttaagaaaataaatagacaagtcacaacctgggaaaaaattctgcaaaacatatatttgacaaaggattagaattcagaatgtgtaaagaatccatacaacttattaataaaaagataaacaatcaatttttaaacatgagttaaagattgaatcagacaccccctgatatggtttgcctgtgtccccacccaaatctcattttgaattgtagctcccacaattcccatgcatcatgggagggacccagtcagaggtaattgaatcatggggccaggtctttcctgtgctcttctcatgatagtgactaagtctcaagagatctgatggttttataaagaggagtccccctgcacaagttctctctctttgcttgctgccatccatgtaagacgtgacttgctcctccttgcctttgccatgattctgaagcccccccagccatttggaacaatgagtccattaaacctctttcctttataaattaaccagtctcagttatgtctttattgcagcatgaaaatggacaaatacagtaaattggtaccagtagagtggggtgctgctgtaaagatacccgaagtaatggaatcgactttggaaatgggtaacagggagaggttggaacagtttggagggctcaggagaagacaggaaaatgtgggaaagtttggaacttcctagagacttgttgaatagctttgaccaaaatgctgataatgatatggacaatgaaatccaggccaaagtggtctcagatggagatgaggaacttgttgggaactgaagtgaaggtgactcttgctaagttttagcaaagagactagtggcattttgcccctgccctagagacttgtggaacttttaacttgagggagatgatttagggtatctggtagaataaatttctaagcagcaaagcattcaagaggtgacttgggtgctattaaaagtattcagttttaaaagggaaacagagcataaaagttcagaaaattggaagcctgacgatgcgttagaaaagaaaatcccattttctgaggagaaattcaagccagctgcccgaatttgcataagtaacaaggagccaaatgttaattgccaagacagtggggaatatgtttccagggcatgtcagagatcttcatggcagccccatccatcacaggcctgtaggcctaggaggaaaaaatggttttgtgggctgggtccaaggcccccctgttctgtgcagcctagcaacttggtgccctgtgtcccagccaccccagtcacggctaaaaggggccaagatatagctcaggtggttgcttcagaggttacaagccccaagccttggcaacttccacatggtgttgagcctgcaggcgcatggaagtcaagaattgaggtttgggaacctctgcctagatttcagaggatgtatggaaacacttagatgtccaggcagaagtttgctgcaggggtggggccctcataaagaacctatgctagggcagtgtggaagggaaatgtggggtcagagcccccacatagagtccctactggggcactgcctagtggagctgtgagaagaggggcaccatcctccagaccccataatgatattcacttacagcttgcaatgtgcacctggaaaagccacagaaactcattgccaacctgtgaaagtagccgggtggggagctacaccctgtaaagccacaggggcagagctgcccaaggccttgggagcctacctcttgcatcagcgtgacccgatgtgatatgagacatggagtcaaaggagatcattttggaggtttaagtttcgactgccctgctgaatttcagacatgcatgggttctttagccccttcattttggccaatttctcccatttggaatgggtgtatttacccaatgcctgtccccccattgtatcttggaagtaactaacttgcttttgattttaccagatcataggcagaagggacttgccttgtctcagatgggactttggattgtggactttagagttaatgctgaaatgagttaacactttgggggatgttgggaagacatgattggttttgaaatgtgaggacatgagatttgggaggggccaaactcatcactcacattataaagaaataatgaggttgaattaaattaataataaaatgctgaattcaaaaaggactttaaaaattgggggatgttaaaaggatggtcaagtaaagatatttaagcaaatttaaaaaccttattaccaatatttcatttaaaagttgatgtttaatatcataaaagtaggaaggatataatctcataataaggaacaacaacttacatttaatacatgtagtcgtaataactaaaaaaaaactactaataataaaatggaacctcaaatgtccaatattaggatatgattaaatattattgtatatccctacgatgaattacaatgaaggcatttaaattatctagtagcagagcacttaatggtatgaaacaatgtctatgatacagtattatatgaaaaatacagcttataaacagaaaacaaagtattatcaatgagtggaaaaattctggatttctgtatatggtaaaacagcaatgtggcaaaatcttgagatggcaggggaaaatataataaatatgcttttaaatacctagctgtactcacaagagaataaaggatatccccaaaggcccaaaacaaagaggaagatagaaagcagagcagaaagctgatggtgaagctgcagctgccagacacagctgccagatacagcactgatttgtgcaacagagagatgtgagtttcatggatgcacagaggacagaagtcagagccttgagctcactcaaggtggggagtaggagcaaaagtgcttcataaagccaggaaccctaaagaagtagaaccttggtagggcgtggtggctcagcctgtaatctcagcactttgagaggccaaggcaggtggatcacctgaggtcacgagttcgagaccagcctggccaacatgctgaaaccccgtctctactaaaaatacaaaaattagccagatgtggtgatgcatgcctataatcccagctacttggatggctgaggcaggagaatcacttgaacgtgggaggcggaggttgcagtgagctgagatcgcgccattgcactccagcctgggtgacagagcgagactctatctcaaaggaaaatgaaaataaaaataataaaagtgaataaaacaagtagaacctcgttcgtgaagggtagaccagaaaaaaaaatttggccactgggctctgtatgcagataaacttctccttcaagaattggcagctataggtttgcttcacataagtttgggcttggcttttcattactagtttggtttaataaaccccagggggagaaatgaacttaaagttgtcctgagttgtcagtgccacaggtacgtagcagagacaattataaattccttctggaagaacttttctcaaccccagagagaacctagacaaaccagaacttactatttaaaattacaggctaagtggaatggctcacagctacaatcccaacactttgggaggccgagggaagaggattgcttgagcccaagagtttgagaccagcctaggcaacatagtgagatgtcatctctactaaaacttaaaaaaaaaattagccaggcatggtggtgtgcacctgtagtccctgctactcaggaggctgaggtgggagagttgcctgagttgaggctgcagtgagccatgatcacaccactgcactccagccttggtgatgaagcaagactctttctcaaacaaaataaataaaatggtacagccacatggaaaaagatctggaagttccttatgaaatgaaatctacccctaccctgtagactcaggaacttcatgcctaggtatttattcaagagaaatgaaagctgtgtctacaaaaagatgtgtacaagaatgtttatagcagctttactcataatagctgaaaattggaaacagcccatgtgtccgtcagtgagagaatggataaataacctgtggtatagtcatacagtgaaatagatgaagactacaacatggatgaatctcaaaagagtgctgaataaaagaatgatatagaaaagaatgaatgcttgggaggccaaggcaagaagatcacttgaggtcaggagttcgagaccagcctggccaacatgtgaaactccgtctctaccaaaaatacaaaaattagctgagtgtggtggcaggtgcctgtaatcccagctactcaggaggctgaggcacaagaatcgcttgaacccaggagatggaggttgcaatgagccaagatcatgccactgcactctagcctgggtgatagagcgagaccctgtctcagaaagaaagaaagaaagaaagaaagagagaaaggaaggaaggaaggaaggagaagacaagagaagagaagagaaaagaaaagaaaagaaaagaaaagaaaagaaaagaaaagaaaaggaaaggaaatgctatacgaattcatcctcatgaagtcacaccgtggagggatttactggaaagaaacataagggaacatctaatgttctgtatcttgatatggatttgggttgcagtgtcagaactcattgaatggtacacttaatatttgtgtattttgtgtacagattttacctcaaatgaaaacaattataaacaaatattgaactctaagtaatgatatgcatgctgaagtgtttgagagtaaagtatagtgatgactgcaatttattttgaaatgcataaaaaagatgggtcaacagctgaacagagggatagatggatggatgtttggtaaaacaaacatattataatgttatttgtaaacctaggttgtatgtatataggtattcactataaattctttaaacttttactttgaaatttttcatgataaaattttaagaagaaataaaacaatgaaatattgctttcaacattttaaaagagaattatcataaatctagattttacgttcagctaaactatcaaccaagtgttagagcaacatgaagctattttctagtttttcaaggaataatgaacatgtgttttttgcctcccaagaatctcttagggctccatccctaccctatgcttagttcctgtgcttcaggtgggatattcccacctctcaacattatggttaggcttatagctcaggtttggccaagtaagttatttcatggccctggccacagtggttgattcagaaatgagtcaagcaagttctatcaggcagtccacgggtattttgctggaactgtcaggagagttgtttttatttttgctagaatcacaatctttgaagaagagatgagcctagaaggatgctgatacctctattcgccagtacaggaagtgaccttgcttgagaataaagccaatacaaaggaaaacaaaaccagaatatggagagaaagaaacattgcagtgattacattgcgggagctcctggattaatctttggactttttagttatctgccctgtaagttccctttttctttgcattacttagagtaagggagatattaaccacatagtgagcaagtcatatttttcttcttgtagtgggatgaatagtatatacccaaaactcatgtctacctgaaacctcagaatgtgatattatttggagatagggtctttgcagatgtaattaattaaggatctcaagatgtaatcatcctggatttagggtagtccctaaatccaatgactgggttacatataagaagatgataagacacagagatacacagagaagaaggtcatgtgaagatggaggcagagatcggagtgctgacgctacaagccaaaaaatgccaaagactgctgggagccaccagaagctaggaagagccttcttcccttcattcctgaaaagggaaataaaagaaaaaagaaagagagaaataaaagaaaaagaaagaaagaaagaaagaaaagaaaagaaaagaaaagaaaagaaagattcctccttagaactccaagagagcatggctctgctgactttcagcttccaggactatgagagaataaatttctgttgttttaagccacctactttccagtaatttgttacggcagccctaagaaactaatatacctctaaataaagaaagataacaattagaaacacaggctgcctataagcccagcattttgggaggcccaggtgggtgggtctcttgagcccaggagtttgagaccagcctgggcaacatagtgagatcttgtgtttacaaatattacaaaaattagccgggtgtggtggcacatgcctgtagtcccaggtactccggaggctgaggtgggagaattgcttgagcccaggaggtccaggctgcaatgagccatgatcacaccactgcactccagtctgagtgagagtgagactctgtctcaaaaaaaagaaaaaaaaatttaaaaatgctgagaaaaaatgtccaaatatgaagcaagctaaaaatgtggcatgatttttgagcaactgaatgaaaagacagtctatttgatggatgttaagaacactttattgtgggcggggtgcagtggctcatgcccgtaatcccagcactttgggcagctgaggcgggtggatcacttgaggtcaggagtttgagaccagcctggctaacatggtaaaatcctgtttctaccaaaaaatacaaaaattagccgggcatggtggcatgttcctgtagtctcagctacttgggaggctgaggtgggaggattccatgaacccaggaggcagaggttgcagtgagctgagatcatgccactgccctccagcctgggcaacagagtgagaccctgtctcaaaaacaaaacaaacaaacaaacaaaaataacactttcttgtgaatggcccaggcattgtgataatggaacttgccaggagggcattattcctggcacaatattttgttctacagtgaacagtatttacatagtcataataatgcaaccctatatattggcattacactcttagaacaaatctataaaaataacatacactccttgaatattgtcatgcacagaatataaatgctgtccctcttgacaatgtgaaactaaagacatagctgacagaagttggaatgtggagggggaaagatacatgagagagagagtaaggagacaaatgatctcattttactttgtaaggagttaagaatattcatggcagcacaattattatgtatacataaacattaaaaattaacaaattagaagaaagaaatcagtgccaccagagaatagaaaaatgtttgaagaaaaaaggcaatgaatgacgaagtgtgtatttcttcaaagtactaaggttaacaaatgtcaagcacaattctataactggctaaacttttattcaggatggaaagagtaaaataaagcatttttatatattaaaaaaaaaaaaaaaagaggccgggcgcggtggctcatgcctgtcatcctagcactttcggaggccaaggcgggtgaatcacctgaggtcgggagttcgagaccagcctgaccaacatggagaaactctacctctactaaaaatacaaaattagctgggtgtggtggcccatgcctgtaatcccagctactcggaaggctgaggcaggagaatcgcttgaatccaggagacggaggttgcggtgagccgagattgtgccattgcactctagcctgggcaacaagagcgaaactccatctcaaaaaaaaaaaaaaaaaaaagaatatttaaagcatcattattcatagtagctccaaataaaacataacctaacctaaatgtccatcaacagtagaatggataaataaattgtgatataatataggcatacaaagaaatgttttacaataataaatgatagctacatgcaacaacatggatgaatcccacaaacattacattgagcgaaagtagccagacacaaaataatgctaactatataagtttgtataatacaaactatataaccatataagactatatttatataggttgaagaaaaacaaatctaatctatagtagcagaagtcaagatagtgattacccttgggaggaaaaagaaaatagtgccctagttatctactggtaagtaaaaaaccactctgaacttagcaacttcgaacaaccaccacaatgtgctttgccaacaagtctgcaatttcggcagggcttggaggggacagctcatctctgcctcaacagcataagcttggacagttcaaaggctgggggcagtgagggcgggtgttgttggggacttgagacttggaggtgaaatcactgggagtcttacccacttacatgtctggcagttaatgccgactgtttgctgggacctcagggactgttggccagaatacctacacttgtcctctcatgtagctgcatggtttttctttatcatggtggctggattccaagagcaaacatcccaagaaacaggaagagaaagctgccagtttcttaaggcctggcctgaaaactggcacagtatcacttctgcagtactctatgggttaagctgtcaatcttgattcaagggcaggagatagagacattatttctcgatgtgaggaatggtgtcaaagtagtatttggggactatattttataatcgctgtaagctttaattaggagcacatgagaggagagggtgcttctggggttctggtttcttgagctaggtggtgattatacaggtatcttcactctctaatgattccttcatctgtacatatggtttgtgcaccttcctgagcatatgtttcaactccaataaaagaaaagcttaaaaaggatgcaaacattctttatgtccagatatagaacaatccctaagacatagtaacatgctatcatggttaagtactgagctctgagggcttgcctgctgggttcaaatctagttctgccaatcctaggctttgtgtctcagttttctcatttgtaaaatggggattataatagctcttactccaggaggttatctcaaggattaaatgagttaaaacatgcaaagcattcagaatactaatagaaaaatagaaagtgcttgagaactgcttgctatttttgttatattaaatgaaaattgcaatttgtataggtaaagcagtgtctacagtatgatgccttatatggtttggctgtgtccccacccaaatctcatctcaaattgtagctcccataatccccttgtgtcatgggagggacccggtgggcagtaattgaatcatgggggtgggttttttccatgttgttctcatgatagtgaataaatctcacaagatctgatggttttataaagggcagttcccctgcatacctgcccttgcctgccaccatttaagatgtacctttgctcctccttcaccttctgccatgattgtgaggcctccccagccatatggaactgtgtgtccattaaacctctttttctttataaattacccaattgtgaatatttcatcataacagtatgagaacaggctaatacactgccatttgtgggaaaatgagtagacgtacccatgggtacaaactagctataagatcaggatatacaataaactaataacgttggttgcctgtgggagggagatttttcacagtgtagactttggtaccttttgaattttcaactatatgaaggctgcatctgggaaatgggtctgggtagggaagaggactgttgcttttttattgagtgaaagtagccagacacaaaaatttagtgttatattttctacaatgtacatgataaacatactaaaagaaaagacaagatgggtcagattacagagggccttataaaagaccaggcatggaaatttagagttgattaaggcctgaaaatggcactggcaatggtgataaaaggatgaatttaaacacttaatagaaaaaatctagaaagtaaaatatctggatagaaaatgatagaggtaagtgaagaggacacccaagttttggtgcgagtaactgttacggactgaattgtgcctccccaaaattcatatattgaaatcctaatccctagtatgcttcagaatgtgcctgtatttagagataagacctttaaagagatgattaaggttaaaaaattattagagaggtgaaaaagttattagagtggtctccaatccaatatgattaatgtccttataagaaaagggagagaaaccagaaatacatgcacaaaagaaaggccattgctgggtacagtggtgcatgcctgtaatcccaacaacttgagaagctaaagcaggagcattgcttgagctcgggagtctgaggcagcagaatgagaccctgcctctggtgcaaaaaataaaataaaataaaagccatgtgaggacccaccaagaagatggccatctgcaagccaaggagagagagttcaggagaaaccaaacctgccagaatcttgatcttggacttctgacccagagaactgtgagaaaataaatttctgttgttttagctatccagtctgtggtgttttgttatggcagcctgagcagactaagacagtgactaagaaagtgaccatgccatgaccacaggcaggaaagtgggaaagggagctagtttgagaagggaggtgattttgaattgcagcaccagccaggcatagtggttcatgcctataaccccagcactttggaaagccaagcctagagcccagccatgggaggtttgcctgaacccaggagttcaagaccagcctgggcaatatagtgagatgccatctctacaaaaaactcataaattatctgggcatggtggcttgcatctgtagtcccagctacttgggaagctgaggcagaaggattgcttgagcccaggagcttcaggctacagttatctatcacagcagcactgcactccagtctgggtgacagactgagacctcatctcaaaaataaatatgtaaataaggccaggcatggtggctcatggctgtaatcccagcactttggcaggccaaggcaggcagattactttaggtcaggagttcaagactagcttggccaacatggcaaaaccccatctctactaaaaatacaaaaaaattagcttggtgtggtggtgcacgcctgtaatcccagctactcaggagactgaggtgggaggatcatttgagcctgggaggcagaggttgcagtgagctgatatctgaccactgccctccagcctgggctacagtgtgagactctgtctcaaaaaataaaaaattaaaataaataaataaatacatatatacataaaataaaatttaaaattgcagccccagtgaaatatggcggctcacgcctgtaatcccagcactttggaaggccaaggagggcagattacctgcagtcaggagttcgagaccacctggccaacatggtaaaaccccatctctactaaaaatacaaaaattagccaggcatggtggcacatgcctgtaattccagctactcgggaggctgaggaaggagaattgcttgaacctgggaggcagaggttgcagtgagctgagacagagccactgcactccagcctgggaaacagagcaagactccatctcaaaaaaaaaaaaaaaaaagaaaagaaagaaagaaagaaagaaaagaaaaagaaaacagaacaggcctttttaaccgcagaggtaatggctacagggaagataatgtgactttggagtgaaaggatagagagaatagggagcaagggaatacgtagcaaaggaatggcaagagaaataaaaggcaataaaaagggaaggaactgctagcaaataggacagaagccaaggaagccgaacatttgaggtatgagaaatcttttttttttctttttaatgctgtagagagaaacagagaaagaaaaaccagaaaagaataatggatttaactaaaaagaggtctttgttgaccttttagaaaacagtttcagtgttgctgggaggatggaaaccgcattgccaagtatgcagtagatgagattgtggatagagaacaaatgcaaccccaaggcatttaccatccatttaagagcttaggtagcccacagaaagtgtgctgggggctgggcatgactatccacggagacctgttgtagcgttgaaggtaaatggggaaggaaccaatgaagtgggagaataaaggaagaccaagtagaagtgaagtcctctgaaggtttgcctaggatggttgggaacaccttagatgaatttattttagaaaggagggggataagactcccagagagggaggaggcaaggtggagagatggcgtaccaatacacagaagtagaaattagaataattgtaggagcttgagacttggtagtggcatacacaagaaattcattgaatgtgaagtaagggaatggaaggaaagcttgaggagagaaagaaaacccattggtaagattatgaatttcatacaggcaaaaattcataagaatttcatacgaattcggtaaaagataccaagcaatagtaatacttattcactaacaaaagctcaagcatctgtaaaacaaaagaaataacaaagaactaaagacaatctgggccgtttacgaaatccatgtgtgtgaccttaaagaagctctttcccgaatcattttctgttgttgcattgctgtttccagagttctggaattctatgccacaagctgaacattaaggtcattgatatcatctgaagccaggaagagtctctgctaggaagacttttagcacaaaatcaactattctctgctccaagtaaaatgtctaaactgtctgcaaaggcaaatggctaaaagctttgacaggaatacttcgttaagtgagattagtcatgacctcttagtaatataagcctgaagaaagaaatgaaagttggaagtaaagatatgagtcatgctgcaacttggtagctggcattcattcaggagctcaacaatgtcagcagatcttaggctccttccttctgctctgccagtccttattcttgttaactcataaattcaaaatggctgccacagctcccaacatcacagttcaaaggcagaaaacagggtagtcagggtaaaagtctttatccttctggggctactcttatcaggcgaaagattacctttcccagtagccctgtagtagacttcccctcaaatctctttgccatataactgactactcttagatgtaaggaaggctgacagaaggacacagaatggctatgactggcttagctaataatgactcatctgctagggctgggtacattccccagacaaaataaggcagtggggcaggagcagggaaatggctgttgagtaagcaacagtgtctgtcacagtgaatttagcccatatacatataagtttggtcttaattctgtatcaaattttgtatgatattttctgggtttttgttgttgttgttactttttgaacacttctctactggactgtattttctttgtgtttgcatgtgtgtgtttcctaatagtttatagggaaataaatttttgttctagtggttaccttataactacaagtttatataataaacctaatcctctttcttcaagcaaaaccagttgactccatactatgaacactgacaaaattagcacactatcacttccctttttctgctgttcttagtatttatcttcgcttttttttttttttttttttttgtagagacatggtttcaccatgttggccaggctggtcttgaactcctggcctcaagtgatccacccacttaggcctcccaaagtgctaggattataggcgtgaaccaccacgcctggcctttatctttgcgtttctaaatatacttattctattaggttggtgcaaaagtaattgcggtttttgccacgtacttgatttatcatctttagatgatttatttccatccctggctattaaaataatgaaatcagcacaacttaaactacctccctctcttcgtcaccttttctctccccactattgttcgttttatactttcttgatagcaggcgagaattagaaagaatgtaggtgcttggtacttttactgacatataagggagattttcttgcttaggaggatggaaaggagatggctttcactttgataatggaaccaaacgtatggcctggtcatgaaggaaggacaagcttctaacccaaggttattttcatgagatatgaaaggaaaaatatcagctccaggtgtgctggcacagagtcccagctactcaggaggctggggcaagaggatcatttgagcccaggagtttgagtccagcttgggcaacatagcaagacctatctctaaataaatcaataaataaagtattcagtactatgtggaactgaattttgaggaaagtctagtaggggagagatatgtagcttttcttcagcatccaacacaggatttaaatctgtggagaaggtggagttacctcaggttttttatttccttctgaatgtcataagtagatttggacctaaggctgtccaattccagagagcagtataaaatggggaaatcacttttgccctaagattagactgcagctttggtttcaccctgcttgttcatgcagttcctgcagacgttgaccttctagactgtctgcctagaccacacaggcctcgtgtctcctattcctcagctcacttcttaaaatggaacttcccttctcccacatcttataggacctgcgtcacctctttaattgtatattaatgagctcttctggtactcgacgtcttacctttctattagtgtccaccagcctcctgattagccacactcctagtctagtcctcaccagaccaccccgtcatatcaccgcttaaatcccagagtgccagttgagaaagtagaaagccagatgagaatgttgctctgaaaaccaagagggagatctgtgtgtgtgtaggaagttgtcccttataggattggccaacttttttggtaaagggtcagatagtaattacattagactttgcaggccctctagtctctgtcactactactcagttctgccattgtgtcaggaaagcagtcatagacaatgcgtgagcaagtgagcttggttgtgtcttgctctgtcgcccaggctggagtgcagtggctctatcttggctcactgcaacctctgcctctcaggttcaaacaattctcctgcctcagcctccaaagtagctgggactacaggcattcacagccacgcccagctaatttttgtatttttagtagtagagatggggtttcaccatgttggccaggctggtcttgaactcctgacctcaagtgatccgcctgcctcagcctcctaaagtgctgggactacaggcatgagccacagcgcccggcccaaaaaccattcttaactcccaggctgtaatgaaaaagaagatgaggcagatttggcctgtgggtcattgtttgccaatgactggtctataaaactaaatgttaaaagctgaggtaagatcaatgagaatcataatggacagagattctttagtttgtttgtttgtttgtttacagagaagatataagatccttaatgagctctacaaaaatattttggtgttttttgtttgtttgtttgtttgtttttttgacacaaggctcgttctgttgcccaggctgaagtgtagtagcatgatccaagctcactgcagcctcgaactcctgggctcaggcaatcctcttgcaagtcctagctactcggggattgctcaagtcctgagtagctaggactataggcatggcatgcaccactatgcctggctaatttttttcttttgtagagatgggggtctcgctatattgaccagactggtttcaaactcattcctggcctcaagtgatccacctgcctcagcctcccaaagtgttgggattacaggcatgaaccaccaagcctgaccccaaattatttgttaaatgagccctgtctcatggatttggggatcttaccatttaccccaactcaggcatatccaggtaccagaatgaaaaagaaggaacacctgagcatctgatccactcagcttctttgtctttctttccgaataagccagaaatgcaaaagaaactggcagaagattgttttctcttagtctggtctcatccgatttattttagcctcaaggaagacaggacttccacatagtctacaaaatattagagaactgttcttggtctgattgtgctttatcagttgtttgttagtttaaacggataacctgagctgatttttaaaacaccgattttacttggaatgtgccaaaactgtcattatgctttttattatgtataactttaatgactatagtaactatctggagaacactgagcaggtcgttatccagacatccattgttataatcattgccacatgctagacttgtttttttaaaataacctttttattttagaacaattttacatttacagaaaagttgcaaaaatattatagagtttccatataaccctcgctcactttcccccaatgttaacatttttacattctatggtacagctgccaaaataggaaaccaacatcgacacgatactattaactaaactctagtcttcatttgtatttcacctgtactagacttttgataataaaatcagtgttaagttgttacaactgggctgccattttataataaagcaggcataaaagatcagtaattagtttagtctctaaactaaattagattaagagtaggttatgtgaccaggggcagtggctcacatctgtaatactagcactttgggaggctgaggcgtgaggatcacctgaggccagaagttcaaaagcagcctgggcaacatagcaagacccccatctctacaataaaaattttaaaaaattagccatgtatggaagcacacatctgtagtcccagctactccagaggctaaggtgggaggattgcttgagcctggaagttcaaggctgcagttaaaggttgggagttcaagactccttgactgtgtcactacaacactccagcctgggtgacagagtgagatcctgtctcaaaaaaagaaagaaagaaaagaaaagacaaagaaagaagggagggagggagggaggaaggaaggaaggaaggaaagaaagaaaagaaagaaaaagcttatgaatgctcatctgacaagctaattaattttctgcattttactgatttaagtatccactttcttactccatgtagagacaacaacaataggccaggtgcagtggctcacgcctgtaatcccagttctttgggaggccaaggcaagtgaatcacctgaggtcaggagttcgagaccagcctgaacaacatagtgaaaccccgtctctactaaaaatacaaaattagctgagcatggtggtgtgtgcctgtaatcccagctactcgggaggctgaggtaggagaatcacttgaaccatggaggcagaggttgcagtgagccaagatcgtaccactgcactcaagcctgggcaacagagcaagactctgtctaaaaaaaaaaaaaaggagcaacaacaaaagccattgcctactgattcttcttctctcttagtctcaaagtccgctactcctcatcctaggcttaattcttaacgcagatgttgttttctcaatagcgacatgttccctgaagggaacgttcacctgccatttgggtattacaaggagttgaatatgcttttctcttttgatgcttaaaaaattagatacagatctttcaagcaagcaaaacagactaattagctctgtgaagcattatggctagaaatcaatgtgtgttgtctgtatttgacctgtgaatagggtttctaatagtcaactttaaattagctgtagaaatgggggagataggactttatcatggataaataacatcctacaacttcataataaagaaagacaacaggctgggtgtagtggctcatgcctgtaatctcagcactttgggaggccgaggtgggcgaatcacgaggtcaagagatggagaccaccctggccaacatggtgaaaccccgtctctactaaaaatacaaaacttagccgggcatggtggcacgtgcctgtaatcccagctactcaggaggctgaggcagaagaattgcttgaagccgggagttggaggttgcagtgagccaagatcgcaccactgcactccagcctggcgacagaacgagactccgtctcaaaaaaaaaaaaaaaaaaaaaaaagacaatattctgcttctttctccatcaaatcttgtctctaggtcactaacaagcaagatcatttttgccttttacctgcattccttcttctgaatagcctctgggtgtggttttattaaaactgcaaaagccggaagaactataactggaggatcaaaatgaagcagttcatgaagcagacatcctcatgggttctctcacataaagagtttctctccatcttcttacagatacgtgaaattccggtaataagggacaaaatggttaagctcttgatttgagactaaggatggagatggggccatttagaatgcccagattcaagaggcaagtagaaaggagagttgacgaagggtcccgagcagggacagctggaaaagcaggtgagtcagaagtgaacgatgccctggcaggaggaacggatttcaagatggagctcaacagtatgaaatatgccaaagagaggagcctggcctctgttgagtttcccagtcgtgaggctccagatggtgccaaggtgaagttgtgtggatggcacaccacagtccagtgaggcccactgagagggaggaagtagaaacagcagtgtggactctgctttgagaaagtgggctgtgagaaagaaagagacagatggtggtagctggagatgaacataaagttaagagaacttctctcctttttaagaaggctatgtaaggttgctagaaaaaggaacccatgtataggaagtcggaaaacaaaactaaaaactcaggaagagggagaggaactagaagaagcaagtgtcataatgactttcaaatggttcagtttttaaaaaacgatatacagagcgttaaataaatttgtcaagatgatgacagttgttgaatctaggcagagagtatacaggctttcataataatattctttccattttcatatacatttgaaaattttcaaaacaaaggggatgtgacaaatctgtggaccagccatatatggttgaaaattttcttttaaaaatattgagaggtatccaaatataatgtgaacataaaattgcaactgaaaagttatgattaaatgttcacagccatacctaatctaatggactgcagataatattgtgttatagacctataaaaattgtttcacttgaatttttgtattgcagtttatttaaactaagaaaaaaggtcatggccaggtgtggtggctcatgcctgtaatcctagcaatttaggaggtccaggtaggcagatcacttgaggtcaggagttcgagaccagcctggccaaccctgtctctactaaaaatacaaaaattagctggacgtgatgatgcatgcctgtaatcccagctatttgggaggctgaggcatgagactctcttgaacccaggaggtggtggttgcagtgagctgagatcgcgccatggcactccagcctgggtgacagagtgagactctgtctcaaataaataaataaataagtcataatattttcacacaatatacacttagttctttaagtgacaattgtcacagatagcagaaagacttaaggaatgctgcacttgtaatccatacaaaataccaatgttttgggtgatacataacgaaatatcacaaacacttttcaaaatatcatagtagccaatatatagggaatgactttggtgagcatagaagtttagaaaagaaaacaaatcacactggaactatctgatttctttaaaaatcactgaacaagaaaaggtacattgaacttcacataccgattttatataacttctgtacagtaccttgacttaaatccaagagcaaaagttaagactctcctttagttttggtaaacaactacaaggtaaacttggatgaccttttcccctggattttactgaaaatagtcttttacattttttatctaaaagagggcaggtttggcacttttataccgatgtcaccagtgttaatgtttcttggactcttgggagggtttatattctatacagctgatacagcatgggctgctaggttcctgtaaagccaacctttgtttttttcagcttattttgcacattaatttgtgtaacaagctcattcttgttggtctctgatctggtttgactctgtgtccccacccaaatttcatctcaaattgtaatccccacaggtcaagggagggacctgtaatccccacatgtcaagggaaggaggtaattggatcatgggggaggttcccccaggctgttctcatgatagtgagtgagttctcatgagatccgatggttttgtaaggatctcttcccccttcactcttagctctctcctgccaccatgtaagacgtgcctgcttccccttccatcatgattgtaagtttcccaaggcctccgcagccatatgaaactatgagtcaattcaatgtcttttctttataaattacccagtctcaggtatgtctttatagcagtgtgaaaacaaactaatacagtctctaataccattctcccaatatcatttctacaagaataatgtgagccacatggaagatgaaatccagttcacattttcaaaaacacttgcctaatgtttccacaaatactcaaattagatctaaaacaccaagttcattttctgaagaacccacacagaagacaaaatatgttattatgtgaggtctagaaatcagtttgttgtcctatcctccaattaataatccttcttctagaaacttacaaacattttcatctctcttaaataccaagtggaaagtctccctgatgatttgctgttgtgtgtcttcactgtagagctggtggaacttggagagctgtggcttcctgtggttgttgaaggtgacggtcatcttgatcctggctgggcagtgctggagcagcttccccacctggggatctcactggctatccttctcctcaacttggatgtttagttgtctttttatttctttgtttattgttgctattggctttgtttgtgggtttatttcttattttgggacttttagcacataaagttggagataatgaatgggaacagaatgggaaagagtggatataatgatacaccacatacccatcacctactttcaataattacctacactttcccagtcttcttccatgtattccccatactctattgtctatttttctggagaattttgaagtaaatctaatatatcataccattttacttgtaattattttagaggatatctctaaagataagggtttttctcatttaaaaaacacagccacaagtcatcaccacacctaaaaaattttattggggtaaagtttttttgttttttttttttgagacggagtcttgctctattgcccaggctgtagtgcagtggtgcgatcttggctcactggaaactccgcctcctgggttcacgccattctcctgcctcagcctcccgagtagttgggactacaggcacccaccactgcacccggctaattttttgtatttttagtagagatagggtttcaccgtgttagccagggtagtctcgatctcctgacctcgtgatccgcccgcctcagcctcccaaagtgctgggattacagggatgagccaccgagcacggcctggggtaaagtttttaatgtcttcaatagttcttcatattattttggctgaattttctgatatttttaattgaactaatacaatattgaggaaataataagtatctatacttacgcaaaggcctttaagaaactgaagtttaaaaggaaacactacctgtgataaaagataaataatggcactggtgcccagaaaaaataaaaaattaaaggagtcttttatataaaatctttaaaacatttgacatgccaatatcagcaagagtgtgggaaaacaaatattctcatagtgaagcagtgagagtgtgaattggatagtgtgccagtcagacggcatgttgaaagggtaactgaaggaagtttaacaaaaagattagttatagagatatactcagggttaggggaacctgcaagggctggtgaaagatccagggacaagaaactgcaggaaacagtttctacccgatctgactgacagggcaaagggagagagcttttcttgaaacatggtggggactaggtttggtggctcatgcctgtaatcccaacactttggcaggccaaggaagaggattgcttgagtccaggagtttgagaccagcctgggaaacagggagactctgtctctacaaataattttttaaaaacttagctggatgtagtggcagatgcctgtggtcccaaatactctggaggctgaggcaggaggatcaccttagcccaggaggtcaaggctacagtgagctgtgattgcaccactgcactccagcctgggcaactgagagagaccctgtcttattaaaaaataaaaatatgtttttaaaaaaggaacatgtggacttagtagccactggggaggagctgcttaatggaagctggcttctgataagggaatgtagccattgcgaaacagaggcctggggctctttccttctgccttcccatctcccacagaggtcctgaatggacactggatgctagagatttatagcctcctggagtacagagcagggtcaggacaggtagagtgtgtatctagagaggaaaacatgatccaacacaaaggacaatttgatgttatctgccagagttttgaatgaacacccttgaatctgcaattctacttctaagaattcactctacaaactcaaatgtatgtaaagttggaaagtttggaagggaagtattttatgttcgttgagagcttactatgtaggagcatcaagcaaggtactctccatttaatccttacaagaaccctatgagtttggcactattattacccctattttacactttaggaagtcaaggttggtaaagctcagacatttacccgtgctcacagttaataagtgacagcacaggtatttaaacccagacaatctgactccagtatctgagctacaaggaagttcatagcagcattgtttgtggaaaaaaatagactgaatacaaacttaaataactgtggtttggggatctggtaaataaattatggcacatctacacagtggaatactatgcagcttaaaaaatggaataggccaggtgtggtggtgcacacctgtagtcccagctacttggaaggctgaggcaggaggatcacctgtgcccaggaattggacaccagtctgggcaacatagcgaaaccccatgtctctagagggaaacaaaacaaaaccgaagaatggaatagatctacatatactgatagggaaatgtctccaagatacccatgtggggaggaaaaggtgcagagcattgtgcagtccatgcacccattagtacataaaaatgaaaggtgcattttaatttaatctctcagcagaaggactgataattaagggacaatttttcagtgtataccttttagcattgttttaatatgtgtattactttgcaatgaatacatgtaattaaataaaaagccacatacatacacatacaaatgtgtgtaaagtgtccggaacagaataataacagctaacatttattgagcactgttgtaaatttttatatgtattatctcgttgagttattcaaaagagctctattaagtaggtattattcttaccaccttgtattggtctgttttcatgctgctgataaagacatacctgagactggggaatttacaaaagaaagaggtttattggacttacagtgctacatgactggggaggcctcataatcatggtggaaggtgaaaggcacgtctcacatggtggcagacaagagaagagagcttgtacagggaaacattcccttataataccatcagatctcgtgagacccattcactatcacgagaacagcatgggaaagatctgcccccatgattcaatcacctcccactgggtccctcccatgagatgtgggaattcaagatgagatttgggtggggacacagccaaatcatatcaccctgattttaaaaatggaggaatgtggtcacaaagagatgaaagaatttgtccagtgtcacccagccagtctagctccagagccagtgctcataattccctctcaataaatgactactattgtttttaatgatttgtccaaagcagtattaactttttcaacagctgcattgtagagctggttccttttaatgcataatcaatgaaaactttagttttttccatcctatacttcatcttcatttcaaaaagaaactttaagttttttgtttgttttatgagttgcaaccaagcctggtcactacccctctggttttcagaaaaaacaaaaaaaaacaaacaataaaaaaaaattgttttaatctaaaaatatcctttacatttattctagtcaaaatgtcaacctgttgacatttgagactgagattccagcctgtggaggtaattgtgaatctttagtgaagccattatattagctatccctcctagttttgggtaatctttaaacctgataagcatgcctctgtgccagcatataaattactggtaatgttgccaaacaggacagtgatagggcagagctttgtgagatgtcacagagactcttggtcaagttgttcttgatgtatcaattcattaaccctgttcagattgtccaaactgctgagtcacctatcacatttcttcatcttgtctccaaggacaacatgataagttttgctcaccattttgctggaattatttctgttattcattgatttaccaccataactgtgcctccctacccaccccccagccatttttttttaaaaaagagtctcaattgaaagggtttgctcacagaacatatagggtggcttctattatcatctcatcttacataagtccttgcaaagtgcttgtacagtggtgtttgttcacaatttaccaacagccaattccaagtttactaattccaattttgattaaactttcttctctttttaaaaatttttgagggctgggagtggtggctcatgcccataatcccagcactttgggaggctgaggtaggcagatcacaaggtcaacagatcgagaccatcctggccaacataatgaaaacccatctctattaaaaatacaaaaattagctgggcatggtggcacgtgcctgtaatcccagctactcaggaggctgaggcaggagaatcacttgaacctgggaggcggaggctatagtgagctgagatcgcaccactgtactccagcctgggccacacagcaagactcagtctcaaaaaaaacaatgttgagtttttccccctcagtcttttggtttctctttatgtgtcctataatttctcagaataattatggtgacccagagcacatatacctatttctttagtattctaggtgttaccagaaaggggtccctgatccagaccccaagagagggttcttagatctcatgtgagaaagaatttggggcgagtcaacacagtatagggaaagcaagtttgttaagtaaaggaataaaagaatgtgtccatagacacagcaacagcgtgggctgcttgactaactatacttttagtatttcttgattatatgctaaacaaggggtggattattcatgagttttctaggaaaggggtgggcagttcccagagctgagggctcctcccctttttagaccatatgaggtaactacttcacgttgccatggcatttgtaaactgttatggcgctggtgggtgtgtattttagcatgctaatgcattataattagcttataataagcaatgaggaccaccagaggtcactgtcatcgccatcttggtttcggtgggttttagcccgcttctttatcacatgttgttttatcagcaacgtctttgtgacctatatcttgtgctggcctcctatctcatcctatgacttagagtgcctaacctcctggaatgaagtccagtaagattcagctttactttacccaggccctattcaagatggagttgctctggttcaaatgcctctggtgtagggctgtgttttgtctagttctagacacttaaattcatttttcaaatatctgcattgttatttgatactcttatatactctttttttttttttttttttttttttgagatgatgggagtctcgctctgtcacccaggctggagtgcactggctccatatcagctcactgcaacttccacctcctgggtttaagcgattctcctgcctcagcctcctgagtaacttggattacaagcgcctgccaccatgcccagctaatttttgtatttttagtagagacggagtttctccatgttggccaggctggtcttgaactcccgacctcaagtgatccgcctgccttggcctcccaaagtgctgggattacaggtgtgagccatcacacctggcctattcttatatactcgtttattgagtttcaatttttttctttgctaaaactgcagattactaaatattgctttataaaaaagatgaaggaaaataaatggttattttccttgctcattgttatctcttagcatttatgctaactgcatcaaaacagcagagaatactgctcatcctgtttattttttaaaattcaaatgtaattcaaatgtagttttaaaagccctttccctcacagtaggttgaagaagaaacaagagaaagtctttcttttccaatctccatctttgctcctgtcctagaagaggcgccgctaatctgattaggttctaaaacagtgaatggcacacttctgctacagtgagaggtcactaaagtgcacttttcccttttacttctcctgggacagcaggtgccttctaggcagagacatttgctcttttttctctcctctatttctctaaaccttcaggaatcctcaattctgctgggcagaaagactctacttatgtcctgagcctaaattttgtgctgcagcatagcttaaccaggatccctaaagaggcagttacaggaacctacttgaaaataaaggggaacctgctatggtgtcttacatgctgttatatcttgcaaacctccttctagaacctcaaaggaagtggagatggctgggccgaggcaggatttgggcattcttgagtccccagccgagggcgtctgtcgacgaaaagagtcaaactccgtaaaatatttgaagagatttattctgagccaaatatgagtgaccatgtcctgtgacacagtccttcctcaggaggccctgagaacatgtgcccaaggtggtcggggcacagcttggttttatacatttcagggaggtgtgagacatcaatcaaatacattaaagctatacattggttctgtccagaaagatggtacatctcaaaagcagtggtggaaaccaaaagttttatcaggcagatgaagcctccaggtagcaggcttcagagagaatagattctaactgtttcttatcagacttaaggtctgtgttgatattaatggcagagaggtgtaatgaggcatgtctaaccctcactttctgtcatggcctgaaccagtccttcaggttgaattttagagtgccctggcttaggaggccattcagatggttggggggccttggaatttatttttggtttacacctccttcatgagcatgtgaactgagctatcgctcagaagtccccatacaatgctctgctgttgccatcttgaagttatcaatattttttgcttaacaaggggacccaaatttttattttgcactgggttccaaaaattatgcggccagtgctaacctaatcctaataattaactgcactcaatcctaccattacttctaaaaaacacttccttttaaggaggaagatttaagtttcagtttgttcttggttttagcttttcaaacactgttcatgtaggttttgggaaatatactctttctttcatcttttgtataaaccttttacatttctgaactcctaagaaaactttgtactcacattgagatttttcaaaatttaaactagagcttgcttttctaattttcttaaacacttttggagtcttaagtcatggggtagattttgcttcttttcattgaatttttaaaatctgtttgccaaaggtgtacttcatacctaactcataaattcccaaaagaaaatgcattgagcaaatatataacacaaataagaaatcatgtaatttcccctaattttcccttcatctgaaggtacctgtcttagttattttcataagtctatgtagctacaccttgcttgccactagaactccctcttcattcaggtaggaggaaaatgattcacaaaccaatttctaaattatttatccagtctttctcaagaaaatagcctttcttggaatggtagaaagtaactttacttggccagatgcagtggctcacacctacaatcccagtaccttgggaggctgaggtggcagatcacttgaggtcacaaatttgagaccagcctggccaacatggcaaaaccctgtctctactaaaaatacaaaaattagcccggtgtcatgggcgtgcctataatcccagctgcttaggaggctgaggtaggagaattgtttgaaccctggaggtggaggttgcagtgagccgagatccagccatagtacaagtgagtgagactccatctcaaaaaaaaaggaaaaagaaaaaaaaaagaaaagagactttactatctctaatggatgtattatctagagtaaagtttagcaaaatacagtcttcaggccaaatccagccaaggcctgtttttgtactgcctgggagctaggaatgctttttatgtaattttaaggcttgtaacaaatgaatgaacaaagagtatgcgattcagaaagtctaaaatatttacaatctgaatttttacaaaaagaagtttgctacctcctgatttagagagcagtaacaatttgccttccctccccactgaagtcatagtagaaaaaaattaccctaagctatagttaaagaaacttgtggttgttaaattaaatttataggagcccattgatttagactgggctccttcaccaggcctcagtagatcaaaccaaaatggagtcacttatgctaaaattccaggccaccttggccaggcgctgtagctcaggcctgtaatcccagcactttgggaggcaaaggtgggaggatcacttgagcccaggagtttgagaccagtgggggctatatagggagactccgtctctacaaaaaatgaaaaaattacccagctgtgatggtgcacacctgctgtcccagctactcgggaggctgagatgggaggatcccttgagttctggaagccaaggctgcagtgagtggagatcacgccactgccctccagcctgagtgacagagcgagactgtctcaaaaataaaaagtaaaaataattccacaccaccaagacaaaatcaagttgtttgcttgaccttccaagaaatcaggaaatccaaatccccagataggccagttttagctggcatgacaaggaagtcccctctgctttaacctttacaaggaaagtaactgtgaaacaaccagtctctgttctttgtttctgctatctttggctatttatttatttatttatttatttatttatttatttgacagtctcactctgttgcccaggctggagtgcagtggcacaatctcggctcactgcaacctcggcttcccgggttcaaggattctcccacctcagcctcccgagtagtagctaggattgtaggtgtgcaccaccacgtctggctaatttttgtatttttagtacagatggggtttcaccatgttggccaggctggtctccatctcctgacctaaagtgatctgcccacctcagcctcccagattgctaggattacaggtgtgaaccatcgctccccacctcttcagcctttttctgtaagtaatacccaggttgcagaactgtattctctgaacttctggttctaagggctgcccaatgtgtagactgttctttgctccagtaaactgttacatttgttttgtctaaagtttttcttttgttgtggtcttcaacactcactgggcccttaatcccatagttcctggttctttctccctctctccccagcagccatttctaccaagttgaagagcactgcattgcactctccgttcgtggcaagcctacagtcctaactactaagctttctaggtgaaacgcttgtggtttgcactgcttgctataagccaacctggctgccccagtcaggagtcaaggcagcccagctcaaagtgagttcctcccactcagagaggtccacagggaactgtacccaatggggatgcttgttgcagtgaatattggctgacccctcccgtcagactttcttttagtgagtacaaatgttcatgagatctcctaaagggagctctccaaaaccccgctaggagatcagagctggcaccaggagcagaaaggccgggcagcgagagcagacacccccgagcctgcagggatggggcggggccaaggggggtatcccatgcccccaaggggagcgtggttcgggggagggaacatcccaggctcccgagggtgcaggctgcagagatgcccaggtcctgagcctgggagggcagccacagctgcaccggcaaagctcctgccccaccaactcggaagggtcggagttcctgcttttccccggctcctgcttgctccgtgaagtggaaggcctaggtctgcagccacaggttgggtggttgcagctgcacccaagtgggcagatcctgcctcttcctggcctcctccaagagaacagggaggcttccatccacagccacagttgggcagctgtagccccgcccaggagggtggggctcccaccagttgcatggtgtctgcagccccgcctcgcctccctgctgcagccagtgacagcagccactgccatcactactgcctgaaaacggtcttttgctggtcaattctgcacaattgcagtggttactgtcttcatatatgtgtgtcattgtttggatgtttgatcccttcaaatctcatgttgaaatttggtccccagtgttggaggtggggcctactgggagatgcttggatcattagaacagatctctcatgaatagattaattgggtgggtggtgggtgagtgagttctcactctatagttccatcaagagctggctgtgaaaaagagcccagcaccttctcctctcccctacctttctctttctcacttcctctctcaccatgtgatctccacacagcagatctcagcttcacctccaccttccccatgaatggaagcagcctgaggccctcaccagaagcagatgctggcaccatgcttcctgtgcagcctgcagaactgttagccaaataaatctcttttctttgtaaattacccagcctcaggtattcttttttttgagatggagtctcactctgtcacccaggctggagtgcagtggcgcatctccgctcactgcaacctccatctcccaggttcaagtgattctcctgccgcagccttctgagtagctgggattacaggcacctgccaccatgcctggctaatttttgtgtttttagtagagatggggtttcaccatgttggccaggctgatgtggaactcctgacatcaggtgatgcacccgccctgacctcccaaaattctgggattacagtcgtgagccaccgcacctggcctatttctgcttttatgcactagatgcaaaataaacaatgaaagcatggagactgtaaaggtggagaaagagaacttgagttacttcaaatctgtcattttgcatgtgaccacttgggatatatatcgtgcttaaaatttaaaacaaagagtgtgaactgagagttgtgatattttgtttggaaagtaaaaattttagttcatacttgaaatattttactgagtttgaataaagttgttaatagtaacatttgttattgttgtttaaaactaatgactcaggccaggatcggtggctcacacctgtaatcccagcactctgggaggctgaagcgagtggatcacctgaggtctggggttcgagaccagcctgaccaacatggagaaaccccgtctctactaaaaatacaaaattagccgggcgtggtggtgcatgcctgtaatctcagctacttgggaggctgaggcaggagaatcgcttgaacccgggaggcggaggttgcagtgagccgagatcgtgccattggcaacaagagcaaaactccatctcaaaaacaaaacaaaacaaaaaccaaaaaaacaaactaatgactcacaaacatgttcatatcagtagtatgatttagtattattccctaaattttattttttcctgtaacacagaagtattaatgcattattattttcttttttattgcaattttttttaaagaaataaggtcttcctctgtcacactggagtgtagtggcatgatcatagttcactagagcctcaaactcctgtgctcaagggatcctcctgcctcagcctcctgagtagctgggactagaggcacacaccaccaggcccagcttgtggttttctattaaacaatttttttactcacataatatatgtatagagttcaaaaacagaaaaatgtcactttctgcatttactttctggaattttattattttcttcatgattatttctgaagataattttgtcatagagtggaggtttttgtgttaaaaattatcccctgggtgggtgtctaataagctcagcacacctctggatatccttcctccagtccacctgtttttatactcctgtgctctcctgccttttcaaatgccacacttgttccacagccttatctgcctctccctcaccaccttcaacctttccctatctcgtggctcctttccagcaacaattgaacatgctcaagcatgtttaaatgttttcctctcttgacttttgcttcactgccagatttctttaaaggggtttctgtatttgctgactccataggttcactcgctactgtatctgcaatccactgcagtgtgatccttgcacccatatcgctgaccttctcttacaaagtccaagagcaacttcttattaataaagtgactttttttccatatttactgtttcttgacttctaacagttgattttttttttttttttgagacagagtcttgctctattgcccaagctggagtgcagtggtatgatcttggctcactgcaacctccgcctccctggttcaagtgattcttgtgcctcagccccctgagtagctgggactacaggtgtgcgccaccacgcctggctaatttttgtatttttagtagaggcagggtttcgccatgttggccaggctggtctcgaactcctggcttcaagttatctgcccgcttcgacctcccaaagtgctgggattacaggccttagccactgtgcctggcctgcttatttcttaaaatcctcacatgcaagatgccacactctcctggtttctattgcctctcgcgatcctgctttgcagcctccgttgctacctcttttttctctgcctgtcttttaagtatcagtggtcctcaggattgtcctgagccctcttacctccttctccacagtctccctgagtgatctccttcaccttcagagtgaggacagcaaggattcaagaagtggagcgatctttccagggtcacattatgatagcaccagggtaagggtcagaattagttcattctgtttaatgtaagtctgttgtgaaagacgtggtgctgagccttggggatacagacgcaaataggatgctatccttctcccaccaacttttgcaacctgcaagccctccctctcttcttccatttcatctggcccccgcctgtttagcgcctacttatccttcacatgtcagtttagatgtcgcttcatctgggaaacttttctacctacttctaagacttccttctctcaggtccttcataccttttacctactctcttgcatttctcacattgtcttctaataacaattaaacatacttttctgttcttccccactgggcctccctttcgcctctggttgagctgagaagagtaacacaaaccatgccactaggacccacaccaatgcttccattctcccaagaaggccaatggccagggcaatcgacagtaagttcttgagggcagtaggactgtgtctgtggcaccatcataccctcaatacctagccccctacctggcaaatggtaattgctcagaagttgtctgctttataatgattgaatgaaccacatgaccatgtgtccgcaattggtgggttcttggtctcactgacttcaagaatgaagccacggaccctcacggtgagtgttacagctctcaaggcagtgtgtctggcgtctgtcccttctgatgttcagatgtgttcggagtttcttccttctggtgggttcgtggtctcgctagctcaggagtgaagctgcagaccttcgcggtgagcattacagctcttaaagcagcgtgtgtggagttgttcattcctcccggtgggctcgtggtcttgctgggctcaggagtgaagctacagatcttcacagtgagtgttacagctcataaaagcagcgtggacccaaagagtgagcagtagcaacatttattgcaaagagcaaaagaacaaagcttccacaatgacgaagaggaccctagcaggttgccaatgctggcttgggcagcctgcttttattctcttatctggccccacccacatcctgctgattggtagagccgagtggcctgttttgtcagggcgctgactggtgcgtttacaatccctgagctagatacaaaggttctccactccccatcagattagttagatacagagtttccacacacaggttctccaaggccccaccacagcagctagatacagagtgtcgattggtgcattcacaaaccttgagctaaacacagggtgctgattggtgtatttacaatccctgagctagatataaacactctccacgtccccaccagactcaggaggccagctggtttcacctagtggatcccgcgccggggctgcaggtggagctgcctgccagtcctgcgccgtgggctcgcattcctcagcccttgggtggtcgatgggactgggcgctgtggagcaggaggtggtgctcgtcggggaggctcgggccgcacaggagcccatggagtgggtgggaggctcaggcatggcgggctgcaggtcccgagccctgccccgcgggaaggcagctaaggcccggcgagaaatcgagcgcagcactggtgggccggcactgctgggggactcagtacaccctccgcagccaatggcccgggtgctaagtcccccattgcctggggccagcagggctggctggctgctccgagtgtggggcccaccaagcccacgcccacccggaactccagctggctcgcaagcgccgcacgcagcctccgttcccgctcctgcctctccctccacacctccctgcaagctgagggagtgggctccggccttggccagcccagaaaggggctcccacagtgcagtggggggctgaagggctcctcaaatgccaccaaagtgggagcccaggcaggggaggtgccgagagcaagcgagggctctgaggactgccggcatgctgtcacctctcaactatatgctaaatgttggaatagaactttgagaaatgtcatctttcccaggcaaataaaaaattatagagtaggagagttattctttttggaggtggacaaagggactagctgatttctggaggtccctaccaatccaatgattctgagtttgatttaatatattccttgtgtggggaaatagtatcatttttttcttttttattaaaattccgaagaacattacattcttagtaatgtttaatgaaatgaaatgtttaatgaaacatgtttaatgtttaatgaaagtctagtttgctcagtaggtgagaaagatcaatataggttgttagatgaatgagtctttcaaattaaagatctgctttaattacattagatagcattgccacctagtgggtagtacaaaattcttcacggaactacatgccatgaatatttcttggtaaattattgtgaataaggttattaacgttctgaaactgaatctaaaccggctagttcaggaagaattctgttggcctgctatttactgtacgcaggagttccagctaacttcttatcatgaagtcagcagagatttcggataagaaaagttcaaaatttctccgagacttttgtccttataataaatcccactaagggggttacagaattatgtgttcaaaatatacttgaataaattttttttttttttttgagacagggtctcactgtgttgtccaggctggagtgcagatcactgaagccctgccctcctgcctcagcctccagaatagctgggataaaggtgtgtgccacaaaaactggctaatttttgtattttctataaagacaaggtatcactatgttgcgcaggttggtcttgaactcctgggcttaagctatcctcctgccttggcttcccaaagtgctgggattacaggcatgagccattgcacccggcccttgagtaaattactttctctgtgtggttacattatcaatttgctacacagttagaattgttttagggtttgctgtttcatccattcttatttaatgttttcgaacatttaaaaataaatatttcaagcatggagaaaaactaaaggttttttacactaaacacctgtatacccactgcctagattctaccgtcaacattttaatatatcttctttattgcatctacctatacattcctgtctctatccatccatcttatttttattttatttatttttttttttgagacattgtcacgctctgtcacccagactggagtgtagtggcgtgacctcggctcactgcaatctctgcctcctgggttcaagcgcttctcatgcctcagcctcccgagtagctgcgattacaagcacccgccaccaaacccagctaatttttgtatttttagtagagatggggtttcgccatataagccaggttggtctcaaactcctgacttcaagtgagtgatccacccacctcagcctcccaaagtgctgggcccatcttatttttaaataaacatttcaaaataaactgcattttggccagggacagtggccatttactttaaaaaccgaatctggaatctaagaaaaattaaccattttgggccaggcgtggtggctcatgcttgtaatcccagcaacttggaaggctggggtgggcagatcacctgaggtcaggagttcgagaccagcctggccaacatggggtaatcccgtctctactgaaaacacaaaaattagctgggtgtggtgatgagtgcctgtaatcccagctattcaggagactgaggcaggagaatcgcttgaagttggcagaagtggccgagatcatgcgacttctgtcagcctgggtgacagagtaagactctgtctcaaaaaacaacaacaacaacaacaaaaaaaccccctgcattttacaaaacatttaatagttcaaaagtgaaaaattaggttgggcgcagtggctcacgcctgcaatcccagcactattcccccatcctattccgcactctcttaagcaaccacaaacattttctatttttcattagtttcagatgtagcctttctctgtgggtttttgtagttgttgttgttggtggtggtgatggtggttagacagagtctggctctgtgcccaggctggaatgcagtggcaccatctcagctcactgtaacctcagcctcccggattcaagcaattctcctgcctcagcctcccgagtacctgggactaaaggtgtacaccaccacacctggctaattttttgtatttttagtagaggcagggtttcgccatgttgaccaggccggacttgaactcctgacctcaagtgatctgcccacatcggcctcccaaagtgttgggattacagacatgagccaccatgcccggccatgtgttttttgatttttgttttccaagacggagtctcactctttcacccaggctggagtgcaatggcacaatattggctcactgcaacctctgcttcctgggttcaagcaattcttctgcctcagcctcccaagtagctgggattacaggcgtccaccatcatgcccggctaatttttgtatttttagtagagacagggtttcaccatgttggccaggatggtctcaatctcttgacctcgtgatccacctgcctaggcctcccaaagtggtgggattagaggcgtcaaccaccacgcccggctaatttttgtatttttagtagagacgggttttcgccatgttaaccagcctggtgtcaaactcctgacctcaagtgatctgcccacctcggcctcccaaagtgctgggattataggcatgagacactgtgcccggcatttttttttttttttttgagacagagtttcactcttgctgcccaggctggaatgcaatggcacaatctcggctcactgcaacctccgccccccgggttcaagagattctcctgcctaagcctcccaagtagctgggattacaggtgcctaccaccatgcccagctaaatttttaaaaatttttagtagagatggagtttcaccatgttggccaggctggtctcgaaccccagacctcaggtgatccgcccgctttggcctcccaaagtgccgggactacaggcgtgagccactgcgcctggcctttttttttttttttttaaataagcaaatacatatacatattctcctttctttctttccttcatttaaaaacttttttttagaaatagggtctctctgtgccatgcagactggggtgcattggcacagtcatagctcaccgtaacctcagacttttgggctcaagtgatcctcctgcctcagcctcctgagtagctgggactacaagcacatgccactgcacttggctaattttacttacttatttactttgttattattattattattattattattttgtagagacagggtcttcctatgttgcgcagactggtctcaaactcctggcctcaagtgatacttctgccttggcctcccaaattgctgagattacagatgtgagccactgtgcttggtgtcttatgtctttcttatgtaagaagtagaggccaggtgcagtggcacacgcctgtaatcccagcacttcgggaggccaaggtgggcagatcacgaggtcaggagatcgagaccatcctggctaacacggtgaaactccgtctctactaaaaatacaaaaaattagccaggcgtggtggcaggtgcctgtagtcccagctactcgggaggctgaggcaagagaatggtgtgaacccaggaggcagagtttgttgtgagtcgagatggcacgactgcactccagcctgggcaacagagtgagactccatctcaaaaaaagaaaaaaaaaaaaaaaagaagcagaatagtatgtatgctcttccactctgctttgtgtgtgtgtgtgtgtgtgtgtgtgtgtgtgtgtgtgagatggagtctcgctctgtcgcccagactggagtgcagtggtagctgggactaaaggcgcccgccaccatgcctggctaattggctaattttgttttttgtatttttgtacagacggtttcaccgtgttagccagggtggtctcgatctcccgacctggtgatctgctggccttggcctcgcaaagtgctgggcactctgcttttttcatttaaggatgtatcccagaaatttgttcatctcagagatcttaaatttttttcatgactttatactactaccttgtgccgatataccataatttattcaactcattgcctatagatgtgcgattaggttagttccaatatttaggtattataaataatgctacagtgagaaagtctagagtaaattcctcgaagtggatttgctacatccaaagtcaatgtgcatgtcattgtagaaatgccttgtcagggccaggcgtggtggctcatgcctgtaatcccagcactttgggaggccgaggcaggcgaatcacttgaggtcaggagttcgagaccagcctggccaacatggtgaaaacccatctctactaaaaatacaaaaagttagctgggtgtggtggcaggcacctgtaattccagctactcgggaggctgaggcaggagaatctcttgaacctgggaggcagaggttgcagtgagccgagatcatgccattgcactccagcctgggcaacaagagtgaaactctgtctcaaaaaaaaaaaaaacaaaaaaaaacaacaaaaaaaacgccttgtcagatacagacaaattcccttctacagggcttttaacatttgacactcccagtagccatgtatatgagtgcttgttttctcccagcctcatcagtagagtattttattagttttctgttgctctgtagaaatttccacaatcttagtggcttaaaacaaaacatgtattatctcatactttctgcgccacaggaatctaaacaaagttcagttggaccctgagctcagggtcttacagagctgtaaacaaagtgctggccagtgcattgtcatctagaggcttcattggagaaggatctgcttctaaactcattccaattgttgggagaattcatttctttggagacataatactcatggccgcttgcttcttcaaggccagtaagagatacatcaaaaaaagtctaagccctctgttgaaggacatcctaatgattacgtcaaggccaacaggataatctcactttcgataatttaaagtataccgatttggggccttaattacaattataaaatcccaccacctttgccttattgaataacctaatcataggcataatcagaggtcagagataatgggtggcattttagaattctatctactgtaagtatgttgtcaagcttttctatagctgctagtctgatagttgaaatagtttttcagagttttaatttgcatgtctcttattctcagtaaagttgagcatggttttgtatgtttaaggaccattcctctatcgttttctctgaaccgtccattcctgtcttttgccgatttatctattgggctgttggcttctccctctcaatgttttatagctctttaaaaattagggaatgtagtcttttatgtgtaaaagaaattccctatattttctcttactttatcatttgtctttgcttatggaaatcatccgatttttaaaatacagacaatttccattttaagacaatgtgtaggccacaattgtgtatgtgaaacaaaacatatttaatgcccaggggccaccttctagaccatcttcaatcctttaaataattctgcactaaaataatcccctgaagatcctgagtatattattctttttttttttctttttgtttgagacgtagtctcactctgtcgcccaggctggagtgcagtggcgcgatctccgctcactgcaagctctgcctcctgggttcacgccgttctcctgcctcagcttcctgagtagctgggactacaggcacctgccaccatgcccggctaacttttttttgtgtttttagtagagatggggtttcaccatgttagccaggatggtctcgatctcctgacctcgtgatccacccgcctcggcctcccaaagtgctgggattacagggtgagccactgcacccggccaatcctgagtatattattcttaacatcatctgagtctcaagtcccaaaaccttcattagtaatgtgtttcatcatttcacttctcttagctgtgcttatactcatcaaagaaatggtttgtcaaaaaataaattggtgcaatgtaattattatttatccatctgaataaaaataaaaataaaaaaattggtgtaaatatttgtggttgctaaagttttgttttgttttgttttgttttgtttttgagatagagtctcactctgtcacctgggctagattgtggtagtgtgatcttggcttactgcaacctccaccacctgggttcaagctattctcctgcctctgcctcctgagtagctgggattacagacgcatgccaccatgcctggataatttttgtatttttagtagagacagggtttcaccatgttggccaggttggtcttgaactcctgacctcagggtgatccgccagcctcagcctcccaaagtgctgggattacaggcatgagccatggtgcctagtggttgctgaaatttttatggctaaacattttccagtatttctacctccttatcccatcatttaatcctttttaaattaatattttaaaaattttattattggccaggtgcagtggttcacgcctgtaatcccagcactttgggaggccaaggtgggcagatcacacgatcaggagttcaagaccagcctggccaacatagtgaaaccctgtctctactaaaactacaaaaaattagctgggtgtggtggcgggcacctgtaatcccagctacttgggaggctgaggcaggagaatcgcttgaacccggggggggcagaggttgcagtaagccgaggttgcaccattgcactccagccctggtgacagtgcaagactccgtctcaaaaaaaaaaattattattgaaaatcccaaacagatataaaagtagagggagtgaataaaaaatcttcatgtactcatccatactagcctcagcagttatcaacacaaggccaatactgttttattcgcaccagtggttctcaactggggatgattttgccctgcggaaggttatctgacaaggtctgcagacatttttggtcttcacaattgggatgtactcctggtagctagagggtagaggccagggatactgctaaacagcatacaatgcccaggacagcccccaccacgaacaatttgcccagtctaaaatgtcaatagagcccatactgagaaagcttgatttataccttttcccttgcttctctcaataattatttcaaataaaatatatggtataaaatttcatctgtaattaccatttataggtagaagctattacaataaaacccacaatattgtcattacaactaatctctttttttaacccattgctcatcaggtaaccttaaacaactcatatcttaccatcccaaaatattcagtcagtgttcaaatttcccttgggtatttttttaaatacagtgtttagttcagacgagatccatacattgcatttggtaatatgtcccttatttgtactcgataacgccttccttctgctttttatttttaaaatattttaaaattaatttttttttgagacagggtctccctttgtctgtagtcccagctactcgggaggctgaggcaggagaatcgcttgaacccgggaggcggagcttgcagtgagccgagatcgcgccactgcactccagcctgggtgacagagcgagactccgtttcaattaaaaaaaaaaaaaagaaggaaaaggctagacgtaattattaccaaggtgtttctgctccttcaaattgcaacagcagttgtaatttcagtgcctagaacagtagtaattggcacgtataaggcgctcaatgaatagctgcaggattaactgataatcggttgtctcctgaacaattcctaccgcaccacaccatagtcaaaacacaaaaagccaaaatataaaagcccctaatacaactacgagtccgtggagccagggctttacacaaatatatgtcgtgtactacatattaatatatatgcacatacaatattttgttcttctggtgctaacgactaatggaggcaaatctttctccctttcgtaaagggctaaaactttgcattttaaggaagttccaagagcagggtcggaggggagggtcaaagggcacaggcctcccagcccgcagaaaacccccacggtcctcaagtactcgctaccgttgaccgcgcaggcgcaggaaggggcggggccgagggaagaggcgattcgcgggatccagaggccccgcccctcgtctgcgtcagttggtcacgtggttgttcggagcgggcgagcggagttagcagggctttactgcagagcgcgccgggcactccagcgaccgtggggatcagcgtaggtgagctgtggccttttgcgaggtgctgcagccatagctacgtgcgttcgctacgaggattgagcgtctccacccagtaagtgggcaagaggcggcaggaagtgggtacgcaggggcgcaaggcgcacagcctctagacgactcgctttccctccggccaacctctgaagccgcgtcctactttgacagctgcagggccgcggcctgggtaagggcgaaggggttgttgaacggtcgcgggagccggggcggggttgggaggtgagtcgagggactgccccattggctgggtcggttttggcgcgctctcacttccgcgcttcctattggctggctggcgcagttcccgaggcgcgcgccgcggttggtaggctcggacgcgcggggccacactgcccgccccctagcctggcgctgggcctccgggacaagttggctgggtccgggcttggggactgcaacgcgggtaagggactcagcctgggcttgccagctgtggggatgaggcgaagcatccatcctcttggcagttaagtggctggtcctgatctgagggatctgcaaatttggctcatggaaagaggtggctgaattctgcgtctcccattaaacggatactggcgttgttgatacgggtttcgcatggaccctgtcctgtgccagggtttttaatctagctattaaaggaactggagaataacaagtaagggttgcaaggtcgctgacaggcgtgggaaacttgtgaaggattagaatgctaagtggctttcagcttttttcacactaaggtacgttttacgtcgcaacctaggacacagctatctaaccaaatgagacgtgatggaagcaatgtttctcgtctcttcaattccattctgttcagttgcatttttctaagcagtgttgctcatgactcactaatttcgagatcacggcccgcgacccgcagtttgaagaacattgcgtagggtctgtttactggggcccgaacaccattttcttaacatgaaatagagtagaaaatagcaggatgcccgcacaaattagattgttttgttttctaagctttttttttttttgagacggagtctcgctctgttgcccaggctggagtgcagtggcaggatctcggctcactgccacctccacctgtcgggttcaagcgatactcctgcctcagcctcccgagtagctgggactacagacgagcaccaccacgtccggctaatttttgtatttttggtagagatggagtttcaccatattggccaggctggtttcgaacttctgacctcaggtgatccgcttgcctcgaccttccagcactttggtgatcatgcaggtgatccgcctgcctcgacctcccaaagtgctgggattacagatgtgagccaccacgcccggcctttcctaagcttttttgtttgcacatgtgtgtgcacgcgccaggacacaaggtaaaatgtattaatgttagaagccactgcactgagtaaaggcatggccacaaaaattagggacatctatcgacgaggcacaggcgcagacacggcaggggccaatgggtagtgggcagtgggcagtgggcagtggagcagcagttcagatgctgagtttggcccagtggtctagtcaaccgcattacatagatccctttctaccttttccctctttcttgcttgttagtccttcagttcatgttactggttaaacatttcctacaaatgtaaatgcatgatctcatttgaccagatattaagtctgtgttaagttattgtcagagcccagtttattataccttaaatctgtctttgaatcaggaaagttaagatgctgctctttaggatggacctgggcataccctagtatctgtttattttgctttttctggtgactatttaatccaggacaatatgtttagaaattttaaaccagttttagaaattggtttaaaatacattaatttcattttttcagctataattattatgtgtgtatatatgtaaaatatagatatcaagagtcattaactttagtcaccttagtcattgacagggctgagtttggattaagagagaaaaaataatagttctactgtacaatagtataatttttatgattgtaagtattttaaacctagactccaccttcgggggtgcaaaccatattgttttttaattactagtcttctgtgcttcaccatctacataatgaatcccagtatgaagcagaaacaagaagaaatcaaagagaatataaaggtatgtgattgaataactttaatttttttttgtagaaagcatggggctaaaagtattttgacataatttatccaaatttagcctggctataatttctgtaagccttgagttagtcagaggatgagtaacaatagagaacatttttaaaaaactaattacggttgaatattaagtctgacccaagaatatgggttgtctctcttattttggtctttcaacagtattttgtagttttcagagcatgaattttacactatttatgttaaattttttcctaagtattctttttgaggttactgtgaatggaattgtttccttaatttcattctcatttggtcattgctactgtataggaaaataattgacttttgtgtcttgattttgtgtcctgaaaccttgctgaacttaatagttctaattgttttttagtagattcttcaggattttcttttctttttgtattttctctgtgaagattccagaagtatctttaggattttctatgtatgagattattactgctttgtttctactcttatatttcatgaaatgttattaaaatccattgtgtatatcttcagaattaagagtctttgaccacagacatgttttgcattatattacacatttttctagagtataccatattcattaccatctaacctatttgatttgtgatactttttcaatccctatatgatactttcactggaaatcttattccaagtatttactcttatgacagcaggacagagtttgtttagttttgagtttatacttctgactagattcatatttatggttctaagttaatttacaatttagctaggtccttccacacaacttaaattatatgaataccttgggaattggatcacatcttcaggtaaactatcaatttgcggttttaaataaataaagagccaggtgcccatggtggctcatgcctgtgatcccagctacttgggaggctgaagtaggaggattgattgagctctggactttgagaacagcctgggcaacaaagggagaccctgtttctaaaaaaccataattagctgggtgtggtggcacccactggtaatcccagctactgggaggctgaggtgtgggaggaattgcttgagcctaggagtttgggctttggtgaattatgattgcttcactgcactccagcctgggtgacagagtaagaccctgtacctaaaaaaattttttttatattaagtaaattaaattgagtacctaaaagccattgataagtataagcaagtaccttttgatgggttttttgtttgccttgcttttcttaggattcttacaatatttttcttgaataagaatgtcaattgacattatattcgcattgacaatttgtgaatttgattccattagcttccatttaggatgatggcatcttcccactgtgctttgtgtgtgattatttaaaatttttgttatgaaatttttgaaatatttaaaagtattttaataatttacttccccagcttcagcaattaccgctatatggccaatctggtttcatctatgtccttatttactccacttttccttcagtggattaatttgaagcaaatcacagccaaataatttatatatttccagcagattacattttaaagaaagtcttgtgtttactagctacagtgaaactatcttgaatataaaggatactaggttctgtttggttttggttctacctccaaaactgagaccttgggtgggttagttagcatttcagccttagtttactcatctgtaaattgggagaactggactagaactagatccttgtgagttgcatgcaaaattctgtgtgaatgtgcttttatgtgaatttttttggggagaggattcacagagtattaaatagttttccaaaaaggttaagacccattaatatacaagaaactttctggctttaagagtctattattccaatgcatactctatatacagaaaataataatagtaatgttacattgttttaggcaaaagtctatatagcttatataaataaaagttaaatcttggaaatggtctttttttttggtgacagttacttagctggcttctttgaccattattaacagaaagcatttaaataacacctcttgttagtaaggttccaacgttacattttcttttatttgtctggagactgttgactaatctataatctaaattatatctgaaatgttgatgtaatatttgtcctcacagtagctggcatttgtccttcagttaaatggtgagataataatcagcagtagaaactttaccgtgggaaaggtgaactcttatcatgtgaagtacagtgtggaatcagtaactttctcacgctggtatggtatcatgttcttgctaaccttgtttgagtattcaccattgtttgctatcccatggtggcagtataactaatgatattttgcaaaaataggagagaactttcagatcatgaaatatacaggaagttgtttacatattacaaggaaggcaatattttcaccaaaacaatagcttgggcattttagagtattttagtatgcctcaggcactgacattttagccaccttctaatgaatgggcttgaagcagaactgcttctactatcaggtaatggttgaggggggatgtctattacacatgtactttgttttgtgtaaagtatgttctggaaagttacattcttttggtgagtacatgtaagtatttgagggatattcatgatttaaggaggcctgaaatgaatctttttgattagggaaagaaatattttgcagtgtaaatgattaaccatttcttccagtttacctgtttggtgagttcataccataaatgttacgatgtttggttttataaaagagtacctgtaagtttttagtttctgtgtggaagattttttcagagagaatacagatagccttcttgtattagaattttgtcatatgtggtttgaaactgttcattggagctgaggaattttgttacgtttgttttaactagatatgattaacaaaatgaccatagcaagagcatgcattgaaatgagagaagttacgtgtgtttgtgtctagtttgggtaatatgattcattcttaagaattcttcaaactttattataatttttggaaataacaagtttgtcagttgattaaaccagtgtcttgttcataggcgaccttacgcaattatatagcagaccaaatgtttgtgttgttagtgttccttttccacccctaaattatagaaggactaagagtaacactccatacagaaactcagtaactaaataaccatattgcaactcagtaacaagataatgaattatgctgactttttagaatagttctgtcccaagaagaactctgaagatgattcagccttctgcatctggatctcttgttggaagagaaaatgaggtatgcactatatggctaaaatggggtactggtgatacagtgtctacatcgaaaacatttctactattttcttggtcagaaacacgtaaattgttgaaatttggaaataatttgggaatcacaattatatatttcccaaagaagtgattttggttttaattgttcaatttaagaagttcgtcgggtgcagtggctcacgcctgttatcccagcacttagggaggccgaggtgggtggatcgcctgaggtcaggagcttgagacaagcctggccaacgtggtgaaaccccatctctactaaaagtacaaaaaaattagccgggcgtggtggcacacacctataatctcagctgcttgggaggcttgaggcaggagaatcacttaaacctgggaggtggaggttgcagtgagccgaggtcacaccactgcactccagcttgggtgacagagcgagactctaaaataaaaataaaaataaaaaattttttaaaaaataaataaataatttcagctaagctcttgaccccagtctaatccaaaataattgttgcaaataaaattcctaaaatgttactatatgttttggtagaatttttaattgtataacttttttaaagatccagagatgtgaaaaagttagatatgcgtactctttttttaatacataaatgaaaaaccacctaatttcttgttaattaaatcaaagtaaatacagttgataagtgttttcattatagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaaggtatgaaaaaatagataacttttgtcttaattttaaattatgatataaggaaaaatttgttaatactattatgaattctgccaattactgtaatctggggatagtataacagcactataaatgtttttgtatgtgaccatttgtttgacaagatccatgtgtggatgaaatgttaggaaaaggaggcccagtgcagtggctcacacctgtaatcccagtagcttaggaggttgaagcaggaggatggcttgagtctagaagtttgagactagcctggacaacacagtgaggctctctctgtatgaaaaaattagctgagcatggtggcttgtgcctgtattcccagctactcaggaggctgagtcaggaggatcacttgagcctaggagtttgtggccgcaataagctatgtatgatagcaccactgcactccagcctgggatacagggcaagacccggtctctgaaggaaaaaaaaagggtagggggaaaggatagttattaatatgacagctctgataattggattgccttgtaggggtttacaagacttggaaataggctttttagaagaaaaatgtttagataatgagttcgaggtatgaaaggaatttgaatattccaggagagtatggcataaggaaaccaataaaaatatggatgaagagtaaagatgaatgagaagaattatgcctataataagtactagtttttaatagaatggtagtatacatcagaagaagaagcaactgatgttttgtaagcattatggaagattattatttctgtatgaattatgggtcattgaatgttaagtactgatgataaaattgaggcctagagaagttaattgacttgctgaaggtcacagtaacatttggactcattttgaattgccttgaagacaggaagaagagaaatagatggtaggatttttattaggcaaaattaggaaaggttgactggatagaaataaagcagctctttaaaaatattgtagattgaagagcaggatttgtgacactcatatctgattaggttaaaaattaaatcaaggattagttaaaataaactgctaaagttaaatatcaagacaaataactatatatcatgttggtaatataaccacaggtggaacacattatccttgtaaccctctgcgatacatggtaaaaattaaaataactgcgaagaaatcccaaactttattacatttgttgtttgaactttattatatttgttgacagtggtattagtgtaattttgaaaaaaaaaaaaaagttgtgtatattttaggactgagcaaatgaataacatgttgaagtattacatttcctagcactgcccctaaacaggtagaaacaaactacacctctgtagaaaggagcacaccgtgtatccagttcttggtttataaacactattcttcactaaagttccatggagaaattgctgattccaggtcaggggcagggaaactttgggtgatcatggattatcttttgacagaaaataaggaagtactcaaaaacgggtggacatgttgaaagaacacatgtcatcttggaaggattctcacagactacagttgggaaaatttgagcatcaaaatgaataacgtcaagaatggattataatacattgaataaaaaaggatatatgagtctatactgataaattttcttttaaattggggtaggaaaagtttttatttacagaataatgctaactactacttgtagaaggaattacataagtgaaaaaaaattggttttccatccaccgtagaagtaatagatataagccggaaacatcaatcatcaatggaattaaacttaggtaaaaagttgttggaggacagggtattgacacagtctcaaatattttgctctacagatcattagttaattactaagggaaaaagttatctttacaaggcagaaatctgatagatagcatcttaatcaaatgatcaaatttaacatctccagtatcatgacaaattggcgtgtgcttcttgatgatatactgaggatacatacttatatagtattcttatactatacttatatagtattcctgccaaaaatgtttagtttgaatctaatcatggagacagaaataaaaaattaaggacagtgtacaaaataattgatctggactttgtaaaaatgtcagtgttacataaaaagacacgacctcacaaaacaaatgtattgcaaaaatctttaataatctaggtggaagatatatacgtattgtacttttgttgtaattctgaaggattgaaatcttggaaatgttggggaaaatagaataatattgattttattttttaactttaatcttttaaaaatgagtattactaaacaatatgggggtactaagattggaaatttttttgaaacaaattactgggttttgacagtaatgatttttaaagttatatttaaaatattattttagaaaatccatcctctcagtattggaaggaagtggcagaaaaacggagaaaggcgctgtatgaagcacttaaggaaaatgagaaagtatgtattgagtataatttgtaccatttttaaaaattccaggattgttttgctgcttagcatattttattagagcaatatgggctagctttagtattggcttaagaaaagtttaagtaaaaaggcagctcttgacaattatacaaaatgaatcccgttgtgttgagagtcaattctatgctgcatgtcctccatgttatatacttggaggtatgtaatttgatttatagcatagcaaatctatggaatactgaactttatttatgtaatacagcttcataaagaaattgaacaaaaggacaatgaaattgcccgcctgaaaaaggagaataaagaactggcagaagtagcagaacatgtacagtatatggcagagctaatagaggtaggtaatttaatagttatctggttcaaatttatgtatttttctataaagttgaggtagtgtagtgtgatcactttgaagtgttagggctctggaatcagatttcctggatttaagacttaacttccttcctaacaccattaagtttgctgggtagagtgggtttatccggtcagggcttcatcttcctcatccacaaaatgagagtaatgatgcctaccttatagacttgttatgagaattaaatgagttacaatagatggacaattgcaaggagtacttgcacagagtgaaagttcagtaacttaattattgttatgaagcaaaagaccatattttttggtagagttattaaaaggaattatccctggaaaatatgtatagcaaattatttcatagttgacacattttagatagttttaattttaataccagcttgacattactgtcatttataaaattgataatttgtacaataaatgagttttgtggttttatctgactttaaaacattttgtaagtagctaatatgtttgtaagaattagcctggtgttgctttatcagacttgaccttaaaaaggttttaagatttatttattcatgtttgcaaaaagtttttcttgctgataggaagaaagtttttcaaatcaaaacttcatgtaactgaattgtgaccttttacatttgagatccatgatagaattaatatttgaagttttcatttggagatactgtggtagctgtcttaactgccttaaaagaattagtccacagctgattggaaatgtagaacacctacttgtccttgcagctgattggggaagtacctgtttatactctgaaataatttcagtgctttttaaaaaaaaaagacaaattattaaacactttgactttgctgactatgatctagcatggtagagactttgatataatactgtttataaatgaatttattgaggggcaagatgaaaaaaatctcatagctatatcagtatgctatacgggtcagctatatcagtatgctgatcagcttaggttttaacatttttacaataaattattggtttattctttaaaagagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatgaaatgcattaatatttgactgttgagaattttactgccgaagtttacctccactagttctttgtagcagagtacataactacataatgccaactctggaatcaaatttccttgtttgaatcctgggaccctattgcattaaagtacaaatactatgtatttttaatctatgatggtttatgtgaataggattttctcagttgtcagccatgacttatgtttattactaaataaacttcaaactcctgttgaacattgtgtataacttagaataatgaaatataaggagtatgtgtagaaaatttgtctgtttctatgcttttatgttgttctctttccattcttttgctaactaccttggaggagacaaggagaaaacgaacttaaagtatttagactgagatagctgaggtttttaactcccaaactttgttgtacctcaagctcattgtagacactattgatattaacaagttgtttttggaatggagcatgagaatctattttccaaaagcttttcaagtgaatctgattagacagtgagaggcccaactggctagcaggatcagactcttcttggaagcttaaaatgatggatgatggtgataatcctcaagaaacaaagtgaggagtgggtagaagtttgacggaaaaaatcaggaatagctgaaaattatggagcttttctatttcacatattggtatagtgcaaagtatgtaaatattgaagaataagagtagggtcagattcattagggatttcccatatatactaagttttgaaggaggaaaagtacaaactaggggtatgtagcattggaactgaaaaagttctgtgagaggcatacaagtagttttgtataaattggcaataaagagcaatgtcatgcttttattttttttcctttgagacggagtcttgctcttgttgcccaggctggagtgcaatggcatgatcttggctcactgcaacctctgcctccctggttcaagtgattctgcctcagcctcctgagtagctgcgattacaggtgcctgccaccacacctggctagtttttgtatttttagtagagccggggtttcaccatgttggccaggctggtctcgaactcctgaccccaagtgatccgcccacctcagcctcccaaagtgctgggatgacaggtgtgaggcaccacgcctggcctcaagcttttgaaaggattgttttaggtaagcatccttatagaaccttaattttctctctctgtcacccaggcgggagtgcaggggtgcaatctcagctcacttcagcctccacctgatgggcgcaagtcatcttcccacttcagcctcccaagtagctgagactacaggtgcgtgccaccacacctggctaattttttatatagacggggtttcgccatgttgcccaggctggtcttgaattcctggcatcaagcgatccgcctgcttcggcctccagagtgttgggattacaggcgtgagccaccgtgcctggccttaattttctttaatactgagataaagcctacctcatagtgttatcgtgaagattaaaacctttagtgtctaggctaagtgtcttaaaaatggaagctattattaatctataacaacattgtccagtagaacttattgggatgatgagaatatctgctgtacagtatggtagccatttctgtgtggctgtttagcacttgaagtgtggctagtgtgaatgaggtatggacattttaatttaagtcactacaagaagctagtggcaattacgttagtgtggctctgtgtgtttcaggtgtggatcactagcctaaagataggattaataggtaaattaattttaaaggaattgaagaatattctggattagagcatgaggagactcagttgagaggcctttagcatggttaagaaagaaaataggtaagtagaatagggacttgacaaatagaaagtatttttgtaaaatgccagaatttgatggtggggagcaaaaggagagggaattgaaggggattaaaaaactaaggtagtagctaaaaccataaaacttctagattatatagaaaagttcttagtgactttgggtttggcagagagttctcaaataggacacaaaaaagcatcaacttcaaattaaacgttgtaaattttaaaaactttttgaaagacaagcaaatgaaaaggcaagaacagactgggggaacatatttgcagaacatagccaacaaaggatttgtatctataaagaactagggtatgtatgagatggaaactaagtgcatgaaaagatgctcaacattagtcattaaggaagtgcaaattaaatgacaaccagatactgctacatacctttcagaattgttttaagtttgaaaaataaaaacaactccatcgagtgttaaggatgtgaaacatctgaaaccctcctgcagtggtggtggcagtgctaaatgctacaactgctgtggaaaagttgaacaattccttaaaagttatacatacacattttatatgactcagccattccacccctgggtatttacccaagagaaacgaaagcatatgtccacatgaagactagttcacacattttcatagctttatttgtaatagcccaaatatccattggtaactgagtggataaattatggtataactatacagtggaatactatttagcaataaaaaggggacaaaaattggtacacgccacatggacgaatctcaatgttgtgtgaaagaagccaggtaaatacatactgtatgcttctatttatttaaaatcacaaaactacaaagtataatgagaaagcagattagtagttgcctaagggtcatgtaggggctgttttgggggacatattttaagcttctagtccctgggaactgaccctagtgatggagaatttgtaggaatttcctgtggaagatgagtctgatttttaattaggtatcaaatgttagtatagcatgtcagccgggtgtgatggctacgcctgtaatccctacactttgggaggctgaggcaggcagatcacttgaggacaggagttcaacatcagcctggctaacatggcaaaatgctttgtctactaaaaatacaaaagattagttgggcgtggtggtgcacacctgtagtcacagctcttcgggaggctgaggcacacaagaattgcttgaatctgggaggcagaagttgcagtgagcatagattgcgccactgcactccagcctcggcaacagagtgaggctctgtctcaacaaaacaaaaaacatgtcaatgaaaataccttggagaaggggtcagggagtcaatcaagcctggcccattagaacaagttctttgaagttggtttaataaaatgcagtcgagcttcgttaaggaaatggcaaatggataagaatcagttggaaaaacagtatgcatgaagcctggattagactgaactaatttgtcaatatattttacaaggctagcataactgatatcaagatttgaggatggaccagccaggtgtggtggcttatgcctgtaatcccagcactttgggaggcccaggtgggcagatcacctgaggtcaggaattcaggaccagcctgacaaacatggtgaaaacctgtctactaaaaatacaaaattagccaggcgtgatggtgcatgcctgtagtcccagctatttgggaagctgaggcaggagaattgcttgaacccaggaggtagaggatgcagtgagccaaggtcgcgtctttgcactccagcctgggcaacgagcgaaacctcatctcaaaaaaaaaaaaaaaaaaaaaaaaaagaaggtaatgaggatggaccgtaaggttggagtaggggaatctagagccttattaatacagattgaaaaatcataaataaaatggcaagtctaatctactaaaagataaaacgatgaccaagttagggtttatctcaggaatgcaagactgctataatattagtaaacatgaagttctttatattaaaggggaaaaagcatatcatcttaatagatggtaaaatagcattgataaaattcaacaccctttctggtaaaaacccttggtaagctaggaaaagaaaagaattttaacctgaaataaactatgctacccatgcttaacataatgcttaatggtgaagctttggaattagtttcaaggtcaagagctagaaaaggatggaccacaattatttccaattcttttggaggtggatgcaatgagaccaaataaaggataattataggaagggaagagaaaagctaatccaagagcagatagaaatgaattttaagactacaccatgggtaagatatctcccccaaataaactgacgtgttattagaagaaagaataaattctagtgagccaaaacgcaacaaacgtccaccacactgccttacggccctcgtaattttggtttgtttagaaaacttccttgcctatcccacacccttcaagatatttcagttgacttttaggttgtaactaattaggttgttaggtcaaccaagaaggataagaattggtgtatacatatctgagctccttgggacctctggatgaaataattcttaaggcatgtgtgttgtgtgtttaccagatggttccccagcaggattaagcttccgtttacctacagtggcagctttcttcataatacatcttttattggctttcttcccttccctattgctagttcccgagatcacctcccaaataatatctttcaaatccttaagcaaatcctctgatttgcttctagcaaaactcaaaagttgggagagatgaacttaggagggacagcaaaggaaaacaaaatcactgttgttaaagctttggtaagccagcttaaaattcaaggtttacagtaaaaatgcctcagctcgaatctgaaccttgtatcttacctccttcaacttaaagaggttccagagaccaaaaaggaatttgaatagaacatattattagactaccttataagctaatcttctgtagataaaatgttaaccaaaatttctgtaaacattgtcacagagaggccttcagcaatttctggttaaacatgttaattgaacagagccatttaatttctgtctttcccaaacattattaaaatgacagtaagctgtaaaaaacatcataatcccgtgctgaccaagcagagtcaacagaagttgaggcaaaagtcacaatgcagggaacagaataaaacaaaagcaaacgatgtaagtatggctaagcaattccatttctagaaatttattcaacagatatgctcacacatgtgaaattacacatatttaaggttattcattacaactttgaactatcaaaatattggaaataacttaaatgttcatcagtataggactggttgtataaattacagttcacccttgaacaaggcagccattagggaagccaacacctgtgcagttgaaaatctgcatataaatttttcttttcttttttttttttttttttttgagacagtctcagctctgtcgcccaggctggagtgcagtggcaccatctcagcttactgcaacctccgcctcctgggttcaagagattctcctgcctcagcctcccgagtacctgtgactacaggcgcgtgccaccacgcctggctaatataaattttctttggctatcttctgcttttaaaatttagataatttttcttttttctttttttttctttttttgagatggagtctggctctatcacccaggcttgcgtgcagtggtgtgatcttggctcactgcaacctctgcttctggcttccagtgattctcctgcctcagcctcccgagtagctgggattacaggcacacaccaccatgtttggctaatttttgtatttttagtagagatgggggtttcaccatgttggccaggctggtctcaaactcctggactcaggtgatctgcccacctcagcctcccaaagtgccaggattgcaggcgtgagccaccacacctgacctagataaattctctgttttgaaattgttatttgagacggtctcactctgtcacctggagtgcagtggcacaattttggctcactacaacctctgcctcctgggctcaagcgatcctcctgcctcagcctcccaagtagctgggactataggcacacaccaccacacctggctgattttttttgtagagatgtctcactatgttgccaagacgggtctcgaactcctcgattcaagcaatcctcccatctaggcctcccaaagtgttaggattacaggcatgagccccaccccacccggctgaaattagttttttatttgaggcaaggtcttatgttttttaggctgggctcaagtgatccacctgcttcagtcttacaggtagctgagattacaggcatgccactatgctcagccttgcatataattttttactctctcaaaacttaatgattagcctaatgttgactggaagccttgctgataatataaacagttgattaacacatattttgtatgttatatgtattatatcctgtgttgttgttttttttgttttttgttttttgagacggagtttcgctctgtttaccaggctggagtgcagtggtgcgatccgcaacctccgcctcctgggttcaagcgattctcctgcctcggcctcctgagtagctgggactacaggcacacaccaccatgcccggctaatttttgtatttttcgtagagatggggtttcactatgttggccaggatggtctcgatctcctgacctcatgatccaccctcctcggcctcccaaagtgctgggattacaggcgtgagccactgcacccggcctatatcctgtgttcttacaataaagtaaggtagagaaaagaattaagccgatcataaagaagagaaaatattttttactattcattaagcagaagtggttcatcataagggtcttcatcctcatcatcttcatattgagtaggctgaaggggagtctcggtggcagactagctgtctcgggtggccgaggcagaagaaaatcttcatataagtggacctgagcagttcaaacccatattgttcaagggtcaactgtatagtacagtcatacaatgaaatactctgaagcaatggaaaagaatcaaactctttaagatgtagaacaaagtgtgaaataaattatgtatgtatagaatgctactatatgttaaaacaaggacgacgtaagggatagatgtatattttcttatatatagaaagaatacttctggaaagatacagaagaagctacttcttttctttttatccttacatgaattgatacattttaattggttgcatatatgcttcttttccatatctaatgttttcttcctggagtaggaatctccaatagctgcaacactcctggttttagtggagatgagggacttacctgattagtgactttgggaagaatagccctcaggtgcttgcctcagctcttcccttcttcttctggggagtgagggcttgcacagagcactgatgttctcagctgcttctcttggttcagggacaggctgaagtcaaattactaatcaagtgaagaataaagacatcactggacatgcaaatgctcaaaacatttacctccccttcattctttctctggaaactactgaaaaattttgaaattaaaatgttggaatgaaccaggaaaagggaagagagagtatacaggaaacagaggcttcaagatgagaggggtaatggggggtcctggatgttgaagggaacccctaaaatactgtatttgttagctaagggcaggcccagattggagcaagaggatggtggagccggagctgacagttactcagtgcatgattgtgttgagagatgttagacatatagaggaaagtgtgggaataaagtagtgataggtattcagaaaactaagtaaaaaaacaaactccagccgggcgtggtggctcacgcctgtaatcccagcactttgggaggcggaggtaggtggatcacgaggtcaggagtttgagatcagcctggccaatatgatgaaaccccatctctattaaaaatatgaaaaaattagccaggcgtggtggcacgtgcctgtagtcccagcagcttgggaggctgagatgggagaatcacttgaacctgggaggcggaggttgcagtgagccgaaatcgtgtcactgcactccagcctgggcgacagagcgagactcccatctcaaaaacaaaacaaaacaaaaactacagagaaaacagagctgtggaaagaaggaagtgtaatcataatatcctgtatgacttagccttgaaaaatattgaattaatcttatttggttttaatgtatttatttataacagagatgggtcttgctatgttacccagggtagtctcaaactcttcgcctcaagcagtcctcccacctcagcttcccaaagtgctgggattacaggtgtgagccactgtgcccagctatcatattttttaaatcaacaattgtgacataattacatcgagagaggaagagtagggcaggtgaaggtaggcaagatgagtgttagaatgccaaattccatctgtcctattcagaaggaagaacaaaaatccccaaaattgaaaaaaaaaagacaagaattaacaatgtatataaattatttagaaatatgaaggtaaataaataccagaagaaacaactgaaacaattcagatgattccctctgggagtgtaaatggggaagggactcagagactgctgtttctcactagaggccttacattatttgactttttaaactgtgtacgtgcattactttgaaataaaaacttaattttaaaagcattaaaaggctgaatctggcggctgatgcctgtaatcccaaaactttgggaggccaaggcaggagggaatgcttcagcctgggagttcgagatcagcctgggcaaaatagcgagactccatctctattttaaaaacgtgtgtgtaaacatatatgtgtatatatatatgaaaaagaaattagcaaggcatagtggcttccacctgtaactctagctccatgagaggctgaggcaggaggattgcttgagcccaggagttcaaggttatgtatgatctatgcctccaaattttcagaaaggctaatttgagtaataacaaaactctggtctcccatttagccagctctacatgtattaaactctttttctattgcaattcccctgtcttgataatgttcatagctcagtggtgtgagctatgattgcaccactgcactccagcccaggtgaaagagtaagaggctatctcaaaaaagaaagaaagaaagaaaaaagaaaaaaagtaattcctggcagtaattcagtatctaaatggaacttccagtttccaacccttaatgtattcctatcaactagattctagttgagaaactctacattccatacttcacaaaaccacaaagtatggaaatgtacagttgctcagcagaacatagctttttctggtctaagatctgagaaaattcccctccagatccttcttaaggaaaccccatctgatgatgtgattagcatcctccacaacattcctatcccaaatacaagtgaggatcacgaatctacacgacattttttaaaatagccccctctgtgcctaacactaaagcacagctcagtcaaagcaagtctgtgaaagatgaaagtacataattcaatgttatggttgcaactgaagctagaggcaggtgtagttagagaatcaggtacatatcccttaggcacttttctgccaatattattttttcgaataaaacttttgatgaggttggttaacacacatagagtgcaggtattctgtggcagattatctagtagacaaaacagagagaataacatctttttatgaaaatctaagagcctacctaactttaggtgtcggaacacacgcgctccatctccatccaaacgtttgtgccagtggagttgcgggctgctgcaggtggaggtaggcaagaggagtgctaattctagtgctaattcccagtcagccccatgtgcaaccagatcatgctctgatagctggagaaccatctcaaaagcaccaccaccggaggttctgtactgaaatagggctgaaaggattcaggtgggtcaatagtgcctgctgaaggaggcagccgtgggtggggctaggatttggcctttctgagtgccttggtttaatatcatctagtaactcccaaagtgcaccattgctcctaacagttatatacatgatgcatcttctgatgaatttcagaattttatgaacttaatttttatgaggtctttttttttcacttttaataattttttttttttactacacagaagcacaaggttaaaaaaaattaccagcatattttttccaatgggaaatcagttgtaaaatacatatttttaatcaacttcaaaaaaagatatattagaaaataagagtttcatgatttaatggtagacattggggatagacattctctctagccttcgtataatagatggcaaaaaataataattccagttctgtaattttacaagtattcatgtaactgccccatgagttcttgctctttgcccagacagagcagatttatcaagacaggggaactgcaatagagaaagattttaagacacatagagctggctaaatgggagaccagagttttgttattactcaaatcagcctctctgaaaatttggaggctagggttttttaaggatagtttcatgggcaagaggctagggaatggggaatgctgattggttccattggggatgaaatcatagggggctggaacttgtcctcttgtgctgagtcagttgctggttggtgaccataagatcagaagacccagcttggcagtctgggtggtgccagctgatccatcagaatgcaggatctgaaaaatacctcaaataccaatcttaggtttttcaatactaatctgtaggtgcaaccggggaggttggaatcttgtggcctctggctgtatgactcctgagccataatttccagtctgtggctaatgtgttagttttataaaagcagtctggtccccaagcaaggagggagtttgtttcagggaagagtctaggtaatcatctttgtttcatagttaaactatgaactaaattcttcccaaagttagtttggcctatgcccaggaatgaacaagggcagcttagaggttagaagcaagatggcgtcagtgaggtcagctttctttcgctgtcagatttttctcactgtcatcatttttgcaaaggtggtttcattcatattccgcattgtatctaactgcgtgctttaacatctttatttcctaatgggaaagaatacactcatgagcaagctcaatgggctctctctacgaggtaattttaaacagcatttcttttctgaagtttgattattgcagttaactgtatgaaaatctatacagaactcttcaactacaaaggaaaacatcgatttttattgtttatttcagttttccagggtaatacacagagagctgcaacatgtaactggatttagagaaactaattcctatgaaaaccaattaggaaatacagcacctctgcaaaattctctgtccatccagaccaattctcagcagccaacatttgcaaatgatattttagagcactgtggtctttaagctccttgacgcaagacaagttattgcatgtcatgacagagagaacgtaacaagtccaaaatttaaggaggaggtagctgtttgtttcacttttgatagtagactcgaatctgccttcaaaaaaactaatgagaataggaataaattgcagacttttggctcttttctggctgacagggtttaagtaacaccaacatgccacactctggagcagcaggatc

SEQ ID NO: 145 - protein, 3038 aa, Homo sapiens
MKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRHVRTIWQHRKVRLHQRLQLCVFQQEVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLHVRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGGSGGGGGSGGGGAPSGGSGHSGGPSSCGGAPSTSRSRPSRIPQPVRHHPPVLVSSAASSQAEADKMSGTSTPGPSLPPPGAAPEAGPSAPSRRPPGADAEGSEREAEPIPKMKVLESPRKGAANASGSSPDAPAKDARASLGTLPLGKPRAGAASPLNSPLSSAVPSLGKEPFPPSSPLQKGGSFWSSIPASPASRPGSFTFPGDSDSLQRQTPRHAAPGKDTDRMSTCSSASEQSVQSTQSNGSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRGRFSVVKKCDQKGTKRAVATKFVNKKLMKRDQVTHELGILQSLQHPLLVGLLDTFETPTSYILVLEMADQGRLLDCVVRWGSLTEGKIRAHLGEVLEAVRYLHNCRIAHLDLKPENILVDESLAKPTIKLADFGDAVQLNTTYYIHQLLGNPEFAAPEIILGNPVSLTSDTWSVGVLTYVLLSGVSPFLDDSVEETCLNICRLDFSFPDDYFKGVSQKAKEFVCFLLQEDPAKRPSAALALQEQWLQAGNGRSTGVLDTSRLTSFIERRKHQNDVRPIRSIKNFLQSRLLPRV

SEQ ID NO: 146 - DNA, 163570 bp, Homo sapiens
gaattccagcctgggcgatagagcgagtctgtctcagaatgaaatgacgtgacatgacatgacatgatgaaatgaataatgaaatgccgggtgtggtggcacactccagcctgggcaatagagcaagtctctgtctcgaaatgaaatggaatgaaatgaagagaataaatgaaataaatgaaatgaaataataaaatgaataatgaattgccaggtgaaatgaaatgaaatgatgaaatgaataatgaaatgccgggtgcagtggtgcactccaacctgggcaatagagcaggtctccgtctcgaaatgaaatgagatgacatgagatgaaatgggatgaaatgaaataatgaacaatgaaatgccgggtgaaatgaaatgaaatgaagaaataaatgaaatattgaaatgaataataaaattctgggtgcggtgatgcactccagcttgggtgatagagtgagactccgtcttgaaatgaaatgatgaaataatgaaacaaaattaaatatgaaatgaaatacgaaatactgggtgcggtggctcacgcctgtaatcctagcactttgggaggctgaggagggtggatcacctgaggtcaggagttcaagaccagcctggccaacatgatgaaaccccatctctactaaaatacaaaaactagccgggcatgatagcgggtgcctgtaatcccagctacttgggaggctgagagaggagaatcgcttgaacccaggaggcagaggttgcagtgagcagggatcgcgccactgcactccagcctgggtgttagaacaagcctctggctcgaaatgacatgacatgacatgatgaaatgaaataatgaaatgaataatgaaatgcgtgtggtgcactccagcctgggcaatgcagcaagtctctgtcatgaaatggattgaaattgaatgggaatgggaatatgggaatggaataaatgaaatgaagaaatatgaaatgccaggtgtggtggcgcactccagcctgggtgatagagcgagtctccatcttgaagtgaaatgaaatgaaatgaaatgaagaaatgaaataaatgaatactgaaatgaaataataaaatgaaatgccaggtgtggtggcacactccagcctgggcaatagagcgcgtctccgtcttgaaatgaaatgaaataaatgaaatgagaaatgatgagatgaaatatgaaatgctgggtgaaatgaataatgaaatgccaggtgtggtggcgcagtccagcctgggtgatagagcgagtctctgtcttgaaatgaaatgaaatgatcaaatgaaatgatgaaatgaaataatgaaatgaataatgaaattctgggtgcagtggcgcactccagcctgggcaatagagggagtctccgtctcgaaatgaaatgaaatgaaatgatgaaatgaaataatgaaatgaataatgaaatgccgggtgaaatgaaatgaaatgaaaaaatgaaataaatgaaatgatgaaatgaaataatgaaatgaataatgaaatgccaggtgcagtggcacactccagcctgggtgatagagcgagtctctgtctcaaatgggatgaaatgaaatgaagaaatgaaataatgaataatgaaatgccgggtgaaatgaaatgaaatgaagaaataatgaaatgaaatgaataatgaaatgctggctgtggtgatgcactccagcctgggtgatagagtgagactccgttttgaaatgaaatgaaggagatgaaatgatgaaataaatatgaaatggaacatgaaatactgggtgcagtggctcacgcttgtaatcctagcactttgggaggcctaggtgggcggatcacttgaggtcaggagttcaagatcagcctggccaacatggtgaaaccctgtctctactaaaatacaaaaattagccgggcatgatggcaggtgcctgtaatcccagctactcgggaggctgagagaggagaatcgcttgtacccaggaggtagaggttgcggtgagcagagatcacaccactgcactccagcctgggcaatagaacgagtctccatctcagaatgaaatgacatgacatgatgaaatgaaataatgaaattaataatgaaatgtgggtggcgcactccagcctgggtgatagagtgagtctctgtcatgaaatgaaatgggaaatgaaatatgaaatgaataatgaaatgctgggtgcactccagcctgggtgatagagcgagtctacgtcatgaaattgaaaaatgaaatgaaatagatgaaatgaaaaaatgaaataataatgaaatgccgggtgtggtggtgcactccagactgggcgatagagcgagtctctgtctcgaaatgaaatgaaacaaatgaaatgaaatgaaatgagaaatgaaatgatgaaatacgaaatgccaggtgaaatgaaatgaataatgaaatgctgggtgtggtggcgcactccagactgggcgatagagcgagtctctgtctcgaaatgaaatgaaacaaatgaaatgaaatgaagtgagaaatgaaatgatgaaatgaaatacgaaatgccgggtgaaatgaaatgaataatgaaatgctgggtgtggtggcacactccagcctgggtaatggagcgagtctccatcgaaatgaaatgaaatgagatgaaatatgaaatgaaataaatgaaactaaatgataaaatggaataatgaaatgctgggtgcggtggcgcactccagcctgggcaatagagcaagtcttcatctggaaatgaaacgaaatgaaatgaaatgatgaaatgaataatgaaatgctgggtgaaatgaaatgaaataaatgaataatgaaatgccagatgcagtggcgcactccagcctgggtgatagagcgagtctctgtctcgaaatgaaatgacatgacatgacatgacatgacatgacatgatgaaatgaaataatgaaatgaataatgaaatgctgggtgtggtggtgcactccagcttgcgcggtagagtgagtcttcatctctaaatgaaataaaatgaaatgatgaaatgaataatgaaatgccaggtgcggtggcgcactccagctttgggcaacagagcaagtctctgtctcgaaatgaaatgaagtaaatgaataatgaaatgccgggtgtggtggtgcactccagcctgggcgattgagcgagtttccatctcgaaatgaaatgaaacgaaatgaagaaatgaaataatgaaatgaataatgaaatgctgggtgcaatgaaatgaagaaatgaaataatgaaatgaaatgaataatgaaatgtcaggtgcagtggcgtactccagcctgggtgatagagtgagtttccatcttgaaatgaaagaaatgaaatatgaaatgctgggtgtggtggctcacacctgtaatcctagcactttgggaggccgaggcaggtggatcacctgaggtcaggagttcaagaccagcctggccaacatgatgaaaccccatctctactaaaataaaaaaactagccgggcatgatagcgggtgcctgtaatcccagctacttgggaggcagagagaggagaatcgcttgaacccaggagatggtggttgccatgaggcaagatcgcgccactgcactccagcctgggcagctgagcgaaactctgtctcaaaaaaataaaaataaataaatgaataaaataaattactctctatctgacagctgctagtttttccctcatgatctttctattaaaatagctctgtacttactatgttgagcccttcctttttttttgacagggtctcagactagagtacagtggtgtgatcatggctcactgccacctctgcttcctgggttcaagtgatgctcccatctcaacctcccaagatgctaggactacaggcacatgccaccatgcctggctaatttttttgtgttttttgtagagacagggtttcaccatggtgcccaggctagtctcaaactcctgagctcaagcgatccaccctgccttggcctcccaagtattgggattacaggtgtgaaccaccgcgcccggccccctctttttttaaatttctgtatttaaagagtacattggggattggaaatagtttagatcagcagggattagccattccctaaatgtaaacttcagtggtgctatacttagagtgcctaaggtcatttccaaatccatgaatctggacgttgaagttatatttgtattcccaccacacaaaatttatgtctgtgccctgtcttcttgggtctattttttaaccagaaattaataagacattgatttgcctttgttagagtgatttcagtgtttcgagttattaagacaggaagtgtgagtccctgttggaattctgggtcagcagattatttacctcttctacaattgcaatggaaattgaaatctatttgtcctgtgacatagaattaatgagtattcttttttgctttttctcttctgagccaagagctttcttttcataatttatgttggaggtgttccagactatgttactactgcaagaaggtccttgccacagaaagttagactctcatttcttttgacaatatcaaatattcagccttttcctctgtcttaagaatacatataatatgccttaagttagatgctataccatagtggcttcccttgtgtaagaaaatggagtggagggggctgagctggagcttccatgcctatctgttgggctagaaacacctcccactcaactccagccatttgccactctgcataattagtgtacctcatttattcagaagaagctggaatcccagatttttatgtgaaatctcctgtttttaaaatatttgatctttttcaacataatttggcccaacaaaactcttactggcttgagtgctgcccttgtactgccaattgaagtttaacatttgtctaaccctaaagactttcaaagtgaaattatttttaggttcttaacaaggtttttctatgccaaggtaaaattttcaagggcatatgaggtatttactgtctcactcagagttctgtttaagtgagcacatgggcatgcatgttggagaaagtgttgtgagctcttacggataaagtttgaaatgcaacctattttcaatagaaaaaagcctcttactctcagatagctcagaaaaacttagattttacaatccttttaagacttaagactcttaggtctgtggagtcaaaatgctacgtgatatttgtggtggatgaattactgaaaaacagaattcctcagcgaatcaagtgtctgatgcataataaaccaacccaacaaaaaaagctgcctttcagaggcaagaatataaaacatgtgtagttaattaagctatttaaaacagaaatgttaggcctggcacagtggctcatgtctgtaatcccagcactttgggagtccaaggcgggaggatcacaaggtcaggagattgagaccatcctggctaacacagtgaaaccccgtctctactgaaaatacaaaaacattatccgggcatggtggtgggtgcctgtagtcccagctactagggaggctgagacaggagaatggcgtgaacctgggaggcaaggcttgcagtgagccgagattgcaccactgcactccagcctgggccacagagcaagactccgtctcaaaaaaagaaatgttatgaaaaatttggaaatatttgtcactagctgtatgaccttttgaaaaaggtccgcctaataccttgctcatctataaaattgcggtatgatgattatcaatttacaggattgtgatgcattttaaatgaaacaagttccattacgtgcttattgctgaaggtataattcagtgaatgttctttccttttcttagagcagagtttggtattttattttcacctaagccattttggtcagttcttaaggctttgattatttttttaagttgaatggtgtttagtgtgcccgtgttcataacagcatattattcacaacagccatacaggctgggtgtggtagctcatgtctataatcccagcactttgggaagccaatgtgggcagattgagtccaggagtgtaagggcaatatggtgaaaccctgtctatacaaaaaattagccagtcttggtggtgggcacctgtagtcccacttactgggaaggctgagatgggagaatcacctgagcccaggaggtcaaagctgcagtgtgccttcattgtgccactgcactctagcctgggcgacagagtgagaccctgtgtcaaaaaaaaaaaaaaaaaaaaagatagattctaagaggccaaggcaggcaaatggacagattgcttgagcccaggagttggagactagcctggacaacatagctactaaaaatacaaaaaatgagctaagcatggtggtacatgctactcccgaggctgaggtgggaagatcacttgagcttggggaggtcaaggctgcagtgagccgtgatcatgccactgcactccagcctaggtgaccctgtctcaaaaaaagaaaaatgtggtatatacatagaatattattctgcctttaaaaagaaaattctggctctccctctcactctccctctccccacggtctccctctccctctccccacggtctccctctccctctctttccatggtctccctctgatgccgagccgaagctggactgtactgctgccatctcggctcactgcaccctccctgcctgattctcctgcctcagcctgctgagtgcctgcgattgcaggtgcacgccgccacgcctgactggtttttgtattttttttggtggagacggggtttcgccatgttggccgggctggtctccagctcctaaccgcgagtgatctgccagcctcggcctcccgaggtgccgggattgcagatggagtctcgttcactcagtgctcaatgttgcccaggctggagtgcagtggcgtgatctcggctagctacaacctccacctcccagccgcctgccttggcctcccaaagtgccgagattgcagcctctgcccggctgccaccccgtctgggaagtgaggagcgtctctgcctggccgcccatcgtctgggatgtgaggagcccctctgcccgggctgcccagtctgggaagtgaggagcgccttttcccggctgccatcccgtctaggaagtgaggagcgtctcggcccggccacccatcgtctgagatgaggggagcgcctctgccccgccgccccgtctgggatgtgaggagcgcctctgcctggccgcgaccccgtctgggaggtgaggagcgtctctgcccagccgccctgtctgagaagtgaggagcccctccgcctggcagctgccctgtctgagaagtgaggagccccgccgcccagcagctgccccttctgagaagtgaggagcccctccgcccggcagccgccccgtccgggaggtgggggggcagcccccgcccggccagctgccccgtccgggagggaggtggggggcagcccctgccccgccagccaccccatccgggagggaggtggggggcgcctctgcccggctgccgccccgtctgggaggtggggggcgcctctgcccggccaccccttctgggaagtgaggagcccctctgcccggccgccaccccatctgggaggtgtacccaacagctcattgagaatgggccatgatgacgatggcggttttgttgaatagaaaagggggaaatgtggggaaaagatagagaaatcggattgttgctgtgtctgtgtggagggaagtagacataggagactccatttcgttctgtactaagaaaaattcttctgccttgggatgctgttgatctatgaccttacccccaacccggtgctctctgaaacatgtgctgtgtccactcagggttaaatggattaagagcggtgcaagatgtgctttgttaaacagatgcttgaaggcagcatgctccttgagagtcatcaccgctccctaatctcaagtacccagggacacaaaaactgcggaaggccgcagggtcctctgcctaggaaaaccagagacccttgttcacatgtttatctgctgaccttccctccactattgtcctatgaccctgccaaatccccttctccgagaaacacccaagaatgatcaataaatactaaaaaaaaaaaaaaaaaatactgcaagaacatctgccccagaactgcctgtccaacctggactgacatcatccttgttattgatctttgtagccaaatataattattttaaaacaaacaaaaaaagagaatgtaagcagtataagactttaaaacacacaaatgaaatatacatgactacatgcttcagtgaactaaaactttcatctgtgatctttattttgcaacattctgaagtaacattacagtcttttcagtgtgctgtgtcatttatatcccttactttatcctaggaatcctgtattgccattgagcatatgcaaattgagacatgtgcatagcttctccccgttgagcccatcagtggggaggagctatgtaccggggacatttggcaaagattttcatgagtctcttggatgtaacagctccttaagaaaacctcagtttaccttccctattttttaccatttgtaaaactaaggctcagtgatgtaaaatataacacattctgtgctgtggcataactgcagcttaggtttttatattcaagacaagcagaggtatagctgaaaaggtatgaacacttactatgcttcaagatcccttcgttggtttagttgtggcattttagaacagctgacttgggactaaagcatctttctatctgggatcagtatttctaagttgcctttaagctgaataaacatttggtttttatatttaattgcttcgatgtgaaacactgcaatttaaaaaattacacatatgtaatatagtattttacactaaataatagtgactggcagtccactggccgaagaagtattatttttcagatattctgctctgtcatcagctgtagacactgacaggtatttatctggaaaggcttgctgtcaggggttcacagtgctgcttgtgggttatctccagaccctttacattcggcactttaggacagcgtgagtcacaggttgcactagaagttgcctttgaaattagacctaaactatgtggaactggaacccttgtacacaaagctctctatcatccaaatcctgctgaactctcttaggaaagaacagttttacagattcattctttccacacacaagatttccccactgcccagttactctcacctttttattttcttgactgttatgttttacttgactctggaatcttaccttgtactctcacatttacatggaagtatagcttatttcaccaattatactatcaaaagcagaagtagttacttacacctgaaaatttgtactgagaatgtagctgtgaatatgtttaagaaagtatacttaaagcacaaatccaaggaagtatatttaaatcaaagcaagaaatcccatttccaaatggcaataaagcatgtgttacatagaatcagtgcatgaaagtgttttagtagcccagattagattgtaccctggcgaataagcaagagttctttttcattttcatcttgcaattcaactgggtatttgggttctttttctattcactcatgtcagatagagacatgcatgttgtaaattattttgtcagaatgaaagcctggcagattaaatgctttcttctcttcttgctttacttgatatcaatctcttgttcatttcttgataatatgtttggttatttttgttttcattgcttttagtgtcagagatggctttggattccccgttctgtgtgctgctgtctggctcctgaacccagctgtagaggtgtgtgtcaatcccaactggtgaagtactgagaagaagctacacaaaaggcagcaaagtattagtaagtgtacctctgacattttaaccacctctgacttttccatggaatggacaagtagtagtctctgtcagagctacattttaaaggagaaaaagaaacgtgaagtcatgaactgtttatttatgctgttatttttgtgtttactcacctcatttatattgacttgtaaattagtaatttctgaactattatttatcaattcattgcctacatgtcagcaaacaaattttcttcttaataaagaatccagttgctgggcacaatggttcacacctgtaatctcagcacgtttggagggcaaggcaggaggattccttggggctaggagttcaagaccagcctgggcaatatagcaagatttcatctctacaaaaaaatgaaaacattggctgggcatggtggctcattcctatagttcaggctactgaggagcctgatgtaggaggatcacgtgaccccagtagtttgaggctgcagtgagctatgatcctaacactgctctccagcctgggtgacacaccaagttgccatctcttcaaaaaaggaatctagagacatcagtgtgtgcacaagcatggtttgtgaatttggaagtgtgtatgtgcatagttgtgctcaagaatgtgttgatgattataccttctcagaatgaaggtaattttttttttttctttttttttgagatggagtcttgctctgttgccaggctggagtgcagtggtgctctcagctcactgcaacctctgcctcccggcttcaagcagttctcctgcctcagcctcccaagtagctgggactacaggcacacaccaccactcccggctaattttttgtgttttagtagagacggggttttaccatgttggccaggatggtctcgatcccccgaccttgtgatccacccaccttggcctcccaaagtgttgggattacaggtgtgagccaccgtgcctggcctgaaggtcatttttataaagatctctccacgtcttagatttgattcttcctttaaatatttttctcattgacatttgaaagcacctgaccttatataaaatgaacaattttcataactccataaaaggagaattatggcatcatctatttctttctcttgtctcataaatctaaaccatcaacctgcttatttttgtatactgtcacactgtgtattccctgcattgaatgcctgtctgttgacattatctgtaaaaattgtgggaagttttctgcaccctgaaatttctgttatgcggattaaatatccactatccatgtttttccaagtcttacagtagaaagggtaaatgcagccctcacagcagcctgttgttcgtcctgcaaatgtgtttccatcacattacacaaagcctctttgtcttcgtggttctaccctactaataagttttttaaaaaattatgtaatgtgtgtatatacaaatacctatatgtatgtgtgtacacatacagctgatatctgctgagattatgtatgcatgaactatagaattaacttgtaattttaagaaaataaattattttgtaaagataaatctcatgtttaagaagaggaattacagttgaatcatttagggatgcctcagcctaaacataatatggaaaaagccataaccaaaagtcattttagagtactgctaggttactcaacctatcatcacatttaattaaaatgtcagtttgaaccatggccagtctatgttggttaatatgttatttaaatcaacttgtgaagtcttcattttaaatatagaatttgtgttaatggactggaaaataacattctattgcttggaagatgtgttaaagtctaaagatttatgactttgtaaaagaagaaaaccaggtgatgatcagttggcattagtatatgaggatgtactcatatttggtaatagccattttttctaactagagcaagggagttgggaatgggaggcagaagcaaggacacagacatgtaaaaaatcatagaacaaaactgtattgagttctgagtatgggtctgtgatccatggttcagtttgagaggttcatgtgtcccttatgagaagggacaggaaagccaggaggaaaggagtatgtttgggcctgtgcctctgcttccaccacagaagtcagcagctctacctttctcttttctcctctttatctaataattgtctcctcttcaaatttgggaaatgagcttaatcaaagatttgttgtgttttgtttgtttgtttgtttttgaaatgtggcctcagtgtgtttgcccaggctgatcttaaactcctgggctcacatgatcctccctctcagcctcctgagtagctgggactacaggcatgatccactacacccagctaagttaatgctaatgtgtagtttatctgcttcaattttgaagggtaggatatatatagttatgtgtgtgtgtgtgtgggggggggtagtgtttgtgtgtgtgtgtgtgtatatatatttatatattactagtccattgctgctacaacaaactaccactatgtcagggcataaaacaaatttattacactcctgtatgtcagagtatgatgtggatctcactgggctaaaatctaggtggtggaaaggctaccttcatctctagaggctctaggggatcttttttctcgccttttccacattctggagtctgcctgcattttttggctttgggctcttctccactctcaccattagcaaccttgcatcccatggactcttcttctgtggccacatgtctctgtggctctttccttcccccttctcttccactgttaaggactcatgtgcttacttagtcctgaatggagacaccgtcatcatccacatgagcccactgtcctaatccatacaggctgctacaaggaaatgcattagaccaggtagcttataaataacagaactttgtttctcacagtcctggaggctgagaagtgcaagatcaaggtgccggcagtcttggtgtctggtgaaggcctgctttctcatagaggcttccttcttgctgtgtcttcgcatggtgagaggaacaaacaagctcccttgtgcctttaataaggtgctaatcccagtcatgagggcagagtctcccgtaaggcttaacctcctaataccatcaccttgagggttaggattttaacacatgaacattgatggaacacaacgttcactccatagcaccagggtagtctcctcatgtcaaggtctttacctgaatcacatgcatgatgtaccgttttcatgtaaggttctaggaatctgtggacatctttggggggccattattttgccaatcacatattacatatattttaatatcctagactagtatgaaaacaatgccactttcattgctttatatatgcatatatatatacacattgtctaatgctataattaaaaaaaagttgtagacacaaatatacccatttaaaaaaaacccattttttgctattttacttcatactgccaaccaactcctttttcctgaaactgcttcaactctggaattcttttttgctattagttttattttattgaagtattcatgaacaagcatacacttgtatatggatttaaaattcacagtaatgttttcatgaattcatctgtgaataacattttatagacaaaatgtctgcactaggacaagagaaagatgtataattcccttgttctaaggtaccgccattcattgttattattttaaaatacgagtgtcgactgatgttaaaacacaaaatggggccgggagtggtggctcccgcctgtaatcccaacactttgggaggtgggtggatcacctgaggtcaggagtttgagaccagcctggccaacatggtgaaaccccgtctctactaaaaatacaaaaattagctgggcatgtgttgcgcgcccgtaatcttagctacccgggaaactgagtcaggagaattgctggaatctgggaggcggaggctgcagtgagccgagatcacaccagtgcactctagactgggtgacagagcgagactctgttcttcccccctacccccccaaaaaaaaaaccacaaaaagggataattggctgggcaagtggctcatgcctgtaatcccagcactttgggaggccaaggtggacagatcacctgagaccgggagttcaagaccagcctgaccaacatggagaaaccctgcctctactaaaaatgcaaaaattagccgggcatggtggcacatgcctgtaatcccagctactcaggaggctgaggcaggagaattgcttgactttgggaggtggaggttgctgtgaaccaagattgcaccattgcactctagcctggacaacaacagcaaaactctgtctcaaaaaaaaaaaaaaaaaaaaagatttataactgggcaatggaattgaaaatcatttttaaaaatatccaaaatatctaaggaacttgtataaataaataggaaaaaaaaaaaacatcaagaagcccacaaaaaagcagatttgtaaatgggcaatggatttcaatagacatttagccaaagaagatatccagttggtgaaaaggcatatggaaaggtgcttagcatcactgattatcaggaaaatgaaaatcaaaaccaccacgagtggtttagaccatagcggcatgcatgaaagttttcagacctccagttgttgggagtggctgaggacattggggagcttctgtctgagttggaagagtggagtctcaacaagaaccattgtattctggacatgtgtgggccctggagtgtgcaaggctggatgccttgtctacctgtgccttacagagtgacaccattgtggtgtggttgatcagaggtttgtttgcccacggatgaaagcaaaagtgagttggcttcccaagaacttttaccagtagcctgttttgctacaattctagacccagactggggtcccaaggcatcatagcccacagcttcttagcaagtgcatgttcagttggatcccccagctcagcctgggtcatccccaccttctgcctcttgggccatagctcagctctgcacactgagccatcatcctatggtgagcaagaccccattcttgggcttcagtctctttccttgtagcaggcaatcaaggtggtggctggaaagggccaaggagccacatctcacagtgccctgctgcctgaacaaggaccagaggcctgtggaacacatggctctcagatttctcccatttgatgactcatcagctgcccccacatggcttcctagctcacagcagatctagccttctctgagcagtgaagatgggatgttttgtggtcattttccctggtgtgcagagcccaagtggagttcttcagcacaccctagtccatcccctcactaacacccccacctgtccagtcttacctgccttcatatcaaaagcacacagttaacccagagggcttctgccctgccctgcctgactttctgggaaacccccctctccacccaccctaatcaggacactgtctgaaggttccccctcatcattttaaaagaaagagaaatttttctgccacagaggttctggtgaagtggcctgctcccacatcacagggtgatggcggtttgggctggaccaggatcagacagtgctgtcctgaggctggccgtctgataaggggctacagaaagggcagtggtggagccctgggaggctttctgctctcctgatcacaggtttttggtgagaggacctattggccactagggtgtctgcgtgcgtgtgtgtgtgtgtgtgtgtgtgtgtgtgtgtgtgatgtgtgtttacttggattgacttctttcagcatgaagcccactgttttgctgaatgtatctcactgtttcctgaaactcagtacattcagctggcttaagggtcctggggcctcgctgtgtcatatttgcacaagcctagtgtctgtgcagactgtacactggagttcagttgtaagacccttttgatcccttattctgttcctgtagtagaaaaggcatttcactcaatggaatagaaacccagatccaatggagagatattctaatctgccatacactggggcagtggccagtgatttggacttggtggcacagatggaaatttccaggttctctaggtggtaggcagaggcctcactttttaagaaactcccccactccacccctgccaatgaggacgttgcttagaggtatttctatcagtgttgagtagaagagatcatttcttgatgttgaatttcaggtaaggatgccagcttctgcatatcagggtggtgatgcttgggctgagacaggtctagacagcactgtctgaaagggggctcaaggaagtagctgtgaaaggcccctgggatgttttctgctccccttcctgcaaatcccctggagggagatcctgttagtcactacgggatgtgtgtgtgtgtgtgtgtgtgtgtgtgtgtgtgtgtgttcatcacttgttgcttgggtgtgggaagagacaacaacaacctacagaatccagagttctcagttcatctcccatcctagtccaatcatggcctaacatccttagctaccgatcgcagaggagactgcgcatttgtgttcatgtggccttggatgttggcagattcagattggtgccccagacatctgtgcctgtaactgcagtttcagcgggctcaggaccaggctaaagggcctccaagcttcctccagtttcctggtgcatgcatgtgcaatatactcccgtggcctgggtctttcctgccgcttcttgccagttgggtcagaactagcttattaaccagttttttctgagctttaatcgaactggctccaaccagttggagacttgaaaagggctacgtgatagttatagatttttaaagatatattattattttagagtagtattgagtgtacagcaaaatggagtacagggtccagagatctcatatggcctcaattcctgtacactctcaggtcactccaccaataacctcctacaccagagccactttgaaacattagaaaatatatttgagcattcagaaatgtataaactaggcagctccagactgcaagcagctcagagttccaacagagagggagggtgggggaagaattttatatggtgaatgtggaagaaaaagaaaatacttgattgggtaaagtggagcagtggcctcatttggaacattacagtggaaagtctctagttagatgttagttggtggtttctgactggttaaacttaagtttccttttattatttacactgagtcaagttttgggttatttaaggaggaattgagtgcactgcagccacctcagcctcatggccacctgtttatttgattatttttaacagagaagatccttttaaaaatatctgttaccctggctggagtgcagtgacgtgatcacggctcactgcagccacaaccttccagcttaggtgatcctcccacctcagtgctccccaccctgagtagctgggactataggcatgtgccaccacaccaccatgctaggctaatggtttgtatttgtttgagagatgcagtttccctaagttgcttaggcttcttttttagactcaaataatctgcatgcattggcctcccttagtgctggaattacaggccatctaaatcttttatctcaggtttgccttgtgacaaaaggaggggtactttttctgacatgatgaggcagagaaaggtgaggtgggcgcatcctgtgcatatgattttctcaggtgatgggaatatggttggctcttgactaatgggatatattttctctttgaatgatttggcaagatatcagatgagagaaattgaatgaatgttagaagaacatagaaaaaacaggttatacacgttgggtttctgaagaaatgatgtgtttggagaaacaaaacttttattgatttctggaaacatttagggccaattttttatgtaagtaatttgaatttatgatgatatctctgaccactttttgatattttttctggttcaggtgagtagtgtcattgagcaaacacaaagtcgggctcatccaaggatgagattttgccagagaaaggacgagcagcaagtcagggagcttaaggtaattatgggaaagtgactatctgcaattgcttaggtagaaggagacagattggatttttgtgtgtttggtatttgggataagagggatgtgggtgtgtttttgacatgggttgtttattctctgtctctctctctctttttttttttttgagagggagtctcactctgtcgcccaggctggagttctgtggcacagtcttggctcactgcaacctctgcctcccaggttcaagggattctcctgcctcagcctcccgagtagctgggattacaggtgcctgccaccacgcccggctaatttttgtgatttttttttttagtagagatgaggttttactatgtaggcgaagttggtctcgaactcctgacctcagatgatccacccgcctcagcctcccaaagtgctgggattacaggcgtgagccaccgcacctggcctgtttattctcttaagagagaaaatgaggggattagtggactgtagttctggacaaggtggaaaactcttaaagtggaagtattggggcaagtgctctgacaggctaggatggtgcagtcagtcacttcacccagaaatcagtagaatgttaacagttcagactcaaaccttgtgaaaaacaggttctagaaaggaaatccctcacagcaactggcaccataatcaagacagaatttttgcagaataaatggagttacctgctttcagccccaggtcgtagctattgtctgccctgctgatatgtgataataatttgtgatcctgttgtcttaaaatggggtcactcatctccagtagaattaagtccacagtgaagttgtccccccatccccagagataaacatatatgaatgaactcacgtgataacaactactgctgcctgggatcatgagagacctgaactgaactgataggaagtgaaaggtggctgaggtaatgagaatagacccatctgcagaggatcataaaaccagcaaagacaagatcttgtctaagatgccttcacaaactttgtccatgagaactctaaggacttctccagacctgttggctgctgctgtgatctctgcccaagaggagcctctgaccaacatccaaagggcttctggacccactggactcctctggaggtaccttggtctcccgatccatggctgtggttttttactccgtttatcactgcctgtgtgtagaatgataattgcacaattgatagtgtgaagacctcttgataaatggtgaatctgagcatatgtatttggctgacatgtcattgtgaaacctcacagcttcagtcagtgtcagcacagctagggagcatgtacctaatgcacatatcactgggcatagtctacaggcacctaataactcaggtaccttaacagtcactaatgagtgtctctccaaggtctaaacaatggaagactgtagaagatgttattcattaagatatctcaagaatgtggaagactattattcgcttctaaagggacaggacttcatagggcacctgaagaaactcccatgaaaaatcacttttacaaaatgtcaagttatgatatccaagatgaaaccaatgagtcacaacattcacataatacactgtacaaccctgatctcttgactgtcatcaaatgtttcttacctctaaaccaaagtttcattttataatttaatttttctcattttttctgttctcttagcttaagaaaagatcattacaaactttttgtaagtttttcatatatgcttgcaaagggttgtaaaactttattgtgattattcttgctttaagctgaaacttccctaatctttctttagagattgtggcatagcatgatagtttcttttccatatccaattgttttctgtaatgaatacagaaatatgggcactattttgtaactttaaatagacatcatctcaagtctacaagaattatccaaaatggtatttaatgacatttctaggtcttcagacactattaatgcagattgtaccctctaggtcctgaagattttactagatactggttactgaaactgagctttcttgaattatttttccttccactgtggtttcccgcatttcaacacatcacctatttttgtcctcaaacattacttaaattttttccacagaattaaattaaatatgaatcatccctcctctgatttttgaaatgaccctttgcttcctatgataatgattcttctggtccgttttgtagttatatgttagagtttgtaaatagtcacacattttgcaactgcatataattttcttattattttttcctcttcctctaaacctgctgttatttcttttaactttttgtgggaaaaattaaacccatctttcactttgttgatatacttatttataattgaactccttgatttttgctcgaattgcttttcaagttacccacttttagggaagacattatttgggttttgtttagtgtatcaggctttttttagttagttgtatcaagaagtgtagacttttctatacataatatcctttttcccacagtagttttgtttttttgttttgtttttttgtttttttttttaaagtctagccgggtgcagtggctcacgcctgtaatcccagactgtgggaggccgaggcgggcatatcacgaagtcaagagacggagaccatcctgcctaacacgttgaaaccccgtctctactaaaaatacaaaaaattagctggacatggtaacgggtgcctgtagtcccagctaatcaggaggctgaggcaggagaatggcatgaacccaggaggcagaggttgcagtgagccgagatcgtgccactgcactccagcctgggtgacagagcaagactccatctcaaaaagaaaaaaaaagtctgttaaaataaaggtcatcaaaagatcttttcctaaacctttcctttaccagaaatatctctagagtcacatggtcctttctcccttcttgcttttgtaggagtccaaagctaatctgtccctgatccggattgcaggcacctgtgccttttggggcccttctgcattagttcttccttctcttctaacctcaaaaatgtgttttctctgttggctctttccctttaacatagaagtatactcacgcttttgttgaatcttggaataaaagtcttcctttaccacatatctccctttaatactacatctctcttctcagccaaatacttgggaagagaagccctgagtttgtgtcattgttttctcacctccagttcactactttacccactgcctgacatccagctcgctcacacacacacacacaagcccagtcactaagttgccatagctaatttgtagctttcctgccctcctggcaaaatttgactctgcattgggataatacatgttgagtacctattgaacaggcactgtgctaggtgctgctgttatagatatgaaaagaaggcatcatctcctttctaacaactcacaggagcagccattcctgattcatatgcaggtctcttgagtctcattgctcacttttgcaagcttcacttaatgccgtgcaaatcaccctattctccaggtcttctttcttcccagttctccttactatacacaacttctcagggcagtcacctccacacccatggcttcaattgctttctccattctctgagaacaatagaattttaaatggcttttttttcatgtattagctttattttatacaaggtgcctcacttgctgtaaccatagattcaaagttgctccatgaaagtaataaatgaaaaatggtgatttttttagcatgtaaattttaggaaatttccccagttacgcttaatggcttgatttagtatgtatgttatttttgaaaacatatgttgggatgtcacaaatggacttagcctacagaggtttatattcaacttttgaccagagagttccattttaatgtgacactgagagtaaaaaactatcttttcctccttacctatttctcttcctacattctcggccaggaggaaggcactgctacatacccagtcttccccagcagagcctgagcagctctgttttccttctacttcccctcttctttcacatctcatgaccaagcacttcctattctgtctcccaaatgatcatagactttttcctccgcttttgtcactgccactgcccttagcattactctgcctttagagaaagtctcttaatttgtttggttgcttccttcagtccttattgtacagaccactacacacacatctgacagagacttttcaccttttcatggttcaatgactgaaattcccagaataaaattaaaaccaccccagcatcaaatttgaggtcaaatagaggtgggtttgtatcccaggttcatatactgtccagcagtatggtctcagaaaactgacctccttaaggctttgtttgtgtatctgcctacactcattgagagttgggactatttcacacatacagtgcctggcatgtagaagggacttaatcaatgttgaaagaaggggaggcattttaaaatccacatcaaaaaaatgttgttctgttcgggagtggtggctcatgcctgcaatcccagcactttgggaggccaaggcaggtggatcacctgaggtcaggagttcgagatcaacctgaacaacatggtgaaactccatctctactaaaatacaaacattagctgagcatggggttgggctcctgtaatcccagctacttgggaggcttaggcacttgaatgagaatcacctggacccaggaggtggaggttgcagtgagcaacgattgtgccactgcctgggcaacagagtgagactctgtctcaaaaaaaataaaaaaaaaaattcttttaaaaatatacgaatctggctgggcacggtggctcatgcctgtagtcctagcactttgggaggctgaggcgggcctgaccaacgtgcagaaaccccgtctctactaaaaatacaaaattagctgggcatggtggcgcatgcctgcaatcccaactacttgggaggctgaggcaggagaatcgcttgagcccgggaggcggaggttgcagtgagccaagatcatgccattgcactcctgcctgggcaacaagagagaaactccgtctcaaaaaaaaaaaaaaaatagtgttcagcaaggttgaagcataaaaggttaatagccagaatcatttatcaattgtatttctatacatctacaagacacaatctgaaaatgaaattagagaaacaatttcactgggcaacaagagcaaaacttcatctcaaaataatcatcatcatcatcatcatcatcatcatcatcatctacaatgtcatttcccatccaagcttgacttctacctttactttctgatatggttttgccatgcccccacccaaatctcatcatgaattataatccccataatcctgatgtgtcgagtgaggggcctagggggaggtgattggatcacgggggcagttatcctcatgctgttcttgtgatattcagtaagtcctcatgagatcttatagggttttgttttgttttgttttttgggatggagtcttgctctgttgtccaggcaggagtgccatggcacgatcttggctcactgcagtctctgcctcttgagttccagtgattctcctgcctcagcctcctgagtagctgggattacaggcatgcaccaccacacccagctaatttttgtatttttagtagagacaggatttcactacattagctaggctggtctcaaactcctgacctcagttgatccacctgccttggcctcccaaagtactagggttacaagtgtcagccaccgtgcccagctgagatctgatggttttatacttgtttgacagttgctccttcacatgttcccactctctgtgcggccaccatgtaagtcggacctgcccttctgccatgattgtaagtttcctgaaggacttccccctctgccatgattgtaagtttcctgaggcctccccagccatgtgaaactgagtcagttaaacctctttcctttaaaaattacccaacctcaggtatttctttatcagtgtgaaaacagactgctatactttctgataatcatgcttaagcaattggggaattcagactagctgggatcaaactatggccccacccttagcagtcatgtgaccttggggaggttacttaccttctccgtctcaacaacttctgtaaaatctgtaacatgagattgtttctgagggttaaatgagcatagcacagtggggacactgtcaggcacacactacttgccagatgtcgagtattcctctttattgaaataggactgtggtaagccactttatggctctcgattgtgtatgagaaaatcatgcttagtgccttgttagtaaaagaaagaaaacctgaaagtccctgccatggaaggaagaaatagcggggagaaaagggagttggtaagtttcagcatttcagagcttggaggggcaagttaggtttctattttatggagaaggaggtggaggcaggatgggtcctaaggtgtcattcaaaacacacagccataactctttattgagagtagagctagggccccagggattgctgtggtcaagttgcggacaaaaatgaccactcgttggaagacaggagaggagtgtttagttacaaaagcagtcaacaattcaggtgtatctatattcagtcagcaaataaaagttgttcaacttggttgctaatgggacccactctactgaggctttgtatagaactcatagaggaagatggcttcaaggaatgaactaccctgtgcttttcttaggactaaaatctcaggaagctggtgatgaatgaaaaccttagtcccaatggcactgcacgaggggccaggagagcagcagcatcataagccacagggtggggcagccaaggcaggggcattctgagctgttggggaggggtggcaggcagggtggggcactgtgagctgtcggggagggcattgtgaagtgtggggtggggcattgtgtgccacatgcctgggctcccacctggggccagtgggcttcagtctgtaggtgactacagaaggaggaggaactccgtctgttctctcttcaggcagttgttgtgtctctcagcgcttgttggtttcacaacctattaaataagccggctggtcttcaccctcccagacaagtcaactcaggggaggcagcagggtgcgggccttggcccgcagccctagccggggccggggccagggctggtgcccggggcctcgctgtgaggtgggcaggcgaggagcgggaagaccatctctgcaagtgcagcatagcctcggcctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagacctatgaggcaggagctagggacaggatggcaggagcgcccatggctgctgctgtacagcctgctgaggtgactgttgaagttggtgaggacctccacatgcaccacgttcgtgaccgggagatgcctgaaggtgaggaggtgataggtgccatctaccctcggtttgcctctggctgctgctgtccccatggttccctttgaggcatcccacacttcgagctcctttctgcttgtagccagctttcccgggggctggccaggaacaaaagctggctctgccttgaattcccaccccttagtctttccccaccgagtccagtcagtttcttttcgcctcccctcccaatcgcccagttcttgctctctcatctcattctcccaggctggcatgggaccatttatttatggctcttgtcgaataagcagcagttgaataaataagttgataaatttttataaatgattacatcctttttcttttctccctctatacatatagctttggagtttaacctttctgccaatccagagtcaagcacaatattccagaggaactctcaaacagaaggtgagacaacagtgtctgtagctctatttattatcctgtggtactttgtttaggcttctttgagctattctcttccttttctcagtaaaaactcaaatatcccaacttttcagtacccatcttattttttctttgtacctatccagatggtacctaagtgaaggaaccaggtaagtgcctaattgtttcctttgttaaagtagccaaatctcaggacagttcctattcaaatatttggggatttcttatttaaaatcagaatggaggttgccacgggagaggctatatggtattcttaatgggctgctttaagtcaccttgatagaagctgcttagtttcttctaactgtaatttgaacacaaaaggaaaaagaaaaaaggagagtgcttaaagtaattgtgaaaggtgtaaaatgtcacagccggggctgcagaaaaatggttgtgtgtgtgtgtttggggtttctcaaaggagtttacctatgaggctctgattactttaaaattcttactttaacagaaaatgtgtctccagatttattctggtgacttaacagactttatttacctgcttgttctaaaagagaggtggggattggttcatggtcaaaactttcaaaagacatgaaacgtcaatgtagacttttaatgtgtaatataaagattgcaggttaaaatgtcagaccttccctgtaagagtgtttgttgccgtggctccccgtttgtcccttcccctcctgacaatagcatcttgttcaaagataagaaagttacagttttggctgggcttggtggctcacgcctgtaatcccagcactttgggaggctgtggcaggcagatcacctgaggtcaggagttcgagaccagcctggccaacatggtgaaacgctgtctctactaaaaaaaaaaatacaaaaattagctgggcgtagtggcgcatgactgtagttccagctactcacaaggctgaggcaggagaattgcttggacctgggaggtggaggttgcagtgagcagagatcacgccaatgcactccagcctgggtgacagagcgagactccgtctcacaaaaataaaaaggaaagaaagttggagttttttagtctctatgctgttggcagaggcaggggatgggagccggtagaaaagagaaaacaattagttcgtttgcctcaaaaattttgcaaagagatgaatctaagtaaaagtaattctgggtaataatatggttcttgaataaaaactgaaattttcaaaatagaaaacattgcatcataaacatattaaatccagttggcttattggtttcatttaaatgccagagatttcattactgtagaggaaatgtcttatagctcttctatttaaactttggtcgggctcttaatttttaaagaggtaagataattaagactcattatgagtgtgactttgtaacttggaagtactatcttcacatttcaagatatttaaggattgctttagaataaacaaatgcattatgtgaattaattgattgtacctttatacacaaagcatgtaagtacttgtgtaaacttatactctgcttggtgatgttcggaaagcctgatggatgttacacaccagttagtagatgggtagtgttggatgagagcccaaaaatggctctttattgtcattctttaggattacaacacagtttatgtatgtctcacttggccctttccaatagaaataaggcctgtgtatgttctccctatgtattgttaatgaagaaatgaaaacttagagatatcacatgactatggaagacagctactcaagagaactaaggttctgtgtcctcagaatgaaatggaagtgacagatacgatgaatttactttttaaaaattttaaaaactctagaatacatcttatattttgcctataaaatagacctgtcttttaaaacttactgacatcttgatttattttatgcaaagttgattttagacaactcaaagccaaaatttacctcttctgtttttttttttttttttttttaataaaggagggtgtcattgtgttactcttgctggcctcaacttcctgacctgggttcaagtgattttcccatctcagcctcctgagtagctgggactacaagcatgtgccatcttgcctggctctatcttatgtctatacattcatttcaatggataagaatcaaagtagagatagtgaaatagcctaaatgcagcagtcgaataaacgagttgataaatttttatcaatgattacatctttttttcttttcttcctctgtgcatatagctttggagtttaacccttctgccaatccagaggcaagcacaatattccagaggaactctcaaacagatggtgagacgacattgtcttttccaccaagagaaagaataaaagctcttgtttgatcaggttatagaaagtatttagaaaaactcatattggtttaaatttttcaccttttcacatgttcacttgtcttattttaatatgtgatatactttcctttagttgttatgatgttagtgaaaacgtgtaacctttttgtttatacattttgccatctttttatcaacacaattaatttgtcatgtgatggaggagtcatggatttctctttataattcttggatttatctttatttataattaatggatttatctttatttataatcccttttcccttgctccaaaaagtacactttaaagatgaatgatagaacttaggcttcagcttggttttcatttaaacaaattaaaaaacatagttgtttatcatcagggattgaatctgtgatttgggcctcctcttacacagtcctctgaccacattcatttaccacatccaagttcatgctactcaaaagttttaggttattaactttttcatttgatgtaatgtaaatttaaacatgccctactcctgcttatttccctcaatgttatgttaaatcctcatttatttgccaacaagccatacacagccaagttttccggttgacttaaacagcaagaatacaagtgagggttctataataatgtgcgaagtaatgcagcacagtaaaacacgggagtttgcaacctttgtttttatagtttgagtagactttgcccatcttgagtcagttatttctggttagaatttgtcttcattttttacattactgtaaagagatacttaaggctgggtaatttataacaaaaagatgtttaactggctcaaagattttcaggctgtacaaacatggctttaacatctgcttctggtgagggcctcagcaaacttataatcatgataaaaggcaaaggggaagcaggtggttccacacggtgaaagagggaggagagaggggaagggggaaggtaccacacttttttttttttgttttgatatggagtctcactctgttgcccaggctggagtgcaatggcacgatcttggctcactacaacctccatctcccaggttcaagcaattctcctgcctcagcctcccgagtagttgggactataggtgggcaccataacacctggctaatttctgtatttttggtagagacagggtttcaccatgttggccaggctggtctgaaactcctgacctcaagtgatctacccgcttcagcctcccaaagtgctgggattacaggcttcagccaccgcacctggccagtaccacagtcttttaaattaccataatgagaatgtgcttattaccatggggatgggaccaagccattcataaggaatccactgccattacccaaacacctcccactaggccctatctccaacattaagggtcacatgttaacatgagacttggaggggcaacatatccaaaacatatcagaattgtatttcccagttccttccagaggcatgggcttctcacacctagagagcatggaagcagtaaaagaaaagctattccatgtccctcactcttcagtggtaggagcttttgcctacaaggcccttccagcatcaaaggcagaggcagtgtaggaagcaaagcatggcccaagtccctcttggggcttttattattctggcctctttttagaggaaaaaaaaatgattttttgtgctgcagacaccatgtccaattaggtttgtatactcattttaaacatcaaaatttaggccaggctctgtggcttacacctgtaatcccagctctttgggagactgaggtgggtggatcacgaggttaggagatcaagaccatcctggctaacacagtgtaactctgtctctactaaaaatacaaaaaacaattagctaggcatggtggcatgtgcctgtactcccagctaatcaggaggctaaggctgaagaattggttgaacctgggaggcagaggttgcagtgagctgagatcccgccactgcactcgagcctaggtgacagagtgagactccatctcaaaaaaaaaaaaaaaaaaaattaagatatgttactttccagttgtgtaaagaccgttttttaattttgatttgtttttagtgacatattagtagataaccactaagtgtggttcaagatgcttacagggattctgttgcatctagagataggtgtctggtcaggaagtagttcttagagctgttagctcttagagtctgataattaaagtaagctatgtataaatgcagaatgagagaatactaatggatcatggctcatatatgcaacagttaaactttttattagctaaatttttcatctggcctaatttttttacccttttcttttgtacatgaggattctttcatttgtatgtaatagaaacaaaaagtaaactaaatgaaaagctaagtttttagatttgacttatgaaattaatcatgccagataatttaaattataaattattgaaaattattttttaaatggaattttgtctcattttacgtaggagtaatcagtaagatgttaacaactacttttattttatggtatttgtatcagaagtgaccagttttttttttttattcttagttgtagaaataagaagaagcaactgtacaaaccatgtaagtaaacactcaaatacttaagaaattgatagtttgacataaaaggatgtctctcttgatttctttaaattacaatgtggacctggtggtggtagcatggacctctttttgtggattttctaaatctcttctattttcctgagtattaaatttatccagaaaagtgtttagtttagcgtgtccaccttttaaagatttctgacatttaagttaaatttcaatagtctggttcaaaagatctgccttacggctgggcatggtggctaacgtctgtaatcacaacactttaggaggccgaggcaggctgatcatctgaggtcaggagtttgagacaaccctgaccaacatggtgaaattctgtatctactaaaaatacaaaagtagccgggcgtggtggtgcatgcctgtaatctcagctactcaggaggctgaggcaggagaatcacttgaacccaggaggcggaggttgcagtgagccaagatcgcgccattgcactccagcctgggcaacagagcgaaactctgtctcaaaaaaaaaaaaaaaaaaaaaagtgcctgaaatatttaatcttatttttaatgaaagaacaaaaatagaatagttaagttaattgccagcactgtctattgactttctatcacagcaggtaaaagcataccttccccgctacaccatgatcttatgtttctccctgtgtttcttccaattgtagcacactttttaattaaatcagtaatatttacatgattatgactctgcaaatattattcactgctaagtcatatggtgttttcactgtgtctctgcattccatgtccttcatcctgtctctgaaacagttctgaaatctgagcacttctgcaattctcctggatcttcttttttcctagcctacgttagtttatctatccaaatattgttaagtagcctctgggtgctctgtttgctttcacatccattattttttagcatgaagctaattttctgactatattcatttgcctattttctaacagctgtttttcccccaagtattgtagcatttatcacatgcctttcaaagatattttccatctgcaaaagcacatctgtttctttttatgtgtgtgtgtggggcaactttctttggccttttgtcatcctagttcaatatagcgtgggtttccctagatatgctcgatgtctgcttttctgggctaactccttaaagtcttttgggatctcacgtaactgctgtcttgtgtgggatcgcctgagtcctagattctgtgtttccttctgtcctgttatcatctctagttgtagttgaacacattttcctgggtggagatgttaaaatccctcctctttgatagagagtacacctctaggttgaatctaaattttatggttctgaagacattttgcagctgtgctcttattacagtgttgttcttgaatctattgccagtgtgtgatacgttatttacaaccaggttttagttatctgcggaagctttttagaatctctctctctaaggttctgaaattttataacagcttgttggggatcttttcattttattgaggctactaaacctgcagactatctcttcttgagaatttttttttattttctctgttacttttttactgatagtcttgttattcagatgctaggctgcttagaccagtatgcctgcattgatttttaatttttccccttctatttttttcagtttgtctttttattctagttctgggatattctgtgactttatcctctactatttctattgaattttgtaatttttggagtgttttaagatttttttttaaagttttgctcctgattttgactggtcctatcaattccttttttctattgttttgatctcttttcttggaggcttccttccaatgtgtggtggtccctggcctgctttatttggaagcaggatttctgttaactgatagcatcagtgtgaggccttagaagcctgactagcttttcatttgggagacctcagtgtattatctggggatctttattgaagacatttcagtttcttctgagaaggatctcccaattttctgcctggaaagtaaaagcaggcctggaaaggaaaagcagagttagcgaagaaagttggagttccatttttggtgtacagttttctttatatctcaggtttaagccatggtatctctgagccagaaattctcaggtttgatatatccagagaacacacatctaagtttcttgtcagatggaaggacaggtggacttggggctctagttagagatttgcaactgaccttgctggcttttttttttttttttcacattttaccctactttccaaagtgccattggcctgtaagttcacaacctgcctttagttctgcaagacaaactggctcacttgtgttccagtcactttctgtaggcaccaaagttgtgtttctgtgttatttaccactcctttatctactttttatgtctcagcatttattaaaaattatctctgtcaaccttctgtgctggtcatgggtgtaacctttattttatgactgatgaggcttccggagggagacgaaataaatttgtggtcaatctattatatttaatccaaatttaggacctgtgtttaaatcaaagtctaatttgagtataattaatgatattaagccagagaattttttaaattaatgtatctataataagcatattacacttttctcctaaggccttgtttaatattttcattcaaagtttatccactgccatatacttcccattacttcacaacatagatggagctgttttcctgaatgcccaaagtgttagaaatatttaagttaaataagatttgttcatttttagcctggtcaacatagcaagagctcatgtctacaaaaaggttaaataacaaattagccaggcctggtggcatgcgcctttcgtattacctactcaggaggctgaggcagaggatcacttgagctcaggagtttgaggctgcagttaactataattgcaccactgcactccagcctgggcaacaaagggagaccctgtctcggaaaaaggaaaaaagttactaattctttaaaaacctatctaaaatttgtcctgcccaaaaggagagtgaaaaatatgaactttagtctttgttttattttatgtttgctgagaaaaatgctgtacttttatttatttatttattatttccataggtttctgggggaacaggtggcatttggtgacatgcctaagttctttagtgatgatttgtgagatttaggtgcacccatcacctgagcagtatccgctgaacccaatttgtagtcttttatccctcaccctcctcccagcctttcccccaagtccccaaagtccattgtatcattcttatggctttgcatcctcatagctcagctcccacgtatgaaagagaacatgatatttggttttccatgctgagttatttcacttagaataatagtcttacttccatccaggttgctgggaatgccatgaatttattccttattatggctgaggtggaattcctcatatatatatatatatatatatatgtatgtatatcacggtttctttatccactcattgattgatgggcatttgggctggttccatatttttgtaattgtaatttgtttgagttcctcatagattctggataatagccctttgtcagatgtatagactgtgaagatttcctcccactctgtggttgtctgtatactctgctgattgttccttttcctgtgcagaagctctttagttaagtctcacctatttgtttctgttgcatttgcttttgtgttcttggtcatgaagtctttgcctaagccagcgtctagacgggtttttccaatgttatcttctagaacttttatggtttcaggtcatagatttatgtccttgatccatcttgagttgatttttgtgtaaggtgagagttgaggatccagtttcattctcccgcatgtggtttgccaattatcccagcaccatttgttgaatagggtttactttcttcactttatgttttaggtggctttgttgaaaatcagttggctataggtatttgagtttatttctgggttctctattctgttccattggtgtatgtgcctatttttatatcagtaccatgctattttggcgactatggccttatagtatagtttgaaatcaggtaatgtcatgcctccagatttgttgttttttcttagttttgttttggctatgccggttcttgtttggtccatataaatttcaggattgttttttctagttctgtgaagaaggatggtgttattttgatgggagttgcattgaatttgtagattgcttttggcagtatggtcattttcacaatattcattctacccattcatgagcatggggtgtctttccatttgtttgtgtccatgacttcattcagcaacgttttgtagttcccaacggcatatcaaaaaataatccggccaggcacggtggctcacacctgtaatcccagcactttgggaggctgagggagacggatcatgaggtcaggagcgggagacggatcatgaggtcaggagttcgagaccagcctggccaacatggtgaaatcccatctctactaaaaatacaaaagttagccgggtgtggtggcgctcacctgtaatcccatctactcaggtggctgaggcaggagaatcgcttgaacctcggaggcagaggttgcagtgagccaagatcaccgcactgcatactccagcctgggcaacagagcgagactccatctcaaaaaaaaaaaaagataatccaccatgatcaaatgggtttcataccagggatgcagggatggattaacatacacaagtcaataaatgtgatacaccacataaacagaattaaaaacaaaaaatcacatgatcatctaaacagatgcagaaaaagcatttgacaaaatgcagcatccttttatgattaaaaccctcagcaaaatcagcatagaagggtcacagctcaatataagaaaagccatctatgacaaacccacaaccaacataatactgaaagggggaaaagttgaaagcattccccccgagaactggaacaagacaaggatgcccactctcaccacttgtattcaacatactactggaaggcctagccagagcaatcacacaagagaaaacaataaaaggcatgcagatcagtaaagaggaagtcaaactgttgctgtttgatgatgatatgatcatatacctaggaaaccctaaagactcctccaaaaagctcctagaaccgataaatgaattcagcaaagtttcaggagacaaaattaatgtacacaaatcagtagctctgttataccccagaagcgaccaagcttagaatcaaaccaagaactcaaccccttttctgatagctgcaaaaataaactaaactaaaataaaatacttcggaatagacctaaccaaggaggtgaaggatgtctacaaggaaaacaactttagtatttttaatgggttaaaatgagaggcagcaggtacagcagaagaagtcagtgcgtgggcatccgcatccaatgggtactgcacctttgatggtaaggctttggttttgacttactaaattactaggtacgattattttctagtttttgtcattaaaccttaaaactactaagtaaccccttccatttcttgttaaatattgtaaaatttcatactctcatttatgctgcctgacgttagagtatttgtttctattttgtgactaccttaaataatacctataaagagtaaactgttagtagtgtttttgctgtaattaaatgtagtaagacttaccttccaaatgataactgaattgtcaaacacttgtcgaagttttggatttactcaaaattctatgctcagcagctggaggtaggaagagtaagggccctcccttactcttatggagaggcatactttctcacaaggggaatactctgcaggaattagcatcttgtaagcagtggtgaattcaactaattagtgtataaaaatacattttttggtgtggctgccgacaaagagatccaagagggtagatggagtcgagcttgctgaagcaaggaaagagaaaagcagtattctaggcagagagcaggggtagagcaggaaaatggctaggtgcaggtcagatgatttatagaatgcaattgatcaagttttgaagtgaatgcaaagtattctccgagagtctcatttgagtcatgtcttggcagtcttatttaaacatgaagtgaaagttagattttttaagttgtcatttgttttcagggtgtgagagaatatttaagtgatactctttttatcctccacataagaaaataggactagagaaacctatggcttcctcacttgttggtggcctagcagccctggcacacagagcctctgaatctgaaacacttcttttgtaacaatatcacctgaaataatacatttaggattagtaatttagtaaatgcattagtcttgtattcactgcaataaaatgctcttgtagcaggattatttaatacattacattttatcgtagtaaataaataatagaagggctgggcgccgtggcttacgcctgtaatcccagtactttgggaggctgaggcaggcagatcgcgaggtgaggagatcgagaccatcctggctaacacggtgaaaccccgtctctactaaaaatacaaaaagttagccgggcatggtggtgggcgcctgtagtcccagctactcaggaggctgagtcaggagaatggcgtgaacccgggaggcggagcttgcagtgagccgagattgcaccactgcactccagcctgggcgacagagcgagactccgtctcaaaaataaataaattaattaattaattaatagaaattctcagctgctttttattgctgcagaaaaaaaatgaaatcttattttaaacttttcttttttttttttttttgagacggagtctcactttgtctgccggcctggagtgcagtggcgcgaactcggctcactgcaagctccgcctcctgggttcaccccattctcctgtttcagcctctcaagtagctgggactacaggggcctgctaccacgcccggctaattttttgtatttttagtagagacggggtttcaccatgttagccaggatggtctcgatctcttgacctcgtgatccgcccgcctccacctcccaaagtgctaggattacaggtgtgagccaccgcgccccgcgaagccgacttttcccattatttttaacggtaattcataaaatccttgttaggtttgatgacaggtaccatattaagggcagcattttataacccatatcttaaacatcatctctggaagttgagagcctccaatgggttttctatagagtgcacatgataccacactcaggcagttcatggagtgtaagacatatcttagtgctttgtcatttgacattttaactgagaaaataatacactttgataagtttgacttacagttcccttccccttcaggtatctgctgtgcgtttcagtcaacaatacagcttgtgttcgacaatattccttgatgacagcacagccatccagcattatcttacaatgacaataatatcgtgagtacaactatgctgccgagggacagattcctttattctaaaattatttcagtcatttggttgtccttttcagcaatcagtttaagaaattggagtcaaccatatattgatatccagattctgaatattaagtatcagtttctcttttaatcttagacgtcgtggtggaaggaaaaatcagttagcaaagaagcaatcccagaaacagtgtatctttttgatgcctttatgcctttagacaatgttgaacacagtgagaaggataggttccctttattgaatgttttttgtggaaacttagtttttcaatgcatcataggcctaaatcagtgtgcactactttggacattatccttggaagaaggaacagcttttcttcttctggcaccacagtgtatctgcatttgaatttctcccattgtgcatgagcacctcatgggccacaaagatgcgctttgagagcaccctgagatgaagtttattttaaaaggaacaacaaccaacaccaccaccagctccacaggggctgtccagtgtacattattctcatcttcttgggttattagtcttgatttttagaacacagtttggaaagtgctaatttagaatattaatgtctttatctttaatttaacttttcattctgtacacataactagcttataaacaattttgtttcaaatgcactagcctttttaactaattcaattgtcaataacttttacttcaattaaaagtggaaagtttacactcataataatgtcactttcctccctcccttttaacaatagttgagaggaaattgtgtttcgaacaaaaactggactcaaactctgtctcaagtcctgagctttgggacctattgagtaatcactaaatgtctgtagtcagctaagtctcttaaatctttgagcacacatacacaaaaattactttgactagagtccctggcttcttctgagttccaaagattttgatatgttagcatataattcaaaagcagctttgaagattaattttgctgaaacaaatttcgtgcttttttcctcattattctactttttagaagtctacttttgagagtatagtaagttttaatttgccaccagcaagtttgagaaatgatcatttggtgtattcactattggtgaaataaagttattgaacaaattaatagggcaaattggcttcaagaagatattttgaaaaatgttttatcatgaatcagtagtgcactgttgtcagtgggataggtggaactcgctgagatcacttatgcaaggtttttttcaaaatacaagtctgcaaacacatgtatcttcccatctccactttccctctgtctctaggcactgagaagccttttaggaaaatcgggatggatgtgaggcatctttctgtgaagaaaagcatcccagaagattctgattttcaccccagctcagtcattccaaactttgctgctgattgaaatcacctgggaaacgtttaccaagaaccttgatgcccaaagccatacccaatactaattaaattaaaatgtctcatgttgaagatgaggcagatattaaagcttctcaggcgattttaatgtgcagcaaagtttgagagccactgcttaatttgagtttaggacgagaaactgctcctatttggtgggaccttgggcaagtcagttttaaggtctgtttccctgatctgtaaaacgagtgttgaattaaatgtcacataaggtcattggtcctttccagcatgtaactttaaattctgtgattttaaaattatttcagagatgaaaactacttgaagcactatagacatatccatctcacatgctaatattacaggctttttaaaaagtgctaatattgtgtagacctattagtagaattgagatttgccttccctcagttgttttgagactcactctacaaaattagctgggcgtggtggcacatgcctgtaatcccagccacttgggaggctgaggcaggagaatctcttgaacccgggaggcagaggttgtggtgagccgagatcacaccattgcactccagcctgggcaacaagagcgaaactccacccaccccacccccccaaaaaaaaattatctgagcatagtggcgcaaacttgtagtcccagcttcttgggaggctgaggcatgagaatcgcttgaacctgggtggtggaggttgtgaggagtcaagatggcaccactgcagtccagtctgagcaagagagacagactctgggtcaaaaaataaataaatacataaaataaatcgcatgggacgaaaggtttcatgggtagaaaagcatataacagggaaatctgttattatttatatattgtaatcaccaacagaaacgcgtcttctaacggcatatttccttgcattttggttctcatatttttgtaaaaaacaaagaaatgaaaacaaagtgcccttatggtactgttctgaactagaagatttgaatttcagggccgctaggagagtttcctctgccccccttttaaaaaatgtcttcaggcctaacaaatgataacatctattgttatgaattttttttccttccacagtgtgaccttggagatacctcatcatatcacacaaaggtgagctttttagaaacctgtcttgttattctagctaattactttgcaagatatcaagctcagtgttaggtcacagctctagacatcataagctgtattgtgcctactaaaatatcgaagcaaattatttgtattttctttgttccttaagactctcataattcttaaatgactgagaatctcaaagagtatgtgtttatattgattatattgatatttagtgtggtagaattatacagttgaaattttttcaaaatctgtttttagtttagatttcacagccttaccactgttgatattatgggctagataatgctttgttgtgaggactgtcttgtgcattgcagagagtttagcggtattcatggcctctaccaactagatgtcagtagtaacccatgacccaggttataacaacagaaaatattccttgagaacagtattgttaacagaaatttttcattgaaaaataacttttctacaacaaaaagttgagtaaaaagtgcgtcatgtatttatattatttgaagtctctcatgttgagcttaataggagacaaatggattctctagagctttctttgcaatttgctttaaagaagcaataagaggctgggcacggtggctcacgcctgtaatcccagcactttgggaggctgaggcaggcggatcacaaggtcaggagatcgagaccatcctggctaacacggcaaaaccccgtctctactaaaaatacaaaaacttagctgggcgtggtggcacgcacctgtagtcccacctattctggaggctgaggcaggagaaccgcttgaacttgggaggcggaggttgcagagagctgagatggtgccattgcactgcagcctgggtgacagagcaagactctgtctaaacaaacaaacaaaaaaagcaataagctggtggggcgcagtggttcacatctgtaatcccagcattttgggaggccgaggtgggtggatcacttgaggtcaggagtttgagaccagcccgaccaacatggtaaaacccgcctctactgaaagtacaaaaaatggctgggcgtggtggtgcatgcctgtagtcccagttacttgggaggctgaggcaggagaatcgcttgagcctgggaggtggaggttgcagtgagccgagatctcgccattgcaccccagcctgggtgacagagagagactctgtctcaaaaaaagaaaaaagaagcaataagatgacctaacctcatgcaaatatgtagttggtagaaggtgtatttttaaagttttcagacagttgtgggtatttgttaacactaaatcaaaacttcacaagtggtggtttcttaaattagttacggtggcattttacatattaataaatttattccatcagtactcattgatctttcttgcacagtaaatggatcttttgctccatacttgtatttataatatcatgcattagttacttggaatatattggtttatgttttattgtgtcaaaaatcacttttagttgaaccaccaatcttactttaacacgcctttaagtattgaaaagctgccaagcctacagtagaaggaacaagtttttcaaagtccagaggaaagcttaaattttatcattgggaacaaatacgtatttcccttgaagtgacaacctctcacttcatttatttttgagaatgatagttgaactggttttttagaccgagtttcactctgtcacttggctggagtgcattggcatgatctcagctcaagcaatcctctcacctcaggctcctttgtagctgggaccacagatgtgtggcaccatgccaggctaattttcttatatgtttgacagtgacagggtttcgttatgttgcctaggctggtctcgaactcccgaaggagctcaagccatctgcctgctttggcctctcaaagtgctgggattttacaggcgtgagccactgcgctggcccagttgtacttttaaataaaaatgatgttctgtgaaaaaagtgatttttcagttcacagttaaatcacggattctttaaaaacaaaaaaaaaagcgcttctggttaactttccacttattcagaatattagagacatgtcaagatttaacaacattaatttttactgcttcatcaaagacgttcttacgaaattcaggctatgttttttacctgtaggggacagtgaagaatagaatgactactaatgtaattggtaccactgccttgatttatgctgagaaaccagccattgtacccacttttgcttttatataatcatggcaagtgtcaatgaaaaagcaggcaatgactttgtattactttcacaaatttttaaaatttttcatcagctttctcaggtttaattagtatgattcagaacagtgttggccaggcacagtggctcaggcctgtaatcccagcactttgggaggctgaggcaagcggattacctgaggttaggagttcaagaccagcctggccaacatggtgaaaccacatctctactaaaaatacaaaacttagccaggagtggtggcaggtgcctgtaatccctgctacttgggaggctggggtaggagaatcacttgaacctgggaggcgaaggttgccatgagccgagatcacaccattgcactccagcctgggcaacaagagtaaaacttggtctcaaaaaaaaaaaaaaaaaaaaaaaaaagaacagttatgacctcttaggccttctggaaggggtcttcgggatcccgagaggtccacacagcacatttggagaaccactggtttatacacaggcacaatgcattagttttacaaagtttaaagttcatcaaagactggcctcttaaaaaggcagatgagtttgtcattcaaacaacagaaagtacataaatacatcatgagagtatactacagagaactaaagagaaaggaagctaggaaatctgaatcacatttacatttattaaagtttactactactgctttgtagaacattcttgtgtttcaatgtgtggttagaagagtgaaaatatgtttggtttattgccatggcctgttagggagagtcaatactcacgggcatttctgactggttatcatataaaagacttcacgatacaggccatgatgtgctgagaaagaagaagtcaggaaaccctctgcaagtcaggatccaatagaagaattcataaaaactgctttggtaaagtaaacaccaaagcacacaggaggcagtattttactaaacaaatattatactaagatattaacagtttttgaagtaatgcgctttcttattttatagagatgcagatagaactttgagcatacctgatgaacagttacactcatttgcggtaagtggcacttttattgaggttgtattttcatcatacacttgtatctgtttcatgctgaagtcaaagccatctttttttaaatcttccccatttcatgttgcatttagtcatcttaagtgttgtaaaaagaatgtgctggagtaagaactgatctgcagctctgtttagttagtgagctagtatgagtaaatatactatccaaacaacagaagatgtatctttttttttttttttttttttatggactctctttctgtagcccaggctggagtgcaatcgcgcgatcttggttcactgcaggctctgcctcccaggtccctgttcaagcaattctcctgcctcagcctcctgagtaactggaattacaggcatgtgccaccatgcccagctaatttttttttcttttttttttttgtaaagacagggtttcaccatgttggccaggatggtcttgaactcctgacctcgtgatccacccaccttggcctcccaaagtgctgtgattacaggtgtgagccaccatgcctggcccagaaaatgtatctttttaaaaggtaattgtgagctgtctataggaccctgcaagccactacccaatttttgaagccattcctcctcctgttccacacaggtttccaccgtgcacattatgaagaaaagaaatggaggtgggagtttaaataactattcctcctccattccatcgactcccagcaccagccaggaggaccctcagttcagtgttcctcccactgccaacacacccacgcccgtttgcaagcggtccatgcgctggtccaacctgtttacatctgagaaagggagtgacccagacaaagagaggaaagccccggagaatcatgctgacaccatcgggagcggtagagccatccccattaaacagggcatgctcttaaagcgaagtgggaaatggctgaagacatggaaaaagaaatacgtcaccctgtgttccaatggcatgctcacctattattcaagcttaggtgattatatgaagaatattcataaaaaagagattgaccttcagacatctaccatcaaagtcccaggaaagtggccatccctagccacatcggcctgcacacccatctccagctctaaaagcaatggcctatccaaggacatggacaccgggctgggtgactccatatgcttcagccccagtatctccagcaccaccagccccaagctcaacccgcccccctctcctcatgctaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcccccacctttcccgtgtgcgatctctggagctggatgactggccagttgagctcaggaaggttatgtcatctattgtcaatgacctagccaacagcatctgggaagggagcagccaggggcagacaaaaccctcagaaaagtccacgagggaagagaaggaacggtggatccgttccaaatatgaggagaagctctttctggccccactaccctgcactgagctgtccctgggccagcagctgctgcgggccaccgctgatgaggacctgcagacagccatcctgctgctggcacatggctcctgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacgagtgtgtgtagtatctgttttatttgactgcagtctccttggtgcaaaaacaaaatgggaaaaataaggataactcagaatttcaaaaggaaatcacaaattcagctaatattagcattttcagtacttttcgtaaactaagtaaatacacaaaatgttgatttttctgaccataagacgtattttatgtccttctgccaaggtggatttgttagtctcaggccctcctggccacattgcccaagtcacacaggcttctgtattatgtatttagataaaatgtgtgaaaacatatttgaaataaagttcataaatatgcattgatttttgtacacatggcacctctttttcatttttatttttattttttttggacgatgttttgctctgtcaccccagctggagtgcagtggcgtgatatctgctcactgcaagctctgcctcccggattcacaccattctcctgcctcagcctctcaggtagctgggactacaggtgcctgccaccacacctggctaattttttgtatttttagtagagacgtggtttcaccatgttagccaggatggtctcgaactcctgacctcgtgatccacctgcctcggcctcccaaagtgttgggattacaagcgtgagccaccgtgcccagcccatggcacctctcttaatttataaattgaactggatgtgaagtaataatgtcagttagttgagataagagggttacagattggctgggcgcagcggctcacacctgtaatcctagcactttgggaggcctaggcggactgatcaccaggtcaggagattgagaccatcctggctaacatcatgaaaccccatctctactaaaaaatacaaaaaattagctgggcatggccgggcgtggtggctcacacctgtaatcccagcactttgggaggccgaggcaggcggatcacaaggtcaggagatcaataccattctggctaacatggtgaaaccccgtctctgctaaaaatacaaaaaaaaaacttagccaggtgtggtggcgggcacctgtagtcccagctacttggaaggctgaggcaggagaatggcgtgaacccaggaggcggagcttgcaatgagctgagattgcaccactgcactccagcctgggcgaccaaacgagactccatctcaaaaaaaaaaattagctgggcatggtggcgggcacctgtagtcccagctacttgggaggctgaggcaggagaatggcatgaactcaggaggcaaagcttgcagtgagcagagattgtgccactgcactccagcctgggcaacagagcgagactcggtctcaaagaaaagaaaaagagggttacagatcactgcacatggaaaatattcccagcagtaaacacttccattaatgtgatctacagcttttaaaaaggagcatctcagaataagatggtggtacaatttgctgattgagaaaggaaaaaaaaaaacaacacatgagtatattacaaagggaaaagaaggaatgtgatttctcatgattgaaagcttgatttagatcgcatacagcttttgctacccaagaccaagcggctctggcaagacagggttgttttccgaatgccagaccgaggtgccttatgaaggcagctgccgatggttccagatgtagagagataggtgatgcaggagggaaagctggattggaaaagggagagttttgtagacgggctacgctcattgtgcctttgaaagagcagagccggcagcctgtagtcatcatttggatatacaggactagagcatgaatctgatatagagctacagaatgaagagcaacagcagctgtttaaataccgagaaagtgtgtagaatgaaatgggacaagccaagcatggtgttttcatgcctttagtcctaactactttggaggctgagatgggggaattacttgagctcagcagtttgagtccagcctgggccagatggtgagaccctgtatcttaagaaaagaaaaaataagaccaggtacagtatctcatgcctgtaatcccagcactttgggaggccaagttgagaggactgctcgagtgtaggacttcaagaccagactgggcaataaagtgagacccatttctaccaaaaaaaaatcaagaaattagctggacatggtggcacatgcctgtggccccagttacatggcatggcaggctgaggcaggaagttcacttgagcccaggaggtggaggctgcagtgacccatattcatgccactgcactccagcctgggcaacagagtgagaccctctctcaaaaacagataaagtggacagaaaataggtcggtaaggactaatcatttaagggacaagcccccagaagagtggctactagagtgggaggaggaaaagcagaaggagaaagagttgaagataggcgaggctgtggtcccagtgctgaattctgccaagcagtgacttgattcatgaacactcactggatgctgactctgttgctcttctgagtgctggggtagaggagaggagaggtggagcacagttcttgcttttatgagcttatgttctaggaaattcaaacaagtattttttcaggtagtatgaaatagcaggaagaggaagcaggctaaagggacacagagtgattgggggctattttaagtagaatgataaggaagagcctgtctagagagctatttgaacagtgacctgactgaagggacaacagaaagcagtgctgacattacaggtagcaggatgactgccaagacagaaacgcatttcatatgtgtttgaggaacaaacagcaaggtgaccagcatggggagagtgaagaatgagggaaaccttgaatgagaataaagcaattccattttggatgctaatctgccatattctgattaatcccagttccaagaattcatctacgatttctattttatctttttaacaaaattattttttattttttattttttgagactgagtctcactctgtctcccaggttggacttcagtggcacaatctcagctcactgcaaacttcacctcctgggttcaagcgattctcctgcctcagcttcccgagtaactgggattacaggcgcctgccaccacgcctggctaatttttgtatttttagtagagacgaggttttaccgtgttggccaggctggtctggaactcctgacctcaggtgatccgcccaccttggcctcccaaagagctgggattgcaggcgtgagccaccgtgtctggccatacacatccctgctgaagcccgcattacccttcccctatgctatagaagccctgggtcgggggggtgggggtaatggcacagggatccaccatcttatcttggtgccatccctgacttgccttctgttcataaacgcctattaaatgtttctttctgagaaactggatttgtcagcctctttctttggtatctcaggttccttggcctttgcgggtaggtttatatagacctgctcagcacaggacaggcagtttctcaaaaaattaaaaatagaattaccaaatgatccggcaatatcacttctgggtatatagccaaaataattgaaagcaaggtctcatagaaatatgtgtacactgatatttatagcagtggtattcacactcgtcaaaagatggatgcagccgaattgtccataggcagatgaattgataaaatgtggtatatacatacaataaaatattcttcagccttaaaaaggaaggaaattctaacacatgctacaacatggatgaacattgaggacattatgctaagtgaaataagccagttagaaaaagacaaatactgtgttctttcacttatgtgaagcgtccagactgagtaagcaaactaatagaaacagaaagtagaacgggggttgccagggacatggggaagggagaaaatgggaagttgcttagtggatatagagttttggttttgtcagatgagaaagttccggagattggttgcatggcaatgtgaatataccctacattacccaacccaagggctctccttgaccctgttccaactgtcacttagaagtggttaaggtagtaaattttatgtgtgttttaccacaattcaaaatagaattattatttttttattataattttttgagatccctcactctgctgcccaggctggagtgcaatggcgccgtctcggctcactgcaacctctgccttctgggttcaagcgattctcctgcctcagcctcccaagtagctggaacttacaggcacatgccaccatgcccaactaatttttgtatgtttagtagagacagggtttcaccatgtttgccaggctggtctcgaactcctgacctcaggtgatccacctgccttggcctcccaaagtgctgggattacaggtgtaagccaccatgcccagctgtcaaaatagttttttttgtttttttttttttttttgagatggagttttgcttttgttggccaggctggagtgcaatggcaggatctcggctcatggcaacctccacctcccgtgttcaagcaattctactgcctcagcctcccgagtagctgggattacaggcacgcaccaccatgcccagctaattttgtattttattttagtagagatggggtttctccatattgatcaggctggtctccaactcctgacctcaggtgatccacccacctcggcctcccaaagtgctgggattacaggtgtgagccattgtgcctggtcttttttttttttttttttttttttttgggatggaccttcgctcttgttatccaggctggagtgcaatggcacgatctcagctcactgcagcctctcctcctgggttcaagcgattctctttcctcagcctcctgagtagctgggattacaggcatgcaccaccacgcctggctaattttgtatttttagtaggtatggggtttctccatgttgatcaggctggttttgaactcctgacctcaggtgatccacccgcctcggcttcccaaagtgttaggattacaggcgtgagccactgcgcctggcctgaaaaaaaattttaaagtttgagaaaatacaaaattttcatagtctccatgtatttctcctaagatctttccccgtatgagggggaaagatagtaactttacaacggagaaaaccagcagaaacctgaaccaaatgaacaagttcaacatcatcagtaagaagcactatcaatgccataactctgatggaatgcactgggaaggattccacatcatttttgtgctgtaattgccaaaagtgtgtaacttcagtccaatcatggaaatacatcagacaatcccaaatcgaagaacatttgacaaatagtgatcagtactgtttcaaaatgtcacggttatgaaagataaggaaagactgaggaactgttattgcagtcctacaaaacggcgagagactaagaaataactaaatgcagcgtgatcctgggtggaatttgggaacagaaaaaggacattagtggaaaaagtggtgaaactccaataaggtcttttgtttagcgaatatgttcattttaaattagttaaattatttaaatatatttaaacattatttaaatgtattaaattaataaaattggttattttgtgaaataattttaatatagttaaatatgagaatgtggatttcctggttctgatcaccgtactgtggctatctaagaggtgaatgttcagggaggctgggggaggaataaatggaaattatactattgagttggaagagagaaacctaccccatcagtcacaaaaccctcacattcatggcagtgtgccggaggttccagtatgaatggcatttcccagatgtcagtgcaaggtccctgtggagggagtggggctccctgggaatctagtggagagcattcggggctcccttcctcaggagcctgcccttcctgcacagaagcatcagcctcacctctgtaccactgcccctctgcctctcagaacccactcggcttcaggaagtttctactgccggcctcctttcctggatacagcctccagggactcagccctgccttcccaagtgttcccgccactcttgggaaggggcgctctcagatcccgcacccctggacttccctgggcaccacctgctccttctttcttcacttctccagctctgcgttctcactctgagggtcctctcctgctgggagtgtgtgttgctggcaacagtgaagattctcccctgggtggcccccccatgccctgttcttctgcacttccctggcttcctgtgttggttctgctggtgtcacctgcttttgggtttacatggcttcccagcttcctaacttctctgaagttgagtttgatgtgtgtgttgatgatgggctttttcttcctcctcctcctccccctcctcagtcttgtcgttgctccacatagtttccagaaggagaaaagggacactgtaaaattaaactgctgcaggccgggcacagtggctcacgcctgtaatcccagccctttgggaggccgaggcgggctgatcacctgaggtcaggagttcgagaccagcctggccaacatggtgaaaccccatctctaccaaaaatacaaaaatcagcaaggcatggtggcatgtccctgtaatcccagctacttgggaggctgaggcaggaggatctcttgaacctgggaggcagaagttgcagtgagtcgagatcatgctactgcacttcagcctgggtaacaagagcgaaactccatctcaaaataataataatagtaataataataataattaataataataatgccatgtttctatcagacccagaaatcccgcagagtgagctggaattctctgtttatctgtttccccttcatacccactggctcctctctgcccgctccttcttggactgcatcagcagggtgcctcactgtctggccctagtggaattcacacagtggaggacgtcataggaggtgggagagagagagagaggagaggtggttattcgctcaggttcttccttgctggtttggcagtggccacatctttctactgatggctgcagctcctgatgatcctcctctacagccacagccctctttgggatctgtggacacctttcctgtccctctagacccagggagataacagctcccactcttgctggtccaggacattcctcatctcttactggttctcttaactcggtccacacttctgtgaacagcccctttcctcaagtacccattcgaatatgtcctctggcttccaccaggagcctgactgatacccacaggtgggtgaatgctggcgtgctgctgggcccctcttcctctggtgactggccaggcaagtctccaggagtctcgttagggtgggcaggcggtgggcacagcacaaactgtgagctcaaatccacagaacaaaagtgggagaagacgctggcaggatggaccgccacaaaactcttggcattcgtgacgtctgtcctttaaatcacgcaaggcatcatcatgcttcagacatgagacagcctaagtatttaagtatttcaaataaacagattgtttttcagaattggtaattgctaagttggcaaattgctattggaaacattggctgtccttgactcaatgattcagccagctagtcccttgccaaactagttgggcaaattccaccttgagaatttatctgctcctatcaaagccagattctccctgcctgaggggaggctggacttgaccttctgactcaggatatgctgacttgggtccctaggtccaagggcggccctcttgggcccactgtgggctggacctcttccatgatggggtggtggagggcaggcaccacctgattcacccttgacctcatcgaggcaggtgaagttccctgcaggagtcacctgaacccagcccctcagatcaggatccatcatggtaaggaggattttgggctgtctcaggttctttggctagaaaagggtcccgctcttaggtgtctgccccagaggtgggacacagagggcctgctggggtccatgggctgggctgggtgggcggggatctggtcacagcagcagctagaaagccaagtgggagggcaccagggcctggggcccctgtctggtcctgggcctccccgggcctcttgccttctccccagcaggcgtttgggatctgtgtctggacccagccttacccaggaagtctagggccatggtgtgttgtcattagaatcacagtgctcacgccaaggcattgcattaaagcagggcagggtctcatgggcaggggaccagtagagggggtggagggaagggcagttgtccccagaggctgtggtgggcctggctctgggctgggcagtgggccagtgtcctgctgtgtggctgagctctgacaacaggctgtctggggttggtgagctcctgagagaggggactggtgcagagtaccctagggtgggagctcatgaggagggagtccgtggggtctggaagccattctagagcaggcagatgacacttgtcaggggaacaggcatagaaaggacccctgtgggggtgggggacatagagcctcaaaagaaacagggaaggggctttgacggatccagggagcatccctgagatttcttagcccaattccaaccagccatgtcccaggtgtccctcccccagcacccaaccctctgcagtgccagctcaatgccctgggcaaaacatcctggactctggctgttacaagaggaggacagggtcatctggacctgcctgaactccaggccccccactttcacagccccttctgggtccacaggttcatacgtatataaatgaaaaatgtgcaagaatcatattactgtattctttttcataaagaggcccctctaaattgttgaagccccgaatcacccctgcccaaaggagacagcaatggcatgtgtggggccgtggccttgagacccagaggtcctgctgcccatggtacccactgcccaccctagggggactggccatagccctggagcccccaaacaccatgcaggaatgcaagagggtctcagctcccgagtcccaggctgggagggcccacagtccagtaaactaatcaggccctgacatatccagtagagcagctccgggagcctgcattggggagagggcatcagaccactgccccaggcctgcaccccagaagtaggagcatgggaagacctctccttggctcctggccagtggaagtcacattccccagccctctggctccaaggcaacctcatgtcccagtcactccttggcccaccccaccaggttggctcactgccaaagggcacctcagtgatgagtggagggaacaggtgtttaccaggagcttgcatgctttgtctcagggatgattagggacacagccaagaaggcacactatgcccattttacagatgaggaaacggaggctcaggttgggctggtgactaaggaaagcagcatatggcaggtggcttgaggcatgtctgtccatcatgagtaactagggagcagccctgccactcctcatgtgatgcgccaggagccagggaagctgctttctaggggattctaggtaaggccagaagcatctccctgagtggtggtggaggcctctgtctactcctccaggactgccaggggataggagggcaccgctgacctcacagagcctcttgggtgagtgagcatcagctgagtggcgccaggtgactatgcttctgctcagtgctgtgcccccttctgcctcggtcaaggcaccaccgtgaatgccccacctgtcccatggaggccgcaaactgctctgcagagccagggtctccaggaatggggagggcagccaccctcactccacttgtgtttgtgacccaaaggactgcccgggtctccaggaatggggagggcagccaccctcactccacttgtgtttgtgacccaaaggactgcccaggtctccaggcccgtagaacccccaaacccctgactgggccacactggggaccttgagcagcagacttagattcttaggtcttgtctccgggtacatatcagtgcccaggcttgggaagcttgggtctcaggggggttggcactcaggccctctgcctcaaggaaggggcatgtccagatctctcctgtccagcctcagccctgctccctgcccctatccttcacggggtccctaggacagggttacagaagtctcatgctgtcaggcgatgctgccaccccagtgccggggtggctccacccagcccctttcctgctaccgtcctcactgactcacctgtccagcctcctactgggctggggcgagggcttgttgccccagagcccagacgagcaccagaggcatctctaaaggcacattgggccagtcctcagcatcctagttggccaccatctgctgccacatgatgctgggaggcctggggaagctggctgccgagggcctggcccaccgcaccgagaaggccaccgagggagccagtgaggacccggggctcctttctacctgggctggggggatctggggcagactgggtccattggaggtggatgttagtaggcaggcgaggacctgcggggaggccttggcccctcaggaaccctggaaccctggcttccagccccaccaggtcagcacggagttgagggttggagagctggggaggtctcctgggggcagggcatgagtcctggtgctgggtgaacactggcagcttggacccttccctctggaaatctggggagcctttcttatcaaaacagcctattctgaataacctatgcaggaaaaggaagatggatttttatttttaccacaactttaaagcttcaaagatttcttaagaaatcacccaaatctgatctgttcaaagtcaaaaaggacattttcaatttcatccaagtcccctaaagcatgtttatttttatttttatttttatttgagacggagtctttctgtgtcccccaagctggagtgtactggtgcgatctcggctcactctaacctctgcctcctgggttcaagtgattcttgtgtctcagcctcccaagtggctgggattacaggcgcccaccaccatgcccggctaatttttgtattttaagcagagacagggtttcgccatgttggccaggctggtctcaaactcctgacctcaagtgatccgttcctcttggcctcccaaagtgctggcatgacaggcgtgagccactgcgcccggtcctgaaacaaaaaaattgttttgtattcagaggtcagcagctgtgtgtgtgtgtggggggggggggggccaagcaaggccccacccatggatcatcgtgtgaaaaacagtcttgcctgagtttgtgtcctcactctaaatggcagcagacgtgtattttctttttgactctgcagctggtgtggaccacctgctttaacctttcactagcctctgagttttctatgattcctgttgggagaaaagctgagtgttgggagagcagtgggcctgctctgagccctctccctggactgggggagcagtgggcctgctctgagcccctcaccctgagctgcaggggcagtgggcctgctctatgccctcaccctggactttggggccagtggacctgctctgagccttcaccctgaactcgggggcagtgggcttgctctgagccctcaccctggactgtgaggccagtggacctgctctgagccctcaccctggactcgggggcagcgggcctgctctaagccctcaccttgaacattcaagatttaagaaagtttgccagcaacagattctgttgaaaagaactacttaagaagtcctcctgcaagaaatgacatgaatccagaggaagaagcagtgtgaaaaaagtaacaattctctaagtaatcagccaatgctattatttaagactaaagtattgattgccatggatgcttaaaataacaatttagaattagaattctggattatatcaacaggagagttggggaaaaggaaaacagcgggaggaagtgaacactcatcttgtttgggaagagtctatatgtactgtttacctttagattttgttaggcaacattatatatggatataaaaaattaaaagtattagaaaaataacaatgaaatgtataaatttcaaaccagtaaaggaaataagatggaacaaagaaatttcaatcaacccaacagaaagcaagaacagggacaaaaagagaaacagcataatcaatagaaaacacaaagataggccgggcatggtggctcacgcctataatcccagcactttgggaggctgaggagggtggatcacttgaggtcaggagttcaagaccagcctggccaacatggtgaaaccctgtctctactaaaagtacaaaaattagccgggcttcttggtgggcacctgtaatcccagctactttggaggctgaggcaggagaatcacttgaacttgggagtcggaggttgcagtgagctgagatcatgccattgtactccagcctgggtgacagggcaaggctgtctcaaaaaaccaaaccaaaacaaaataaccccacaaagataataaagtccaaacaaatgagtattcataataaatgggcaataagaaaaaaatcaaatgaataccaaataggcaattcatatgaaaatactattcaaggaaattaaaattgctaagaaagaaaaaatgctcgatctcaccatttatcaaggaaatacaaataaaagggcattgagatgctatttttactgattagattggcaagtatttttaactttgataacaaatgttagccggagttgggcaaatgggtaccctcatgtcccaccagagggagtgcatattagtgcagtcaatttggagggcatctgacatatctattaaaaccaaaacatttgcatgtgtgtgcaagaaagtatagtcaagattatcttagcaacattgctggtagcagtgagatattggcaatgatctaaaggtccatcattgggagaataactacatgaactattgtatgttcctaccacagaatactctgcagcagttaaaaacagtaacttagaatcatttctttcttttttcattttcttcttccttcctttctctctctctctctctctctctctctctctctctctctctccctttctttctttgagacagagtcttgctctgtctcccaggctggagtgcagtggtacaatctcggttcactgcaatctctgcctggcaagttcaagtgattctcctgcctctgccttccaagaagctgggattgcaggtgcccaccaccatgcttggctactttctgtatttttagtagagatgggattttaccatgttggccaagctggtctcgaacttctggcttcaggtgatccacctgccttggcctcccaaagtgctgggattacaagtgccccccaccagattcatttcttatagtacgagtagacttactgtgactacttaaaaattttcagaaggaaaggaacagaaacatattttatatgtgtaaagccacataagacaacactaccgtcttttcacaaagccctttcgccttcccgcttgccctcttctttcccctatcctgcttgccaccctctttttgccctccatctaccccaaaactattctccccatcgtctttttcccaatcctctttcctacctccctctcgccaccctcttttctcctcccacttgccaccttcttttcccccctccatccacccaaaagctttttacccaccgtttttctttctgcaccgtctttcttttctgccctctgtcttttcgcaaaaccttctctccctcccgctcgccaccctctttttccttctcccacttgtcaccctcctttccccatccagctacccaaaaacattttcccccacggtcttttcggaaaaccttgtctccctcactcaccactctcttttgacccctgctgctctccaccctcttttccctctccatctacccaaaaacattttttcctcactgtctttcccccctcgccatcttttcacaaagccttctccctgctcctgctcaccaccctcttcttccccactcctgtcccctctcccacatgccacccttttttcaccctccatctaccccaaaactatttttccatcgtcgttttcccaaccctccttcccacctcctgcttatcaccttcccccctccatctacccaaaaccttttcccccactcttctccccaccgtcttttatgcctcctgctcgccaccctcttttcccgctccatctacccaaaaactttcctccccactgtcttttctccccactgtcttttcacaaaaccttctctccctcttgctcgccccgttttctcccccctttaccaatctctctttagtcctcccacttgccaccctccagggtcaggccctaagtcctggcactctggacgcaccccaccgtcagcagggagaggcgcagggctgggaggggcctggagtcttgcctggggcatcacttttgcaaatttattttgtgcgggcctcggtttctctggcagcgattccaatggaagccagcttcaagccttggaacaccggcatttcccggcctagtgtcacagcggcgtctctcccgcccccaggacgtgcgcagtgcttggcacaagggtggcagcaatgccagcttcagcagcacagtatggccacacaggcccaggccccggcccgggttcgcgggttcgcgttagtgcggctctgccggagtaggcgcagagctttgggagttctgaacccctaagcgcgagtcgggcgggggagcccaggagcttctcggaggcctcagtgagcggcccatggggacaagcgtccagtcaggggcatgtcagagccggtgtcacatgtgcgtgcactaggggaaggcagcctggggtcgctccctggggccatctgcctgcaggaatgagtccaccgacttgtagctgagctgcaagggcgtcaggcagcggaaagtgccaggagagtgggggatctgcacgcaggccctctgtgaggacaccaccatctccccaggagacagccagggtggcactctggcgacgaggctggggtctcagtactcgccctgacaccacccccctccctcgtctcctcagcatcatagttgggggcctcctccgtgtctgaaatttgcaagtctttctcctgaatggtgaaattgtgcacggggctctacctgggcagcttcctattggggatgctgctgttttaccgcttctgggcgctctttggcttgtacagcttggctgccttcttgttctggttgatcctgagcttgctcaacttgaaggactccaggtgcttcctcatggacctgtggaagatttcccggtcccgcttcttgtcctcagttggtgtggctgtagcgatgcatgtactccttccccggcttgcacaggtactgctgcagcgtgtggtgcgtgacggggtcctccccatacggaatgctctgccacactgctccagggactgaacgtccagacagacggcactgatgttctccctcagaaggtaggagacagaggccaccatggtggacaatcgtgccgtgaagtccatgttgacgacgttatcagtacttggggagctgatgaaggccacggaccttaggcactctcctttggtggcttagctgatggcatccttcaggttcagctcatggaagacattgaggatcccatatggagacttctgggccagcattctcatgagaaccccactgaggaacttcctgtcaaagtgggaccacatctctctgagatagttgtgcctgatatgccgggatatgtccttgatggccaagaggatgtggttgaaagcatggtggtgcagcttctcatggagcttgggctcctggtgctcactcctcttcaccttcagccactgcaccagggacttgatggtcagcccctggaaaatgactgtgaagaagatgatgacggtggtgctgacaaacaggttcttctccttgaccttgtttctgtccggaagcatgaccaggatgaaggccatggccccatgcaggcctctataggacatgaccacctggtctatgatctccagctgcatcatccaatagcactacaggagtcaggactggatgacaccatggctcggtacatgaaggtgtaggccagtgcaggaggatgaaggccatgttccacgtccagatgagcaggttcatgaccgagatgcccagggatatgaagattgtattgacaccactggccagcatcttcacggtgtagtgcatggtgttggccgactgctccaagatgttggccttcatgtacttatgacagcagatgccacagaagataatggccaggatggccaacagcaacagcttctcagacgtcctatggacgggtaggagatgactaacacaaaaccaggctagatgatgtgcacatgcttggtgaagtgggtcaccagtgacagcaggaaggcaaagaccaccccacagtcatgccccccaggctcaccacaaaggacactacacttttggcatggtccacgctgatcatgttctcatcatccagtgtcacaaaagattgaaacacattgtacagtcattcagtagcaactccctgaagatgatgatgaacaggacctcattgacatgaacttcctcaaacccaaccagtatggctgctgggtccacagtggtgatcaggctgccgaacaggaggaagtccagcagccctatctgcaggttgcccatgagcctgctaagagagatgccatagaggaacaggatggtggtggctgcattgcacacagtgctgatgacctggtacagcaggatggtgcccagattgccaaagaagagccggttgggcatgaagtagtcggcatctgcatgatgggggacgtcaacatgaagtcgctatgtggtcggccacccagatgatgctgcccagcaccaggcccaggacgatgagcaggggtgctctcagggaccacggtgatgccttgtgggacaggtagaaccaatcttggccagcctgaccacaaggatgcagatcgcaatcaggtactggtcctggacattggcccattcaaaggcggccacgtgggagccctggctcacatcgtgtacactaccgtgctcctcctcgacaccccctcgcccgtagcagccacccagcaccagcgccactgccatcagcagccaccggcagcaacatcagtgctccatctccatgccagcctgggacacgcatgttgtggggagtcccagctgtgctcaactgatgcaccatgctggggctgctgaacacacaacccagcaaggagcccagctgcctttggggccgttgctgatggcagtccccttgttttgttttttaatcacacatcacttttttaagtacacacacataaaatatcactgaaatgagatattcttagaactttttttagttcaaagttcatcttctgtaatacttttgacttaaaatcatcagtgccctcatttttccacacattgttttctgttccatcaagagaaagggacaacaaactatcacccatgagccaaatgtggtccttcctttgcttttgcaaataaagatttgttggaacacagctacaatcctatgactgctttcaggccctgatgacagagttaagtggttgcagctgagcctgtatagcttacaaaccaaaaatattgcctacctggccctttgcacaaaacatttggtggcccttgattgaggagcgcaggaagtgaagcatttcttgcaagcatgtccactcatcctggggatgttttttgtttttttgagatggggtctcattgttgctcaagctagaatgcaatggcacaatcctagctttcttcagcctggaactcctagactcaaatgatgctcccacctcagcctcctgggtagctgggactacagacacaggtaaccatgtccaggtaattttcaagttttttttttttttttttttttttttttttttgtagaaatggtggtctcaccatgctgtccaggctggtatcgaactcctgggcttcagtaatcctcctgccttggcctccaaaagctgtgggattacagttgtgagccactgtgcccagcctgggatggtttttaagtcccatttttaagtcctgttttaagtttttaagtacttggttgttgctttgcaagaaaacctggattgcagacctccctgcagggatgaatatgtgtctgtctcaccaacatcacacaggcattctgctgctttgttcccaggcttcttgcgtgcacactagcttttcaattcaaagctgaatcacagtcgaactttctgaagacatttaaaatagcacctatactccacatgtgaaataaccatgcccaaatcttaattgatgtgacaacgctatgaaccgctgtggctgagtctgtatgagaccaggcaggacagccatgtcacagttgtgattagaagacccagctaaatttcaggtatatgaaaatgtgaaaaatcaagatgtgtatctttatattgatgaaatactgcaatgctcctcccttaggttataagcatgtgtggttaaatcaagacagtgcatgcgaacactgagccatgttcaggacacacttggcactcagtaaatgttgttgagatgaatttagtggagggatggtgacattgctctcctgacaaacccacttgagataaagcaggagagaagtcttgtaggcaaatcccatggagaaaaggcccggctgctgggaggcaggtgtgtgggagttgtggggaggaggtttctgggtattgtctgtgggatgggacctagagctcagctgtcatctctttgttttgtttttgtttttgtttttgttttttgatggagtttcactctttgttgccttggctagagggcagtggtgtgatctcggctcactgcaaccttcacctcccaggttcaagagattctcctgtctcagcctcccaagtagctgggattacaggtgactgacaccacacctggctaatttttgtatttttagtgcagacagggtttcaccatgttggccaggctggtctcgaactcctgacctcagatgatctgcctgcctcggcctcccaaagtgttgggattacaggctttttgtcttttaagctttgccaagataaatgccttctgtttggaaaggatgattttcaagagggccagaacctccttcctggttctaaaggaagtttgggccagggccccttgagcttaggggaaggcatgagtgcaaaagtgatgggggcaggtggttttcatagctggatgatgtagaatgcattgtggaagggtggctgcaagtggctttgcttagcttggccacctggaaggaggcttagggtcttccaagtggccagggccttgaggggattaacccagcctcttggttccagttatgtatgtggttcttgagtcaaatgggccagggtctatatccacggtgactccagcatcatggccaagcctgagtcctcctctgtctgcagagggatgacatagaggccatgccagggatttctgtccccacatcacacagctgatgtcatgacctagaagtgaacagtaagccagctgatgaaggggtctgtggggaacctagactatgaaaagaggtagggcactgggtctgccacacatcccctgggtcccttcattccccttggcacagggaagttcctctcctggggaggagaggcttgcaccctgcccctgcttctgcccgctactctgcctggttgttacggccacttggctcagcctcccttgcagctgtggcctcatgggaaactcaaagtctcaggaggatccagaaaccaagactcttgggacatggaatttggcaatgccctggtcaaaaccatccagagggagaaatctttacaaagatctcctaagactgcaaatggcaaaatgtttcccagtctccagcatccctttcccagcactcaagggaagacaagaggtgttagtgagtatctgatccagggctgcatctcctgtgaaatcttgtgatttataagatccagcaaaggctttagtcaggctaggaagaaattctgaaacaggggattccctgctggaaagcctgtatgccagcacaattaggaaagacttcaggaagaacaaaggaagccatggtgcaaaggtgtggccgacccaaatatttcagcttgaggagccttggctgctgttgggaatgagaagcaatggcgttggctgctccaagtccacatgtaatcgatatatatatatatatatatttttttttttttttttacttgttttgcttttttaagaaactttttggagacataatctcactctgtcacccaggctggagtgcagtggtgtgattttggctcactgcaagctccacctcctgggttcactccattctcctgcctcagcctcccaagtagctgggactacaggcgcccgccaccacacctgggtaattttttgtatttttagtagagacggggtttcaccatgttagccaggatggcctcgatctgacctcgtgatccgcccgcctctgcctcccaaagtgcttggattacaggcgtgagccaccgcgcccggttgaaacaaattttaacctaaagatacacagaactcaggtaccttcagcatgctctaatggccatcagcctatcccttctcccctgtaatattatgctgaagcaacatgcagacattatatgatttcatctgtaaatattttaatgtgtatctcttaaaaaagggactcttttcaagaaacataaccagaacagtgttattgtgttctgtttaataagaagcctcaaggtggttaacatcaggccttggagtgatgaacagtgttctctaagctggtcacttcctttgcagggtttatcctttgtgctcagtgctggtcagtgggtgggacagtcggtcctaggctgagcacaataattcagctccagtcagaccctgctgtttatctcaatctctctctcacttttgagacggggtcttactctgtcaccccgactggagtgcaatggtgtgattcctgctcactgcaatctctgcctcccaggcttaagcaattctcccacctcagccacactaccacacacagctaatttttgtatgttttgtagagacagggttgcaccatgttacctaggctggtgtctgtgtctctctctctctctaacattttatttttatttatttttaatttttattttttacagagatgaggtcttgctttgttgccaaggctggtcttgaactcctggcttccagtgatcctcccaccttgacctcctagactcaagagtttctaatcaggagacactcatggaagaacagagtaggcctcctggggatgctctgggactggagccttgcctcagcctctttattttaaaccttggtctaaagtctcctatgacctcccggctgagttcatattacacaagccccaaatccctttgtagcatttagaaaactgtaaccacagaattctgtgcctagctgtatacctaccgtcttgcccttgagaactaagtgccttgaaggcaagggtcctgtcttgctcaaatcttacacccaatacctgccacagcttgtagcacatagtaggtgctcagatcagctttgtgaaatgaagcagagaagtcagggcacctgggttcattccccagattttttttttttttttttgagactgagtctcgctctgttgccaaggctggagtgcagtggcatgatctctgctcactgcaagctccacttcctgggttcacgccattctcctgcctcagcctcctgagtagctgagactacaggcacctgccaccactcccagctaattttttttgtatttttagtagagacggggtttcactgtgttagccagtgtggtctcgatctccttacctcgtgatccacctgtcttggcctcccaaagtgctgggattaaagcatgagccaccacgcctggcccattcaccagatatttactgagcacccaacctgtgccagccactgtgctagaatcaaggaagacagcagttgtagaaaaggagaggaaaatccttatcttctcagagcttacattctgctggaagacaatggatgggcaaggagatggatgaatatatgctatgggaccaagcctttgctccaccctcaccttgctggatgacctggggtatttcacttcacctcggtgagccacagttttccatttctgtcaaataaggaagtagggcaagatggtctccttagaattcaaaacattcccagagggtctgcagggatttctcaaacattgaattgtcttccatccaatgtcaatgctttaagcatactgaggaccctgtttgttccttggacataattaagcccaagattgtgtgggcaggaaactcaatgctcatgtttcaggaaaagcactggatccaatgattgccaagtccaaccccagctcagatcagctaatcggggaccccatgcttctgcattatcttctttctgtttgtaaaacaggcacatcctaggtgcttcaatattgagttccagctgaatcagcccttccaaggtcactgcccagggtatgtatggggcatccctagccctgggctgtgaacccctgtctatccttgttactctcagcagaacctaaggatcaatggaagataaatggcaggggtcagaaatgtggggtttgtgtgtgaggaagagagatgcccaggggctccagcatcacttggaggacaagaaatcgatggagataagtggggggtcttgtctgggctggtgcaggagcacttcttgttttcacagacagccctcattcctgcacagccatgatcctcattccttagctgggtatcccaatgatagaaagaaaacatcaccaacaagttgggtattggggttctgaggtcaggttggacttgcctccaatctcagccctactgtgtggagcagtggaacccttatatgctgctggtgggcaaccaatttacagaggcaagtttggcagtttcttgtataacttacccttatcatgtgacccagcaactccattcctagggatctaaccaagagtaatgaaaacatattctcacacaaaaacttatacacacattttcataacaaaattattcataatagctcaagactggaaacaacccaaatgtgcaccagctgaagaatggatatgtagatgtttgtggtccatccatgcaacagaactttatttgtcaatagacagggatgaagccacaatggacattacaacacggatgaacctcagaagcattacactatgtgaaagaagccaaccacaaaaggccacactatatgatttcacttagagggaatgtgcagaaaaaggcacatctgtggagtcagaaagcagattggtggttgcgtagggctgggggtgggaatggaagattgactgcaaacaggcaagagaaatgttttcagggtaatagaaatattctaaaactggcttgtgctgacggttgcccaaatctatagatttactgatctaactgtacatttattgtgagtaaattttatggtgtgtaaattatgcctcagtaaagctgctgaaatatgcaaaataaaacccaaaactcaccccttgattcctcctgctgtgcaggctgggacaatcaactccagttccctgagcctcagtttatttatgtgtaagatgggcatgtactaatggaacctctcaatgagcatgccaggaggattcatataacagaaaatacatgcaaagacttttgctgggaactcggcacctgcacagggccctcaattatgtgggctgttggtgtcatttccatggaaccaaagagactatagccacagaactcctccttgctgacagctggtggggctggtgttggctttgttcactgagcatttccagtgctcggcattcactgtgcactgtaaacattctctaagcatcatggacaagtgaacaaaacagagcccctctacaggtgtccagcaccctttggggaatcagaggagaaaacaggtgtttgcaaccctgtgtgatgggcacatgtgctgtaggagcccagggagaaacaaactggctaaaatgggcacgtgaggggctcctcagaggcagctacacttgtgtccttgcaggaaccctgctgagcccgattctggaacagatcaggacaggaagagctttcaaagagtttctgtttcaatattcttttcattgctaggaaactgaggctgagaaagggttaggaactggctcagggtctgtggtgggagtgggatttgaatgctgtccgaccttgaaacctgtgttagtatgaatcctcccagaagcagacaccaagttaggatgagatcagcagagatttattggggatgcacgtgtgcaggttaagagaggggccaggagtgatcagggagagccttcagactgccatgtgagaggggagagggggaaggaaggaaggtagggcaggaggagtccgagacacagcacagctctaggaacgtttggccggatcagttgggagtctctggtggactattgactgttagaggattcccttgtcctgcaggaacaggtggcactagtaccctggcatgctcggttctggctgggagcagcctataggaagtgtggcctcagtgcccaggctggagtgcagtggtgcaatcacggcttaccacagccttgacctcttgggctgaatttgttcttccacctcagcatcctgggtagctgggaccacaggcatgtgtaaccatgcccagctaatcttttatttcttatagaaggtcttgttgtgttacccaggctggactcaaactcctggactcaagcaatccaccctcctcggcatcccaaagttctgggattacagatgtgagccactgggcccgaccggttggttgtatttctattggatagtgctggtctaacacaggttttctcagccgcagcactgttgacatttggggctgaatcattctttgtgttgagggtggtcttgtatattctacagtgttcaggagcctccccggcctccagctactagatgtcagtagcacctagttaatcctcaaggcatggcaacctgaagtttctccagacatcgacagaatcatgtagccacaagagcctgtggcttaccacatgccaagcactggtattaaggacagggtgttagggatacaaacagggaacgaatagtcctgcctatgtggcacttactttagtgggaagtagagacaatgaataagtaaatatacattgcccctggcaacaagtgtggtggtaaacagtgaaacaggaaaggggaccaggagcacacggtggtatgtgctagcaggcctcctgttgtgtgtatttcatcagggaggcctcacagagaaattgaagagtgaggaaacaagctggattctgagaccagtgtttgaaaaagtggcaggggccagtgcaaagacccagtggtgcacatcactgaaaacaaggaaggagatctctatgtagtgacatgaaaagactattaattagggaagaatttggaaagggggggccttgaacttaaactaggacaaatgatacacatctttctggtgaggtgggtaaacctttttaaaaatagctttactgagggccaggtgaagtggctcacatctgtaatcccagcactttgggaagctgaggtatttgaatcacctgaggtcaggagttagagactagcctggccaacatggcaaaacccagtctctaccaaaaaatatgaaaattagctgggcatggtgatgcatgcctgtagttccagctactcgggaggctgaggcaggagaatcgcttgagtccagaaggcagaggttacaatgagctgacatcacgccactgcagtccaacctgggtgacagagcaagactccatctcaaaaaaagtaagaaaaaagctttattgaaatataattcacgtgccataaaagtcactcatttaaagcccaaaattcaatggtttttattacgtacatagagttgtgcaacagtcaccacatttgctttagaaaattttcatcacctctaaaaggaaccccataccctgtaaccatcactcccaaattcccccagtcccccactcaaccctaggcaaccattaatctattttctgtcttcaaattggtctattacatttcacataaatagaatcatatgtgatttttttgtgactggcttctttcacttagcataatgttttcaaagttcatcatgttctaggatatatcagtacttcactcctttttattgctgaataatagtcccttgtagcaatatatctcatgttgtttatccatccatcagttgatgagcatttgagttgtttccaattttgggctgttacatataatactaagaataacattcaactgcaagtttttgtgtaaacatatgtttttctttctctttgaagtagctttgctgggttatgtggtaactcttatgtttagcaaattgtggcactaccaaacttttctaaatggtatggatcattttacagtcccatcaacaatgaatgaggttgccaatttcttcacacccttgccaatacttctgtcttttttattaaagctatcctagtgggtgtgaagtagtatctcattgcggttgtgatttccatttctttaaaaactaatgatactgagcatctttttaatgtgatcattggccatttgcatacattctttggagaaatgcctattcacatattttgtctatttttaattggattttttattgagttttatgagtttttatattacatattctagataaaaacactaacggatatataaatggcaaatattttctctcagtttgcgggttgctttttaactttcttgatggtgtcttttgagacacaaaagttttacttttggtaaagtctaatttggctatttttcttttgtcgtacttcaaaagcttggcctaacccacagtagtaagattgacttatatattttttctaagaattgtatagttttagctcttatatttaggtgtgttgtccaattacaatttagttttgtgtatggtgagaggtagggtctaactttattcttttgtctgtggataaatagttgttccagtatcatttgccagaaaaaccattctttcccaattgaattgtcttggatcctggttaaaaatccattttttgtaaatgtgaaggtttatttccagactcttcatgctactgatctacctatgccagcaccaccctatcttaattactgcagctttgtattaagttctgaaattaggaagtgtgagtcctccaatttgttcttctctttttagattgttggctattctgagctccttgaattgccataagaattttaagtatgccaattttgcaaaaatgttagctgggattttgacagggattgtattaagtctgtagatttggagagtattgcaatcttaatactaagacttctaatccataaatatctactatttttcagtttatatctaatttatttcaaaaatgttttacaatttttagagtacaagttttgttctctttttttaaatttattcctaagtattttattcctttaaatgctattataaatggaatcactgtcttaattaatttcagattgctcattgctagtgtatagaaacacaactgattttaatgtatcgatcttgtgcactgcaactgtgctgaactgtttatttagttcatttagttatttagttcttcctaaagatctactatataaaagctttatatacaagatcatgtcatttacaaatagagctttacttctccctttctaatctatatgctcttttattccccccacttttttttgagagagagtctcatgccagtcttgcccagactggagtacaatggcacaatctcagctcactgcaacctctgcctactgggttcaagcgattctcctgcctcagcctcccaagtggctgggattacaggcatctgccaccatgccaggcaaatctgtgtatttttagtagagatggggtttcactaagttggccaggttggtctcgaactcctgacctcaggtgatccacctgctttggcctcccaagtgctgggattacaggcgtgagccaccatgcccttcttatttccctttcttgcctaattgccctgctctagaaccttcattacaagattgaataaaagtggtgagactggacatccttgtcttattcctgactgtagaaggaaaccattaggtataacattaaccgtggggtttttatagataaccatttatcaggttgaggagcttcccttctattcctactttaggtgggttttctttttagtcaagaaggggtgtgaattttgtccaatgcttttttcagaaagtgtctattgaaatcatcatgtggttttctttcttcttttattcatatattacattaatttttgtgtgtcaaatgaatcttgcattactgggataaatcctatttgtacatggtatgtaatcctttacaaatgttgatggatttggtctggaagtatttcctcaggatctctgtgtctataatcataagagatgatctgtagctttctttatgtctgtctggatttggtatcagggtaatattggccttataggatgagttgggaagtgtttctgacatgggtaaatttttaaatgtatttcaggataggcaaagcctcagagtgggagaaggatatcagtaagtaaacctaggtgaacagaaagtgaacactatgaaagtgcaagcatcagagaaatgtgccatacataaattttttttacaattttttctaccaaaggatatgagatatcactgaactcactacaatataagcatgtttaaagaagcagttctttttaaagatggtggttttgttagtaatctccactccataagcatgatattccagaggcatctgaaatccaatatactcaaaacttataatttttcccacaaacctcctgctttcctgtagtccccatcttggtaaagagatgcctttcatgccatcactcaaaatgatctgtcaataattttggattttcccccaaccccatgacacctagaaatgaccaattctagacaatatgacttcctaatattgttttttgtttgtttgtttgtttttgaaacacagtcttgctttgtcacccaggctggagtgcagtggcgcgatctcggctcactgcaacctccacctccccagttcaagagattctcctgcctcagcctcctgagtagctgggactaaaggcacgcaccaccacgcctggctaatttttgtatttttagtacagatggggtttcaccatattggccaggctggtctcgaactcctgaccttgtgatctgcctgtctcggcctcccaaagtgctgggattacaggtgttagccactgggcccagcctcttaatattgtttatatctgacacccactccatctacaatgattagggcttaatttagggcttcattagctctcaactgagcaattttcatggcctagttttgatcctcgattcttgcctttcactctttcaacccatctgtccatgaagccagttttaatttcaattttgaaaaaatgtttatgaaaactagattagggtatcatatttttacattattcagcaatgatgtttaagcaagcagagaagtcacacaaagttctaaaataattttatgtttgactttagaatgcattgcaatgaaacctcaacaatgaaggaactaaatgagggaaatgaactaagttagtctaaacatgaaaaggttcctttttgaatagatttcattttttgagcagcagaactgagcagaaattacagagttcctatatgaccctcactcccacagccttctcctatcacaacctgcaccagagtggtacatttattacaactgatgaaccccacagtgacacatcattttcacacataaatagaagtttgtaatttacattagggttcactcttgacggatttgaactaatgcataatgacgtgtattcaccattacagtaccacacagaatacatacactgtgctacaaatcctctgtgctttgcctattcattcctctctcccctcagatcctggcaaacactacactttttaccatctccatacttttaccttttccagacataattcgggattttatagtatacggccttttcagattggcttctttcacttagtaacacacacttaagattcttccatgtcttttcatgggttgatatagctcatttctttttggtgctgaataacagtccattgtctgggtatagtacagagtttattaatacattcatctactgaaggacatcttggttgcttccaagttttggcaattgtgaaaaaagcttccatacacatctgtatgcaggtttttgtgtgaacatgttttctactcacttgggcaaattccaaggagcataattgctggatcatacagtaagaatatgtaagaagttgccaaacaatcctccaaagtaccattttgtattcccactggcagtgaatgagagttcctgttgctccccatcttccccagctttggtgttgtcagtgttttggatttcagccattgtaacagtcatgtaatagtacgtcactgctgttttaatttgtatttccctaatgacacataatgtggagcacagttatcttttgaaaatgtagaactgatcatgttatttcttgcctcaaggtcctataatgacttctccctgtctatagaatataattcagactccttagaaatgctcccaagattatgcatctcacattccggccccattttactcatctacaacctcacctcatcttgcaacatctctggtacttctatcctctaatcatctgcatctgcagcttcagaacacatcagcttctatattgttgctcctgctctgctctacttactatcttgtgcacacatggttacctgacaagcacctaatcacctttcaacattcagctccaatatcaactattccacaaagcttttatacctaccccctttacactactacctacatcatatattgcacccataacaatttctttattttattatttctttatttattgagacggagtctctctctgtcacccaggctggagtgcagtggcatgatcttgactcactgcaagctccgcctcccaggttcatgccattctcctgcctcagcctcccgagtagctgggattacaggcgcctgccaccacgcgtggctaattttttatatttttagtagagatggggtttcaccatgttaaccagaatagtatcaaattcctgacctcgtgatctgcccaccttggcctcccaaagtgctgggattacaggcatgagccactgtgtccagcccctaacaatttcatttttaactaaactgaagggagcacatctgatctctaccacctagcacagtcttttgcacatattggtactcattaaagctttgttcaaggaaagaatagatattttagtctttcaattgatcctcagaacaaacctgtgctataggtaaggtattctccaagttttagacattaataaatatttggttatcctctgtgttagcctgttcatattgctataaaggaatacctgagactgggcaatttataaagaaaagagttttattttggctcacagttccgtagagtgtacaaggagtataatgctggtatctgcttctggtgagggcctcaggaagtttacaatcatggcaagaggaaaggagccagcatgttacatggtgagagaacaagagagagagaagaaagaggtgccaggttgtgtttatttgtttgtttaagacagagtcttgctctgtcacccaggctggagtgcagtggcgcgatctcagctcactgcaacatctgcctcctgggttcaagcgattctcctgcctcagcctcctgagtagctgggactacagatacgtgccaccacacctggctaatttttgtatttttagtagagatagggtttcaagatgttggccaggatggtctccatctcctgaaattgtgatctgccagcctcagcctcccaaagtgctgagattacaggcatgagccaccatgcctagcccccaggttcttttaatccagatctcatgtgaaatcagagtgagaactcattcattaccacaagggcagcaccaagacattcatgaggatccacccccatgacccaaacacctcccactaggcccacttccgatactggcggtcagatttcaacatgagatttggaggggacaaaacatccaagccatatcatgctccaaaagtttgtttagagggatgttggcttctcacaggaatcccattctgattcactccaaatgaagtccatcaatgtttatccaactcataacatacatgcacatacaggaatctgctatgagtttttataatattaataggaaagataattaatttgggaatctgaattgcattgttcaaacttctagtgatcctaaagggagggcattacagaaaggaaagttgtttcttgtagcatagctcttttgagtgttgttgcaccacatttcaaaatgatgggtattagagtaatacaaggtaccaggctaataatactgctggtgatagtggtaaagggtcattgctcttaaataaaagctaaatttaaaagctgcattgcttatatatgactttgtatggagctctctaaacttaaccccctttctttcactcattcaaacaactgcttttataattttggataacatgaattcttaaaaacatacttatgctatatcaaataagactgtcctatagggtcaccagtgtgtgtatccccgaagccaacagtactcctacctacatagttgcggctctagcaacagaagtcaggtgtcaggactgcaaaatgcacatgacagaaataaagacatgagtgactatgactgccaaaggaatctggattgtttccttcaccacagtgttcttccatagtgagaccctgaaaataataggctgggggagggtagaagataacaaacagatttgcaagtccttcacctataatgagaatggataattcaattatatgccagaagaaaaagcacaaccccgttcagtattaattgtgctggaacttccaccataagtctgggtccagtcaatggggtaatttccaatatcctaaaagaactaagattgataaccaaaaggaaaatgtttccctctagaagatagttatgcttctcctcaggagtagaaatcactgtagcagaggacaaaatgaggccatgaaatctggttaagccagactggatgcctagagggtagctgaggaacaaatggaagctgcagcaggacaaagacccagccagtactaaaagctgggtccatgaacagcttcttgaaatggtgtgtggtcgtgcttagctgagcatgctgtgggactcatgatgttggaaaatgagggggcaatgaagacttaaagatgggatggaaaaacagctaaaaaaaacaaaacagaaggggaacaagaaacaaaacagaaaaaaagctggccacggtagctcatgcctgtaatcccagcaattcaggaggccaaggtgggagaatcacttgaggtaagaaggttgagaccagcctgggcaacatagcaagatccttgtctctacaaaattaaaaaaaaaattagctgggcatgatggcacacatctgtagtcccagccattcaggaggctaaggtgggaggatcactggagtcctggagctcaaaggtgcagcaaggtatgattatgccaccgcaccccagcctgggcaacacaaccagaccttgtctcagaaaaaaaacaaaaaaaaatgggggcaggtagagaaaaaagtatttccagaattttttacaattaaaacatatatctagctattaaaagtaatgacagcaaaaagatttccaaatcaattcccaaagcatttctctcatctcttctgaaaacgtctgaaaagacaactataaagatgaaatagaagttaaagctaaacaaggcaatagcgctaaatatgtaatttcagtaactcagaatttgctccatcctctgctctaaaaaagcttagctacagaagagcagttacctttgaaactttttccccaacataaagatatccagaatgtgaagctgccattaaaaatattgccataggctgggcgcagtgtctcatgcctgtaaacccagcactttgggaggctgaggcatgtggatcacaaggtcaggagattgagaccatcctggctaacacggtgaaaccccatctctactaaaaacacaaaaaaatgagccaggcacggtgacaggcacctgtagtcacagctatttgggaggctgaggcaggagaatggagtgaacccagcaggcggagcttgcagtgaacagagatcacgccactgcactccagcctgggggacagagcgagactctgtctcaaaaaaaaaaaaaaaaaaaaaaagtccaatggcaatttagattataaaacatgggaagtaaaataaaacttatatttgttaaactaagttgtatttaaactaagtattaaacttagtgcatcagtcttgaagaaagctcatgcctaagactttcctttgaactcaaatctagacagctgggctctctgacctcacagagcttcccatgatttcttcctccaacatctgccatgatatctcttcctactgtggttctgcactatattacgacaagcgacttgtttatttcaagggatcaacattaattacagaggctataaggaagccgaatgtaaaaataccaagaactcaaaaacttccaactccagagaagaatgacattttaattctaaaaatcctaaagcagattgaaaaaaaaagtgtaaaaactcatgcaacacacatgtgaacaagacacaatgaaaaactgctagtaatccttttaccacaagtctgaatgtggcctttagaaagcatttagggaaattctactcgactgtgctcacaccccttcaaatcaaagaactcccaagcacttgcataagtgctgtatctctggagtctagagtcttacaaatcaaagtggagtccacaagccagcagcagattatgcagaatttcaggccccgcccctattttctgagtcagaacctgcatttcacagggtgcccaggtgatttcctaaacatgaaggtttgagaagtgctcctcaatgtttagcagtgactaaatgctgaaatccactagagagcatcacaaaactccaatgacgaggctgtaccccaaccagattaattcagaatctctggagctgggatccactgtcagcactcattaggtcttttctttttattttttttccttttttgagacagagtctcgctctgtggccctggctgcagtgcagtggcacgatcttggctcactgcaacctctgcctcccaggttccagtgattctcctgcttcagcctcctgagtagctgggattacaggcaggcaccaccacgcccagataatttctatattttttagtagagacggagtttcgccatgttggccagcctggtctcaaactcctaatctcaggtgatctgcccacctctgcctcccagactgctgggattacaggcgtgagccactgtgcctggcctgtcagcactcttttaagttccccatggatcccagtgagcagccgaagttgacagcctttgttctaggacaagcttgtccaacccgtggcccatgggccacacacagcccagtatggctttgaatgcggcccaccacaaatctgtaaactttcttaaaacattatgggatttatgcatgaacctttttttttttttttttttagttcatcagctattgttagtattagtgcattttatgtgtgacccaagacaattcttcttcttccagtgtgggccagggaagccaaaagactggacgcccctgttctagaaccttggctatctttcctctgcatatctttttgctccaagctttaggtaatgtttttattttccctgaaccactataatactctagtaggagcaactacactgatgtctggctgttgctacagggggaacaatcactgacaatgtttaaaagaaaaaaactggataatccatcataaattcatatgttcgagtagaaaacacaaattatatatgcttgggaattccttgatgtggaaatgtgagcacagctgggtgggaattccttaaatgctttctaaaggccagagtcagacttttgtagtaaaaggattgctagcagtttttcgttgtgtcttgttcacatgtgtgttgcataagcttttctctctttttttttttttgagacggagtttcgctcgttgcccaggctggagtgcaatggcgcgatctcggctcacaacaacctccgtctcctgggttcaagttattctcctgcctcagcctcctgagtagttgggattacaggcatgcgccaccacaagctgctaatttttttgtatttttaatagagacaaggtttctccatgtcaggctggttccgaactcccaacctcaagtgatctgcctgcctcagactctcaaagtgctgggattacagacgtgagcctccacgcccagccgcataagcttttaatacattttttttgcaatctgcttcggaatttttaaattgctttcagtaagaacatgaacatatctatgacttatatatccacttcacccgctcctaacttgcctacaatgttaaaaaaaagaggaattattataacacaggaagatgtttaacactgaggattttttatgtcatcatatttaaagtctttttctgcacagctaaatctgattccctgctactaaatctgattgagttagcaactaaactaactgatttggtagtatctatccagatcacaaacagaaatattgttaagactccctcaaaaaggagtttaacctcaatatgtaactcctcctaactatagttctaaattaatgaaacacagtagtcatttaacaagatactagtatatatggccattggggtatacgggacatgctacctcaaaatatgacaccttggcatttgagaaaacagaagcagaaagatgtctctgacctctccctggcccttctcctctgaaggaggacatagaagaatcctctaaccctctctggagtaggtcataagaccttcattccagtcctccctattcccagaggaaaggagcctccttatttgtaaagatgcagagaatgatctgaccacacaggccttgctgagctccccccagcttattcccatcaggtcacacccctttcatctaatcgtgctccccaaaactgtccgcttcttcatcagacagcatcaaattgacacaggatttcctgtttctcttgagtttttctttctgaaggctcctgtgtctggtaaaacttatcttacgtaaacttgcacacttttctctggttaatctgtcatttgttctaagggactcaaccatgaacctagcgatggctgagaaatcatttcccccctagctggcctaactcatttgaaggagcatacactatcgtgtgggagtcatacttattcctaaccattttgaagagattcatctttaaattaatatattacattaaatgtcttccgtcagaaaagacaatcttgtgaacatcacctttggtgactgaacatcacgagatataaaacaggtagaaaaagaaaatatttggggtggctttaactcttaaatcccatgaaataatcccctcttctttagcagaaacctcagctcacctcctcatcactgctgaacaacagggcagatgctttctttttggagagctcggaggcttttgctttctcttctctctgagcttgtagacacaatgtctgcctcttagcagctgtacgcccaaaaagattatcctagaaaagcaaatggcagaaaggtaagacaactttataatcagaaaacataggatgtcctcctatatcaaactgttaggaagtaagtctccagtcaggtatacaaataacaactctggcggggaaaaaccgtaaaatgctagtaaatcccaaactacagccttttctcactgcacccatagaagggaaagaggttaccatagaactcaaaggcagaacagctgcgaataagcaggagaacaacatgcgaatgagatcacaaagtacaaggagaaactgagccccatccagtcaccctgtgggcaagtgcctctctgctcatttcagggggttacagcctgcaacgggcatgggagcccctgcagcagccagaaactcacacagtcctctccatgaatgagaaaccagaacaatggctcaaaggagagaactgggggtctgtctccactcctttacaggtcagaaagacacacacctgggatggagggaaggcatgacttgtgtttctcattagtttcaaagagattatacaaattggagaaatagtttactaaataaaattgctggtgtactaagtttaatggcatttgtaaattcttctgtggtcaagcactccccaaaagttatatttcttaaggtgcttttattcaggtaaggggaacaaaagcatcagagggcctgagtctgagttaggatggacaaactcttaacagcaggtgaacagccctggaatgtgaagatggatgaagggagtgtcttcctgaatgaagtctcctttaaggagagtgcggtaatgtaggacaggccaggagaataatgagctggtgtccattggggatgctaatgacagagctcacattcactatgcacttattatgtgccggcactctgcaagagcttcacactagtagttacagctgccacagtgaccctactcactgttaagccacatgagcttaaggaaggttaagttacttgccccaggtccctggtttgcaagtggtggagctgggatatgaacccaggggtctgatggcaaagcctctgagctcaccactgcccagtactgcatgagagttaaggtttgggttgtcttctctcttatttctcttccccactgtgctctctccagccaggatgggaaacaaaggcaatggtcaggacatggctgccttctcctttgtatctccacttgatccaaaacattcttgtaggtcattgggtatatgttgatccatcctctagactaaagtacagctgaccctgaatgacacaggtttgagctgcacaggtccacttctacacaaatgttttctcagtaatatgctgaaaatttttttgacatttgcagcaatttgaaaaatcttgcagacaaaccacttagcctagaaatatcaaaaaaaaaataaggaaatgctagatatgtcaggaatacaaaaatatataaatagatactatactatttataggttaatcaactgtttgtgttacccatgaggcctctggttaacagtaaggtgtcagtagataagtttttgggaagtaagaagttatatatggatttttcactgcaatgtggaagccaaaacaacctcctcactgttaaagggtcaatcgtatttctcaaaggaaaatttctaaaaataaaacctgtagatttcactccatgagaaatgtgtcaagaggccaggcacagtggctcatacctgtaatcctagcacttagggaggccgaggcaggcggatcacctgagatcaggaattcaaaactagcctggccaacatggtgaaaccctgtctctactaacaatacaaaaattagccgggagtggtggtgtgtgcctgtagtcccagctacttgggaggtcgaggcaggagaatcacctgaacccggctgcagtgagccaagatcgcatcactgcactccagcctgggtgacagagaaagtctccaactcggaaaaaaaaaaaaaaaaagaactgcatcaagaatctaatgtcttctccattgcacagctaggaaaatataaggaagaagtcactgaaataaaaacagaaatatttttgttatataaacttcaggtggcctgactgcttccctaccaccttttgctagtatatgagcctctgggtagaaagttacatcaacaaccgttttctcctaatctaaattatctagtgttacaataacaatgtttacctcttcatcttcatcatcaaacagggaaaccgacgtggggagcttgccaggcagcagagatgcaccttttaagttactcgcactttgagaagaaaacaaatcctgttggattgaaattaaagttgctggttaacaggaatatcagtttttaaaatatcaggtcagtataaaacacaagtgactcagacatgacagctgccatgtgtctaggcttctttcctgagagggaaggtggctcagacagagtccttaaagggataggcctcagggtctgtgcagggtgtgtgcagtggcactaaggaggaggagagctacaggatctggtggcctcacagagcccaggggcttctgtattcccacctgaatgacagaaggcaggaataagtttttgaatcaatttcctacaccatgctaaaaaaataaatatataagcatggcttcccattactgtctaaagaatcagagattagacagggtcaataaagaaacaggggctagattcccaaattaatggagctacaactattttatttagtaacaccctcctcccctaagattatgacttacttctttttcttttttttgaggcagagtctcgctctgttgcccaggctgcagtgcagtggcgccatgttggctcactgcaagctccccctcccggattcacgccattctcgtgcctcagcctcccgagtagctgggactacaggcgcccgccaccacgcccggctaatttttttgtatttttagtagagaccgggtttccccgtgttagccaggatggtctcgatctcctgaactcgtgatccgcccgcctctgcctcccaaagtgctgggattacagacgtgagctaccgcgcacggcccacttatttcttttaaataaattcaaattaaatttttatttgtaaatgtttggtagtctacttagtttaactacacgtatatgatgttgcaaaccaggatgagacctgctagattctgaataaactttcagcctggcgctgtggctcatacctataatcccagcattttgggaggctggggcaggtggatcacctgaggtcaggagtttgagaccagcctgggcaacatgacaaaaccctgtctctactaaaaatacaaaattagccaggcgtggcggtggttgcctgtaatcccagctactcaggaggctgaggcaggagaattgcttgaacccagaaggcagaggttgcagtgagctgagatcccaccactgcactccagcctgggcaaaaagagtgaaattttgtctcaaaaaagtaaaaaatataaaaataaagaaattttcaaaacgttataaaacatcagcttatcctgcaaagaaagacctgcaaattgagctacatgaagtagaaacataaaatgggacatctaatcccttgggaagagaaacattaatacacaagagccgaacaattaaataggacaagaacatattttctaagacctcttctgacagtttttttttttttttaaatcatggggttgttgtctactcctcaaacatagacctaatgagttcactaagtgagatctcctccacacagtgtttttcccctgtgcttcccagagtcccatgggtttatttagatagaagaggtcacaaggggaattccaggcatcctgtgcccctcctgaatgttacacaatggcaagagaaagggttctgctgttctaagaaaatgaaagtaaaccaaagcaaagaacaaaaacaaatgtcaacatcacagtttcggacccttaactaatacttttattggtactgcaaaaaaagacacttccattacctcaaatatgttcccccaaaatgacttcacagggcaagcttcagccccacacttgagatatagagaaaggagtcacgatgcattccttcgggtccaaagctttaactcttacttagactgccttagttttacttctccttgactcagaatctgaacaatatccaataaaaacattcactctatgatgacacacatggggcaaagcctttggtagggttttcacacaagtctgagagttcatttacactcccaccatcaagaaggggagcctatggcctctccccataaacctggatgggccattgtgaccatcttgaccaacaaatgaaggaaaaggaacaccgttgacttccaaggctggaagacagaaggcgacatggcctccaccggactctccctgaggactctcccctacagccctgagccagcatgtaagaggactggcttccctgactacatgctgggagccacacagggctagtgagagatgtcccaggggccccagtgcccaggtaccagacatatgagtgagctgaccctcagcccagccaccttcagacacaagagaccctcagtgacaatggcctagctaagcccagtcaacctctcgaagtatgagataacaaaactactggtgttataaaccactaggctttggagttgcttgtttcatagcaacaaataaccagaacacctcgtaagtcactgaaattgctcacattttgttttcttgtctaatcaacaattactggatggcttacaacatgccaagcactggtattaaggacagggtgttagggatacaaacggaataaaaagtcctgtccttgtggcacttactttagtgggaagtagagacaatgaataagtaaatatacactgtccctggcaacacgtgctgtggtaaacagtgaaataggaaggaggaccaggagcacagggtggtacgtgctagcaggcttcctgttgtgtgtatttcatcagggaggcctcatagagaaatcgaagagtgaggaagcaagctggattctgggaacagcattcctcagagtggcaggggccggtgcaaagaccctgaggtgcaggtgtgggtgacacaggggatccatgagcataagacggtggaggccccatcatgctgtttctcaggggtcagggttgtgacttgactggactttggttaattcccatgttttgtacactcgccttcaatgaaataatagcctcaaaggtattctttatgtcaagggcaatcactatacttccaaagggttccatgttcatccttgctgtgagtgcaaagcccaaccatgacagcctaacctagagcccacagtttcttgaaacacatgtaagtttctgccatgtccacatatttttctgtaaaaggggcttattatttcccattacatttctgatacaggtctccaatctcctaaaaggccaacataaaattagatctaagacgacctaggcctgagagactcaggaaaagcagtgaaattctgagaggtggttctaaggtgcctggagggaccaaagcaacctgtgaaccagggtcccacaggctgttagtggtctcagtctcgacaagacagatggctatgccagaacccatctgctacagcattaagccacggtctagttagtgaaaatgtgaataaaggaagtagcatggtgacctccactctggtgcaagctcctcatcacatcatgagcccatgaacagtttaaaatctgagcatcctaaaaagagagaattttcatcccaggaaacgtaaatacagtccaacccaaaagtgaaaagtattgtaaacatattgctttctaaagcccctgtgctctcaagagattattttttattcatttatttattttgagacgaagtctcactctgtcgcccaggctggagtgcaatggtgtgatctcggttcattgcaacttctgcctcctgggttcaagtgaatctcctatctcagcctcctgagtaactgggattacaggctcacaccgccatgcccggctaatttttgtctttttaatagtggcagggtttcatcatgttggccagcctggtctcgaacttctgaccgcaggtgtccgcctgccttggcctcccaaagtgcagggattacaggtgtgaaccaccactcctggtctctagagataatttttaaagaactggagtacttaacaaaaagtcttataactctattgagaaaaacctgattcaaaaatagtttctatgtcatatccatagactaatacccacaactaaggaaaagaataacatacctcagagtcctcctgatcctaaaataagcctttttgagtgtttgtttctgacgagggcttgagatttttgctggaaggtaaggtaacctttgttgggggaaaagaaaagaaaaagaaaaattaagcattaacaaataagatacccagaaaagagggtttactcaatcaaccatttagaaaacgcacggagtctctgctgtgataggcagcaagctgagggggctgttaggagaacagcaagacaaacagaggacacatctggtgtatcagggagcaggacacactgcctgggtcaatgggtgcacagatgggacatatgcaatgagagacagcatggaaagactggctgcctgacaggcctaccaggttctgaatgctgggccttagggggtcggcaggagaaagtcagggtttcacagccaggacatgacatgatgagacaaactgtagaaagaggagggaccagctgtacaggacagcagtgaaaggtcaagcagtcaaaagggcttaaaaactgctggggacacacacactggccaaatgcaggtcaatctgagcatcaaaaactatgatggtctggccaacatggtcaaacccagtctctacaaaaaaatacaaaaattagccaccaagagcaagactctgtctcagaaaaaaaggaagaagaggaatgatggtaatggattatcatctacactgaagaatgaattcatgatcccagagcaacactaaaaattagggaagcagaggaagaggaaactctttattcagaagataccaactaataagaaatatagaattaaaaaagcagtggtttatgaccactaacaggttaactgattcaggaaaagatcatcagtggattttcaaaacactgagtaaaaggctgggagagaacaggtattcacactgtgttcaactatcactttagagatcaacttagcaatggcaaaagagaacagggtagctttccaatgaagcagtgtggtgggcaccctagcaaccaagtgacaaatgtgtctgaatgaggcagacagtggacctgatgtatcttgggaggtgatccaactggaagtgcacaaccctgcctgcttgtattcttgccaaaactgctcaccctgaatctattcatagaaaaataatcaagcaaattcacatgacacattctacaagacaagtggctggacgttaaaaaaaaaaagaaaaaaaaagatgtgggagatgttgcactagattaaggagaccaaagagacaggacaaccaaatgcaatgcagacacactgcctgaatcctgggtttcttaaaacaaacaaacaaacaaaaaatcaaaatacacaaaaatactataaagcaggggtccccaaccctgggctgcagaccagcccatggcctgttaggagccaggccgcacagcaggaggtgaggtgagcagcaagcattactgcctgagctcctcctcctgtcagatcagtggcagcatcagattctcataggagggaaaaccctattgtgaactgtatatgcgagggatctaggttgcaagttgcactctcctaatgtccccaatgccaaaaaggttggggaccgctgctataaatggcattttggggacaagagaggaaattaccatataaactatatgcgagataattttaaatctgtattctatttgttggggtgattttacaaagacattctggggcaactggagcaattctaatacagactagatattagattctactatagaattactgttagtctcacagctgttgataatggcattgtgcttatatggaagtcttttcaagagaggcttaatgaaatatttaggggtagaatgtcacaatgactacatggaaacagttccatgcagcaaacagttcaaacaacttacatgcaaatagttcaggaaaaaaatagatatgtcacaaggtttacatccataaagtgtttgccaaaaccctaagaactgatcaatctgggtggcagttatttgggtgttcactgcaatgttctttccactttctgtttgaagttcttcaatatgaacgtgaaagggaacagtacttccctctgcgttccggatgaattattaaaatgctgcagatcaatgctcctgcgttaagtcttccctcctgctcacctttttttctgctcttgctttattttcatctgtctgactcacagtggcttctggcaatgctacggctttttctttgaacagatctccttcttcgtcaccaaagatatcagcagtggattggactttgcctttaaataccaaggcataaaattacaataaggccagaaatcctaccacaaaaaatcctaccacaaaattcatagaataaaaaatccttccctcccgaagattaatatgaaagttacgttgtttcttggttacttataaagaaatagtaagtggaactatactcttcccttcaaatttttcaaagagtgtattgacagctcagttgaaagacagaacaaatagtttaaccatgcagctgatatgcttatccaagcagcagtctcctgttgtggttacagaagcttggactaacttaaaaggtgaagagagatctagaggaagaaagatcacttaagaggaacaccaagtcaatcatcgaaggaatctgagaaatgaaggctgggctcctgctttaaaaaaatcaaactgggctgggcacagtggctcacacctgtaatcccagcacttcgggaggccaaggcgggtggatcacgtgaggtcaggagtttgagaccacactggccaacgtggtgaaaccccatctctagtaaaaatgcaaaaattagctgggtgtggtggcaggcgcctgtaatcccagctactcgggaggctgaggtaggagaattggttgaacccaggagacggaggttgcagtgagccgagatccgccactgcactccaccctgggtgacagagcaagactccatctcaaaaaaaaaaaaaaaaaaaatcaaactgtacaaaagcagataaaagcaaataatgaaattccctcataattccacctgcctactcgaacaacatggacattggaaacagttcagcatacatgcttccaattcccccaaaggatgtactaatgaattaacactagttatttacaaataaggctataaataagaaggtaatttgaacaatgtgtcttaccatttgtattttccacttaatgtacctataaaacattcccaagtcaacaagcatagaccccattcattttaacagtcgcacaatattccactgaatagaacggccatagcttactctactgatgaatattttcaccacagtaagcactgctgtaccaaatggggcatgtgttgctgaaatgaggtcactgactcatgaatgtccgaagagactaggagttgtcaaagaaagcagcatcaatttactagtgattctaaatcagttctcaaagatatccactaagtgagagccctgtggagctataaaaagcactactaccttcattcactgtcatcttcaccgagacctgcacgaattctgcatccgtttgcactctttctagattaactaggctattgttttccctcgcacttcggcttccatccttgctttctacacctaacactggaaaaggacagtaagtccagacagtctgcttctaaatgaattctgattccatctattcctatatcatccttttttattttttcaagttgctgaaaatcatgtgcaacttagggatctagggatctacctttcttttctggaagaccagtcaatggatctaagtcttgctattccaggtgtgatctacagaccatgaagcttgctggaaatgtaaattctcaggccccaccctggacctactgaatcagaatcttcattttgacaaaagcctctgggagattcatctgcacatttaaaaacaaatgatttacaggaatgacttcaggaacacaggacttacatttaagaggaaaaagaaaggagaatgccaaaaagaaaggagtggccaagcggatgaaaaccccataatgtgaagaaagaccaaggccacctgagctttttggtagagagaagagaagccgggaaataactggccagcacacaaaatgctgctcatgtaattgactaaggtcggctggaagaaaggatgattaaaactttataattccaaaggtcagaactgtgaattaagcaaaaattatagggataaagacttgagccctctataaggaaaataatcatagtaattagcttacagagcagaaaagattgggtcataaaacagacctcccaggcaccacacctatgtaagtacagacacaacagctcaatgacaggaatgctggagaagggattctggtactataagagatacagaactaggtgagcttatcttccatttaggcaacattctctttctggctgaagtcctagacacagaggcaggaacacatacctgttttggaaggctagctgtggggtgtcgagaaaaagtcgtcatcatcatcaccatcatcatcatcaaagaggccagtgggagggggaaggtaggggcttttccttggagtgggctgctcaggcttctgtggctccttcattgatggaacggaggcagcacatccgtgtctcctgtgagtgaagggacaagacagacacagctgtgagccagtgtgggccggttgaatttacagaaaaaaattatcacccaccaaaaacttttcatttcagttaatccacaaaatgcattaagagggcccaatagcctccatccattactgctacagaacatctcacaacggagaatcaccaggtcactcaaacacaaaaaagtccaaggccactgagctctaggagaataagagctaatatcagtaaatgagctctttctataagatgctcaaagccctttgaagctcccaggtacttcctcatctccagccaggctttagaagatgataattttgaaatggaaaaaacagtatttgtgtagtttttagaaaacaaacctaagttatgttacctaaaaatacagaaacagctcctgctgggattttctttccaggtttggatgatgaagactctagaatgagaaagcaaggggcaaccatttttacaagggaaataactttccttgctattttattcctgaaatatgtgcaatgtaacacacagctagtaccagacattttgaaactactttttcctgaacaagccattttaaaatgctttggtattttcttctctaccaatgtcaggacttttttggggattgatacaatctgagctgtgactccaatggaagagcatgctgaccgtcatcaagccacagcagtgggtcagctgggggacaccaagggaggaggtgagcacagcagaggcagggacagcatgaccagggctcccccaaacaattccgcctttacccattccagttggatgagaatgaacgagtgaaaaagaaccgcaaaaacatgtgagtcatcagtaaaaaataaagacataagagcaaagggggaaaccaagcaagtcactgatgccaaaacgtgggcagcagaaagcagaggagagccaggctagcagcccgcacagcacgcacaaggagcggcctccaaggcccagctctgatgcctgtgcccgggagactcggcacttagaatcactaattcccaagtcccaagaactgccacaaacctatggagtaacatttgtaggttaaaaaacatatttatatttgtgttttttaaaaactgcaccaatgggacaggtgcggtggctcatgcctgtattcctagcattttgccaggcctaggcgggtgatcacttgaggataggagtttaagaccagcctgtccaactgtccaacacggtgaaacaccgtctctactaaaaatacaaaaacaaaaacaaaaacaaaacctgcacagatgattttaatgcacactgggttggggaattactggtctccaacttatatacagaatgttaaaaatgtttctttaaattaaacttcattcaatgaaaatcatcctcaacagtgctctagggtacttttcttgtttgactttttatgagttctctcctaagaaagaggcaagactgtggtatgggtttacagatggtactgtgttttccaagacatgaattagtgaagatgaattactttcaactggaccacagtaaaaacaatagcttcctgcttaacacagaaacaaggcttgggaacaaccttgttccatctcctagtgaggaagacagttttggaactctgcacacagagacacagctgcccaaccccagcttaccctccttaacagaggctccagcttgccaatcctggggggcttccgtgaagaggtcactctggttgaaataaggtatatgacaaagaattcaaaaaaccaggagaaagcacagctgcatttgaggattcctaaggaaaaataacctacaagatttaaagctacatatttactactctgacagaaaatcagttgcaaagtgataactatggcaaaatcagaccctaaaataatttaggcctgtccaggaattaaaaacaaacgtggaagacaacagataaggcaagaaacaatcacctagtaaattattcacattaacacgtgcacatcttctcctcacctaacaaagcatagaaggatacggcatttctcactctgtgattcttagttcaaaatgtcccaaaatatgaaaatagaagcaacttccaactgagaaactgttttttccccactaaacaagcaaagcctatttcttccctgtggacccctgacacagctagctgcagggagtgttgctgggtgccatggactcacctcctcatcctcatcatcaaagagccccttgcccccactgaacaggccacctccagagccaaatggcgagaagtcctcgtcggtcagcttggggggtgcgaataagttatcctcttcatctagcaaacagaaagcaatgttttgcagggagtattaaagatggggccagaactcaaattcccgggttggcatctgctgtgtctccaaactggcatggagtttatctggccctctttatcaaagtgtgaggcagtctgatgaatttcacactaaccccctggcacagtccactgacaccctcaaaagactctctgggcctccactctcaagtctgtccatgtctgcggcagacagcattcattctctaggccagcaccctggatctagatttactctgaagcaagcattcgggtcagatgccacattcaagacccattcccccacgaatctgggggaaggaagggcagaataaacaaagggatctgcaaactgacacagggacacgtggaatgtaatggacatggctgtttaataggaaaaggcctggtgtatcctttattgaaaacaaatggtagagatccctaagtttctatatttctaaagaattctagaaagacaagaaatgattgctgtaaaatctaataaatcaaatctctacaggaatttttactccacacccacatatcctcccagcaccccaaaacatgccttccaaggcttttgtttgtttgtttttgagacggagtcttgcactgtcaccggtgctggaatgcagtggcacgatcaaggctcactgcaacctctgcctcccgggttcgagcgattctcctgcctcagcctcccaagtagctggtactacaggcacccaccaccatgccaagctaattttttgtatttttagtagaaatggggtttcactatgttggccaggctggtcttaaactcctgaccttatgatccacccacctcggcctcccaaagtgctgggattacaggcgtgagccaccgcgcccagcccagaggctttagaaaagtaaatggagacagacccatttgtcagaaggaaaacagcatgtaaagcagtacttcatgaattatataagcaacattcccgagtcaaaggctcctaaaataacagaattcagggaaaaggcccaccatccgaaggagttctcctttccttcttctcgagtgtcttccgaagttttgcttctcctgagggtaaggcttgaagaacagttcacagttttaatagtactaagtcctccctcagtatacacatcctggttctttccacgtctgtcatcctcataactcacagctaagagcaagacatctgcctttcatctcagctgcactaaaccccctgtcctgcccacagtgggcactcaagagtctctttgtaaggtagaaggcttctgctttcatcccaggctcatgtgcataacaggattgtatttgttgaaagaattattatgttatctttctaccctgttataactagaatatgctatatagcacattcttatgtgttcaaaatataggagtaaatattcagccaggaattcttaagctgttgcccatggttctctggagtttccattaatctcctgaaattatatgtaaagtgttatctacatgtgtacatgtacatttttcttgtgagtccacagtgttcagttatctaaaggagctcattaaccaaaaaaggaataagcgctacaatttaagcctcttctgctgtagtaattactaataaaaagggaaatccacctttggtgaagccagcagagggctctgcactacccccccctactccccgtcaatgaggctgggtctcacttgtcggctcctcgtccactccgcccacggcatcccccttgatgcgggcagccagctcactgcaaacgaagtaggtctgcttttctaaagtaggagaaatcaaaagaatctcttttttgtaacaaactagtacacttcactttggacatctaacaacattatgtatacaagagcaaagaaattgaactgaggagaaaactgagtttaattaaatgaacttaaacatatgtaccctatacagctcacccaaggaataggactcataaaatgttccttcaaagggagatgctctttatttccttattttttttaatacttgactttaatacttaaaaatctgaataagaaaataagaaaaaggtcatgggcagagagacaggagcactacggtcttcaaactctggaaccagacatattctgaatgatctgactcataaaatcataacatctggacaagaaagtggtacttgtgaggcaatttgagatgcttgccattattttccaaagtgtaaatgaaatgacaaatatgccaaaatgagagatgttcaaagtaagtcacaataaaaaataaaaaaagtcattggttctaaaaccctgccaagtgatagcaactacagccttccttacagttctagtattttcttcaatgtcctcaatatctttctcctccttctcagagtcagcaaaaaggtcacagccatcatcatcctcttcctcatcactcacttgtgtgatgtgctaagagtataaaatagcaaattagaactactagttattaagctaaagaagagatactgccacttagcctttaggctgctccttcaaaatcgtaacagctgtttaaaataataatcataatcatgatgcagtaagttataaagcaaaagatgtgctggaacaaataatacacaagatttacttcaaatctaaataaaaatgcattctttaataagaatgtaaccacaagaatataaaaagcaaaatattaagatataaaaattgtctgttactagagaaatatttttatttatttatttactttttttatttttgaggaattttgttcttgttgcccaggctgcagtgcaatggggtgatctcgcctcactgtaacctccgccttctgggttctagcaattctcctgcctcagcctcccgagtagctgggattacaggcacctgccatcatgcctggctaatttttatatttggtagagattggatttcaccatgttggccaggctggtctcaaactctttacctcaggtgatcaacctgccttggcttcccaaagtgctgggattataggcatgagccaccacgcctggcctattactagagaaatataaacaaaatcagtatagtcttaccttagtaagaatactgagtaatagttaaaaggtaaaagctgtaacaattagagagccatccaaggtaggtcaagcaaaaaagttccaataacaaatccagcacgataccgtgccccctctacatacaagcatttctatggaaacagatatatttataaaagcaaagaaaaagacgtggaaagacatgctcccagagcatgatcctagtttcctctgaagagtatgcagagaaggaaagtactggaaggctcaaacttagcctcatctgttaagttctaatttttccaaaggtacacagtagtatgtataactaaaaaaaaattttgttcaatgtttgaatcaatgaactgtgccaggcatgttactaaaagcactttattatctaatttaatccttacaactttggggttagctgcagcacacaaaaccaacctgttgcataagctagtgcttttactcactatactgtactgttttgaaaaacagtttgtggccaggcattgtggctcacgcctgtaattggagaactttgggagggcgaggcaggtggatcacctgaagtctggagtttaagaccagcctggccaatatggcaaaaccctgtctccactaaaaatacaaaaattagctgggcatggtggcacacgcctgtaatcctagctacttgggaagctgaggcacgagagtcacttgaacccaggaggtggaggttgcagtgagccaagatcatgccactgcactctagcctgggtgtcagagtaagactctgtctccaaacaaacaaataaataaataaatgggctactctattcaggagaagttcagattttggagtcacaatgtttcagtgataaattccagggtgtgggacgtagattaagggtgttaagtacgtggccactgaagttacccatgatggtgttacataaaatccaagtttggtaattggctcgcctcaattttaccaaccaagttccaagttctaaagtgtgtatgtgtgtgtgtgcgtgcgcgcacgcacgtgtgtgtgttttaatcaatgtgggggaaatggaagaggttggtagatggtgacttaaaaatgaagtccccttaagactctaagactgtttttgcagacagcagtcttagtcttcttccaggctggagtggagtggtgcaatctcggctgactgcaaccttggtctcaggggctcaagcaatcattccacctcattctcctgagtagctcaaactacagatctatgccgccatgtccagttaatttttttttttgtagatatggggtttcaccatgtttcccaggctggtctcgaaccgccttggcctcccacagtgctgggattacaggtgtgagccaccatgccagcccagccttagtgttaacactgttataggttactgtaacatattggctcacagtgtgtgttctcgggtctgcctctttcctggttacctaatcataagtaagttacttctcctttctgtacctcagtttcctcaactataatttggaaataatattccctccctcatagtcattgtgtgaattaaatgaacaatgtataaaatggtaaatactgaacacttgataaatgttagctattattaaaggagagactgatatttaaatgattacaatacaatgtaataccttaggataaatacataaaaaacaacttttttccttccttattttacagctttattactgatttccctctaaaaagagatccaaataaatgtggagcgactcattctcattatagagtaaggaatcacaaagtaccatagtcacgtaacaaaagcaaaaaaaaaaaaaagcaattgttttacctttcaactgctgatgttatgtacaatctatcacaagaagcatagctgtgcattcatgagctgattgtattaacctctagaattttagaaacgagcacataggagggcgtttcaagtattcctgatactccttgtcatcttctgcgaatctactagcaaacatctcttcaaaatttggaacagctttggcagtgtcagtcattccgaaattcccaaagatttgaggcagctgtattgtttaatgtttaggttgtttaaatccgccaagggctgtgtctatctagctcgggccgaaccccgccagcgagacactaagagaccgcaggagaggtggcctctggcccaccacaccgtggaactccagaccaccccagctctccaatgtagtggagacccttccgctagccatcgaaaataacttaagtcacttaagctgtacttgggataatcaggttatttaatgaggtgataactgaggtgactacaaaagaaaagtctgggattgggtgtgtgagcaaggtgcatggggacagtggtatgttctaggttgaaggctcaccctaggccaagcaccgtggcacctgttttacaatatcataactttaatatcacatccttgcaagatatgtagcttcgttttactgaggaaagctcagaaaagttaaataactcgcccttgggcacacatgactggaaagaaattgggatttttattttagtaagtaagttggtcaggcacaagggcgactcagcagagggaacttcaaggaagtgtgagacaacagctggagccctgagctgggagagtggaggacgaattataaagagttttatgcctgccataatgagaagcttgtccttgaacttgagggcaatgctgagagtgcaaaggactttaagcaggccctacacagtggcagccaagcaggtcataaagagcaagatgatgcccaggcagatcagggattctctatctacagagcgtccgcctaccagctccttcacagcagcggattttgctgcaagagaagaggcagcaggccaggccttttccttcgcccacagcgcctacgtcgaaggctcccaggctggttgctccactggctgcttgaggtcccctctttccagacccgccgaactggcggccggtgctgtggccgatcccgcgccgctgcctcgggccttggggggcagcgccacccggccaacccgcctctgcagcgttcctggcgtcagcccctatcctccagcttcctccgccccaacctagggtagaaccccaaactccagtcccagtccacttccgcagcttcctcccctcagcatggcaggtcggatcacgtgcgggttctgtcacgtgacatcaggtcacgtgaggccggtcacgccccgggcagcttggctggggctaggcttccggggctctgcagtcctcggcgtgtgctggcagcttcggagcccaccgagccgggcggctaggatggtgagggcgccgggcaggagagaggccggcctgggctggggccgccgtccctgccgccctcaggctcagcttctcttctcgtttttttcgctgcagatgaaccggacgacccccgaccaggagctggcgccagcgtcggagcccgtgtgggagcggccgtggtcggtggaggagatccgcaggagcagccagagctggtcgctggcggccgacgcgggcgtgagaggcgggccccggggacgcgagagcggcaggggtgacgcttggcttgcgcgcaggagggccggaccgcgactgcccctgcacctggcccgtcccgttgcctgccctcttaggaacacacgccccgtttagcccccgagaatgccaccctggcagtccccggccaccagggagaggggcagacactgaccgtggcccagacgcgacgttcccttcatggggtttctggctcagctccatccggaggggagatccgtttccgccacactgagggattgctcgggcactagggaggcgattcctgttgggacctggactaaatggggtgggaaacaagccagtatgtggatatcctttaatgggatttttcaaatcgggggcccaaaaagctcagaactgttggagtcccaaatgaataggatttttgaataagagtggtggttgattagctaacccttggtctgtgatctctgtagattgacaaccaaagaggacttttaaaaggagacagggttttgccctgtcgcccaggctggagtgcaagtggcttgatcttggctcactgaatcctctggggttcaggtgatcctctcacctcagcgtcctgagaagctgggactataggcgtccaccacacctgtctgatttgtttatttatttaattttagtagagatgggggtcttgctatgttgcccagactggtctgcaactcctggactctagcgataaccctgcctcagcctcccaaagtattggattacaagcgtgagccaccatacccagtgccaaaaagggattttaaatttttccagaaacgagataggtgtccattagctcactgccactcttttgatgagctttcttagtgttttccaatgtcacttggttttagtacttgtcaaaccagcattccagccgggcacagtggctcacacctgtaatcctagcactttgggaggccgaggtgggcgaatcacgaggtcaggagttcgagaccagcctggccaacatggtgaaaccccgtctctactaaaaatacacaaaattagttgggcgttgtggcgggcacctgtaattccagctactcgggaggctgaggcaggagaatcgcttgaacgcgggaggtgcagtgagccgagatggcgccattgtactccagcccaggcaacagagtgaaactctctcaaaaaaaaaaaaagcatttctttcacattctaacactcaaaggtgaaaggaaatgggttcttttttgatgtgacatgcagaatagttacatgtaacattgatactactgtatgtttattttttaaaatagctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatgtgagttatttagttatattatcattccttttttgggagtaggagatattgtaattttaaataacttactgttaggttccctcctaaattttggtggaagtgtggttcttggtaattgtagcttttttctctgggattaatacctcttttttatttgtaaagttttaagtccttttttccaagcctctaaaaaagtctaatgataacattttcttatacttcggtgcttccatcttttgtcgttttgagagtagtcagcaattgtgctgaattttgtggcactcacactgcctttgttgtggcgtgatctgtaaggacagctgtttacctggttagaccctctggacaccagcatatggtttcacttgttgattggggtcattctgttctgataaattatattcaggggatatatatgtctgcttgcaatactctcaactaaagtttatgatggctgaacttacaatatggaatcaactgtaaacagattactgagcttaaatctatgtgtgatttttgtctatttactgtttcttctaggtggtaggaatacataggtaaattagatagagcctctcccttggcaaatagtataattccagcatacaaaggaagtaagtatggctggagcagagtggagacttaagagatgaggatggagaggaagcttaggtaacagacctgtgtttctcatagggtgtcccaactttctgaatatcagcattcatttgtggaaaaaggattattaaagtaagcgatctcctgagattgttagatataaagtaataaaattttcagaatcacaaaattatttaaaaagcccaagatttagaatagttaagagaatgccatgtagtcaacttgtgcagcatgtttgtgcattttttaatagctggagttaaatgccacttcctgtctttttttggagagctatatataaaataaagacattaataaaggtgttagagatctctttgccagttatttcctttaacagcaaaggagtacttatgagtttgaaaaataacaagtattcggccaggcgtggtggctcatgcctgtaatcccagcactttgggaggccaagacgggtggatcacctgaggttgggagttcgagaccagcctgaccaacatggagaaaccccgtctctactaaaaaaatacaaaattagccgggcatggtggcgcatgcctgtaatcccagctacttgggaaggctgaggcaggagaatcgcttgaacctgggaggcggaggttgcggtgagccgagatcctgccattgtactccagcctgggcaataagagcgaaactccgtctcaaaaaaaaaaaaaaagtattcaagtaaaatcagtagttttctgattgtttacacagaatgtccatgcttggtcctgactatctcactggaaaagtcagggactctagactcaacttctctggtgtgcacagccccataatgttttcatcaagattaatttggtgtccttttaagcactcctgttcttttcattctgtacttttcttgctggatcaggtagtcagcacttctctgcagtcagtgctgcagcaccagagtcccaaaggatttgggaagtttctttttttttttgagatggagtctcactctgtcacccaggctggagtgcagtggtgcgatctccgctcactgcaagctccgcctcccgggttcacgccattctcctgcctcagccttccaagtagctgggactacaggcgcgtgccaccacgcctggctaattttttgtatttttagaagagacggggtttcaccgagttagccaggatgatctcgatctcctgacctcgtgatccgcccacctcggcctcccaaagtgctgggattacaggcctgagccacggcgcccggcaagggaagtttactttgtacccagtgtgcttgtaccagattggtactagattggtaccagatcaatacttcagtgggaagaaatggggaacatcatacaatttttctcaatcacagtcttaggtcttatcttttctccagctcttttctagccaagttttcgtagattctgagttttccatgttgtagtttttgtggagtttttttggttttgttttattgtgttttggtaattgttctttatttctgtccaatactggggatttcctgttttccatccatctctccatccctttagccttagcttttttttttttttcttccgagacagagtcttgctctgtcatccaggctggagtgcagtgacaccatctcggctcactgcaacatccgcctcccgtgttcaagcaattctcctgcccacacctcccatgtagttgggattacaggctcccgccaccaggcctggctaattttttttctatttttagtagagatggggtttcaccatgttggtgagtctgcttttgaacttctgacctcaagcgatctgcccattgcaacctccgcctcccgggttcaagcagttatcctacttcagcctcccaaagtgctaggattacaggcgcgagccactgcgctcggcccttagtgttaagtcttgatgccccttcgccttccagtctgcagccagaactcttctccggatgtgctggttgccgctgccaaatcttaattacttcccagaccttctataaggccacatgctataggtttttttaatttgtggcaaagcatgataatactgagaaaacagctaatgcttaataaaactctgaaaaaatatagttgctgatatatatttgtaagtgatctggctttttttttttttttttttttttgagacggagtctcactctgtcgcccagactggagtgcagtggtgcaatctcagcccactgcaagctctacctcccgggttcacgccattctcctgactcagcctcctgagtagctgggatgacaggcacccgccaccacacctggctaattttttttgcatttttagtagagatggggtttcaccgtgttagccaggatggtctcgatctcctgacctcatgatccacccgccttggcctcccaagtgctgggattacaggtgtgagccaccatacccggcaatctggctttttaatgttttattttcaatccctgacatcagtacttaggtgttacaattccagcttgaattatggtgccatttggtttcatggtaatttatcagaaacattcaaagtcagataggtttctgggtcttattaattagcctcaggggcagccacaaagttgcaaactatattataaagttagtgaaacaatccagactttctagggcgagaacagtcaggactttttagggcaagagaaattaataccattagtaaaggctcaagaggggacttggagggagaagaaatactaattaacattggccagtgttctagtgtctaattagaaggcaacacaattctaaagccttaattatctgttaatttaggaattggatcctgaaatagcaagtgccatagttaatgactttagtttgttaaatgaactggtgagggaggattttttctttttaaagtcaattgtttccaaatcttagctttgtaaaattaaaaaaaaaattccagaatgaaacaaattaacctgtttatgcccaaggttagaattttttttgtgaaaagccagatcttggcaatgaccttgagcagtaggatatacataactctgacaagcttagtgttccaataatgggacactaggcataaattggttaattttccagatcatcttcctgttgatttataaaagctgaattttggtcatttttccctccttttctacttttctattgaagaaacagatggagttgctgaaactgtcaagtactcagcaattagagagaaggaggtaaagcccaaaagcgttattaacatataatttcctgcacaggtttttccctctccccctagacctgctttattttacataatgccccttgcttttgacactccagccttctcattccttggagatgccatatgccctgctgctacggggcctttgcttacattgcttcctatgcctctaccctttgattgacatctgtctgtcttctaggtctctgctcaattatattacttcctcctggaccctctgcactaggcacaccccctggataaaagcagctgaagcatcacattctttagtagacttcttacaattgtaattttacaattattgatgggatttgatgagttggaccctcccgctaaatcaagccccatatttttaacaacaactatatttgaggggtccagcacaagcctgatatttagggatccagtgaatatttgaatgaatgagagtacgcataaatgaaaggggaccagggctgtgtatagtctgttactctccagccctggtccctttttccccagttcccctctttccccttttaccctgtctccccagatgaggagcaataccaaagatatttaacagtcctgggtatagctatctgactgtaaattgatcacaaaacacatgaagctgtgagtttagcaggtgaggatgaaagaagttagcattggttatctgctggatatgaagtagttgaggatgcatagtcctgctcaccctgaaaagatcccatgggctttaggtcccatgggtttaggtttcttagatgtcatgtttggctttccagctgcaggctgctgataggtaaccatggtagctgccaggtcttaaagtctcacttttgagatttacttaactttttggagtcctgactttgaaaattaccaaagtaatccctgatctttatagagcaattaggaaaagtaagaaaaagaaaaatcatgtgaaatttcctcagcttgaggggagcctctcaaggtttagcacatatattctaagtccatttcccatgcagacatcaggcttaaaagaattgaacctacagtaggccgggtgcggtggctcacgcctgtagcactttgggaggccgaggtgggcggatcacgaggtcaggagattgagaccatcctgactaacacggtgaagctccgtctttactaaaaaatacaaaaaaattagccaggcgtggtggcaggcgcctgtagtcccagctactcgggagcttgaggcaggagaagggcgtgaacccgggaggcagagcttgcagtgagccgagatcctgccactgcacttcagccagggtgacagagcaagactccgtctcaaaaaaataataataaataaataaataaataattgaacctacaaaaaatcagctaccccaaattaaccaaccattgaacttttcagtgtatttttttctgttcttgttttttaactttaaccttttctagatgacggtatgtgtgtgtgtgtgtgtatttacatttgcagcctactttttttcttaatgtgaacttatttaacccatctttgagacttttgtgaatataatttttttgttcttaaaccgtatcataatttatttaataatcttctaatattaaatgttatttatgaaatgtttcataaatttcataaatgtttcataaataaatagaaaagttcagagagaaaccacaagtgctaagaaaatgtagcacctagcatcagtggttttgtatcttgccacatttgcttcaaaggtgcctacccaccatattcgtccttaactctaatcattttgggtggggattccttggtatctctgcctttttattctttttttgtttttgagacaggatctccctctgttgcccaggctggagttcagtggtggagacagctcactgcagcctcaaactcctgggctcaagccatcctcccatctcagcctcctgaatagctggctaggaccacaggtgttcgccaccatgcctggccaactttttattctttttacctagagagggatttcatttttatcccttatagataacctttattgtgtagttgttcttttcttcattgactattatgtatgaacgtttgtgtgtgtttatgtgaaaataaaatcaggcctccatggaattgtgggtctgtttctgccctctgctgtttgttttgtttctctgctgtttgccagtatcataatcttaaatactgcagatttctaatgtcttattagggcaagtccccataatctctttttattcagaattgtcatggttatcaatctttggctttttacttttctgtgtgaatttgaggattatcttttacttatttatttatttttttgaaatagagtttcagtcttgttgctcagactggagtgcaattgtgcaatctcggctcactgcaacctctgcctcccaagtttaagcgattctcctgcctcagcctcctgagtagctgggattacaggcaccggccaccacatcaagctaatttttatatttttagtaaagatggggttttgccatggtttcaccatgttggccaggctggtctcaaactcctgaccgcaggtgatcccaaagtgctgggattacaggcatgagcctcccaaagtgctgggattacaggcgtgagcctcctaaagtgctgggattacagtcgtgagccactgcccccagcacgattatcttactatattgtgccacagaatattttattagcgtttgattggaattgcatagaattataaatttggtatttgtgactttctgctggaaatcatgataccatgaacattctgatgtttgcatttatgataattttcatgggagctaaatttcaagaagtagaattttgggtcagaggatatgatcgtttaaaaacaacattgtttgatcagattggcagatacttaaagatgggtggacaggagccattgctggcaaaggtttgggtaaggggcacttgagtatgctgctagtgacagggaattctacacatttgtgcatagaatctgggaatgactattaagatttatttattccctctctaggtaaaatccctctctaggtatataaataaataataaataaataatcagtttcagccgggcacaatggctcacacctgtaatcccagcactttgggaggccaaggccgatggatcacttgaggtcaaggagtttgagaccagcctggccaacatggtgaaaccccatctctactaaaaaaaaaaaaaaatgcaggccgggcatggtggctcacacctgtaatcccagcactttgggaggctgaggtgggcgaatcacgaggtcagattgagaccatcctggttaacatggtgaaaccccatctctactaaaaatacaaaaaaaattagctgggcatgggtggcaggcacctgtagtcccagctactcgggaggctgaggcaggagaatggcgtgaacccaggaggcagagcttgcagtgagccgagatcgcaccactgcactccagccttggcaacagagtgagactccatctcaaaaaaaaaaaaaaagggcaaaaacaaattagccgggtgtggtggtgcccgcctgtaatcccaactactcgggaggctgagacaagagaatcatttgagcctgggaggtggaggttgcagtgagccaagatcctgccactgcactccagcctgggtgacagagctagactctgtctctaaataaataaataaataagcaggaagggtaggagagctctaaatatatgcacttgttagcttatatttatgttcagagcctcaggaaatgagcatacacaccaggcttaaattgggtattccaaggatcaggttggggatagggagggaactattttaaaatacatctcttttacatgtgcctttatattgacttaaaattttaaaaattgagatagaattcacataccataaaattcagtcctttaaaaagtatacaatttggtggtttttactgtactcaaagttttataatcacggccactgtctaatgccagaagattttcatcagttcatttatattgacttcttatttctttctttttaaaaaattttaatttcatttcattttatttttgagatagggtctcactttttcacccaagctgcagtgcagtggtgcaatcagggctcactgcagcctttacctcccaagctcaagagttcctcctgactaagccccacaagtagctggaattacaggtgcacaccaccatacctggctaatttttgtattttttgtagagatgaggtctcactatgttgcccaggctgatcttgaactcctgagctcaagtgatccccttgcctcggtctcagagagtgctggccttacaggcgtgagccaccgcacctggcctatattgactttttataacaagcatgttgtacttcggtagtttttaaaacataaaaatgattttaaaaaccaagaatcacagtgatttggcagagcagtgggtcttttctggaaaagagagtcttgcctacccatgctgtcagggttagtcaaatgcccaggctttctggcaagtcagtggtagatttttctctctgctttcatacaaatgggataataaaaatttatcagccattttaagcaactgaatgaaaataagttttgcctttaccattttccttgttcaaaatcctgaagttctagtttcctagttgataaattacatcagttgacattctccataacctggggtcagaatactgtatcattgcccatcaacattattaggttaaatgaaaaggtgtgaaaactgatatcttactgtttttgcaactcttggtttacaacgaggttaaagtttcatcatgtttcctagtcatttgtatttaaaaattttctttttttttttggtgaatggactattctttgctgtttgtccatgacccactgttacggacacccacctggtagtggtctcagccctttgctgaataaccatttccttccccatctttgtccttagttactgtgtgaattcttatattgtgatttatttccaatgacgtgttgaccttttaacattgagtttgcttccatatttagcgtgtatatgatgaagaagtggaggagccagtactcaaggctgaggcagaaaaaacagagcaggtacttgtataaaatcactcttagctgagtttctgactttgaaaaatgtggtggagatcgatgtgttatgtgggaactgggggatggtgggcggggttgggaaagggagggactgctcctgacagcagcccaagaggggattctttcctttgtttctgaaatgtagtgtattaactaatacagagatcaaatccttgaattctgatataagaatagagtagaagtcagcaaacttcttttgtaaagggccagatagtacatattacagatttggagggtcacagaggtcatttttttcctgtggcttcctgagttacagatggaccagccttcttcctgagatcttctcacaccagagcccaaaacatagctaagaggttctgggtcacactgacttcttagcactccagcagagatttctttttcttccactcaggaaggcacatggactgtgaataagtttattattggagtagctttgattttgttctcatttattcagaaaatatggatcacctgtaaaggttggccctttgtcagcaattattacttgtaacagatgaagctgttagactaggaaaagggtattcgaaaccagctatagttctgcctgttgccagcattttttaaaaaaagttattttattttattttttatttaaaaaaattttttattttgagatggagtctcactctgttgcccaggctggagtgcagtggcacgatatcagctcactgcaacctctgcttcctgggtgcaagtgattctcctggctcagcttcccgagtagctgggactacaggcgtgtgccaccacgcctggctaatttttttgtatttattgtagagacggggttttgccatgttggccaggctcgtctcaaactcctgacctcaaatgatccgccagccttggcctaccaaagtgctaggattacaggcgtgagctactgtgcccagcaggttattttatttttaatagaactcaaggatttgctagccatttaagtgcagtagtatctggttataccaattcagggtttaatttgaaggtgataggtatttagtgtactatttttaaaaactgctatatatttcatacacattttcacaaactcagtacaatattagctatttaactcagaatcaagcatatccaaatagaaaaatacacaaccaagacaaaaaagttcagttagaaagacttcagtacttgagataaaagactaaaatgctcgtagggttttttttttgcctttggccctcagaacaacactgtgtggtttggttccttctagaatatttgtagagggggaaatgacactaaatatttttcggtatttctcacaatggcacacttgtgtctgcggggactgccattgagaactgctgttgcaggaagaagacacctgagggagattctcagcctgttggtgatatgaacaaaccttttttcttgagtggggcattgttgtagggtatacacagaatagaccggagatgaaaatgacccccttttgatgtagaacagatttataaaataattgtaattgtccagtattttttttttgtctctttaaactgtaattgaaaaatgagacctctgtgaccttccttctaagtcttaacacctaaaattacccaagggataaccagggctcgtgggatagtcatggtgagtctgagagtctaggccctccagcagtggggaaacagcatgtattcattgttgggatacttctccacacactagttgtacctctgcttttgtagacgatgacccttgagctctggaaccttaggtagtttgatgcatgtccagaaaggggcaaacttgggatttaaaacttgcagtcttactccaaagtctgtgtcaaggcattcagcagaatttgacttttttaacatttttaataagtttttttggagcttgaggctaggctttagagaacattcacagtattcttttggggcagtatcagtatattggagacccatactgcatggtatttattttgtaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggtgaagacattcaacttaaatatttattgcacaactattatgtttgggctactttaattgggcacacgattagtaagtcatggacttaacctctgggaagtgagtatgtcacttagtagtctcacattgactccaccagaaagactcgctttacctgagcactgatggagtacttgtgaggcgcaaggcaacatgtcaagttggggtgcaaagatgcagagcatggcctctactctcgaggtgtgtgttgcagtctggtgggagagaggagacatacatacgaataaccgttgtaaatgccctgagagagaattgacttccagctggaattttggggcaaagatgatatttgaattggggtttgaagggtggggaggctcaaaagagacagagagtgttgggaacctgaaattatgtagcttgggctaaggaagactgcagaagaactgaaaggcatttgggttgtttccggtttgggcaattattaaatacaaatgaagctgctgtgagcattcacgtccaggctccctcatagcctagtgagtgttggttgcttgacacactttctcccacattgttcaaagagacaattggggtgacacagagtctctcggtagtgaacacagaaagttaccacagtgatttatagaaagaggccttgtgacacacaaggccttccgaattaaaacatgccacagaaccaaacccttttttttttttgagacggagtttcactctgtcctccaggctggagtgcatggcacgatgttggctcactgcaacctctgcctcctgggttcaagcgattctcctgccccagcctcccgagtagctgggattacaggcgcccaccaccacacccagctaatttttgtatttttagtatagacagggtttcaccatgttggccaggctggtctcgaactcccgacctcaggtgatccgcctgccttggcctcccaaagtgctgggattacagacatgagccaccgcacccagcctgaaccactcttctagtcattctgtagctgcacatttctcttccagtttgagctttgctgagtcacaccaaattgaggcagatcatttggcactgaccggtacacttgctgcttggattttcactgtatgcctttaaaagtcagcagtggactctgggaaatggattgcctggaccacacttgatacttccaagacacacagcactttctctcttttttttttccccttgcagagaaagttgtggaggtacacttttcttttgtaggaggatttggggttgtcttctgagtcagtgagaattagtccaaattaacgctgtctttgccttatgctccattggttgctgtgacgtcgttgaacctttactttaaccttcccaatctttctgttgttgtgtgaaatgtcagaattattctcccctgccccagagtcctttgacaaggaagagatatcattgccaaagggcaatgcctcacaggggacagggcagcatttccttcagcagtggaggtaggaggctgtgcaagggtggagcactttcttgaccctattttttttttttttttgagacagagtttcactcttgttgcccaagctggagtggcgcaatctcggctcactgcagcttctgtctcctgggttcaagtgattctcctgcctcagccttccaagtagctgggattacaggcatgtaacatgacacctggctaatttttgtattttttagtagagacggggtttcaccatggtgaccaggctggtcttgaactcctgacctcaagtgatccgcccgcctcggcctcccaaaagtgctgggattacaggtgggagctactgcaaccgaccaaccctaaatttttaatgtgtgtgtggtgtgggactgacaggagtagacggctgacatgggcagatctccagcatgtgctgttggggccacagtctcctgccctcactctgttttctcatctggtcttattttaccaacttcaattttctaaattcaacagtgtggaaccactagggggtattgttcttctgtttattgagttataatcttttttatttatttatttatttattttgagtcagagtttcgctcttgttgcccaggctggagtggagtgatgtgatgttggctcactgcaacctccacctcctgggttcaagagattctcctgtcttagtctcctgagtaaatgggattataggtgtgcgccaccacacccagctaatttttagtattttcggtagatattgggtttcaccacgttggccaggctggtctcaaactcctgacctcaagtgatccatctgcctcagcctccgaaagtgctgggattacaggcatgagccactgtgcccggcctaatctatttttatattaaaatatatagttacattatgtctcattagtactgctttttaggggacagctcaccagaatgttcagtttctttccttggtcctcctcttcttggaccttatactaggaggttgtacccttttccctgtttgcttgctgctgatagacttttggtaggcttttgccatttttgttaaattttgttaattaggcccttggggagggagattctgtgtgatacagctttactttggtatcttttttttttttttttttttgagatggagttttgctcttattgcccaggctggagtgcagtagtgcaatctcagctcactgcaacactgtttcctgggttcaagtgattctcctgcctcagccgcccgagtagctaggatgacagttacccgccaccatgtcccgctaatttttttggatttttagtagagacggggtttcaccacgttggtcaggctggtctcaaactcctgacctcaagtgatccacccgccttggcttcccaaagtgctaggattacaggcgtgagccatggtgcccggccttaccttgacatctttacctaggatttgacttttaaaaaaatcagtgaaaaaaagaattttttttttaacttttagtcctgctgtgtttcttattctccactttcgttatgtagcttgtttgggatagtcagatggaacagggtatcaggtggcacatgtaagtttgttttcaactgaaatgtttgacagcctattcctttcatgatgtacaggatctatacattgatcgtcctttaccatatctcattgggtcaaagctgttcatggaacaagaagatgtaggtcttggagagctgtccagtgaaggtacttttcttcaccaaataattttgttccttaacatttcttttttattttaaaataatttcaaattttacattaaagtttcaagaatagttcaaagaactctcatatacccttcacctgggtttaccagttaacatttcaccacatttgttagattgttctctacatatacgtaatattttgtcttgagcctatttgggagacatcatgctcatgccctgttacttctaaatgtttctctgtgtgttttctttttttcttttctttgtctttttctttttttgagacagagtctcgctctgtggcccaggctggagtgcagtggtgcgatctcagctcactgcaacctccgcctcccggatttaagcgatttttctgcctcagcctcctgagtagctgggaccacaggcgtgcaccaccacacctggccaatttttgtatttttagtagagacggggtttcaccatattgtccaggctggtctcgaattcctgacctcatgatctgcccgcctcggcctcccaaagtgctgggattacaagcatgagccaccgtgcccggctgtttttctttctttctttctttttgagccggagtttctctctggtcacccaggctggaatgcaatggcgcgatcttggctcactgcaacctccacctcctgggttcaagcaattctcctacctcagcctcctgagtagctgggattacaggtgcccaccaccacacctggctaatttttgtatttttagtagagatggggttttaccatgttgggcaggttggtctcgaacgcctgacctcaggtgatcctctgtgtgtgttttctaagaacaaggacatctcttgtataatcacagtagaattacaaagccaggatattttcctggacataagggtattatccaatctgctgctatgttcacattttgccgtttgtcccagtgacaccctttacagtctctctcttttgttctgtggtccgggactcaatccaggaccagccaccacatttggttgtcaaatcttcagttatcttttaatctgatgccatttctcagcctttctttgctttttatgaccctgacatctttaaagagtacaagcaattttttttttatttgtaatgaataatttttggggggagagatacttcaagactacataaatatgtaattcctcaccataatgacactttcaattccagtaagtgggtatagatggttttatcaagatctctgtgatgctgttgtatggtggtttgtgattttgagctaaggacattttcttgtgaatattggtgtggtgacccttatctctcttctcaacagaaggctctgtaggcagtgatcgtggcagtattgtggacactgaggaagagaaagaagaggaggtaagggctgtttggtatgaccaggtcacggtgggcagcaagcttaatttaagatgggcctagcaggctaagtaaatagcataactgtgaattcgtaatctgcttccataaagcttttaacagtgatagaagccacattctgagttttttttcccaagggttagatttcctttttgccttatgtacaataatagggaaagctgctttcatctcttccactattatcctctctcccaccttgccaccaaatatctctttcacccaatatatttttgagaagggcagcttagatgttttggtggaatctctgcctgggatatagtctttgagtatattctgtctttgaataattctaagggaaaaaatctacatttagaacttttgtaaactataaaacctagagcaggatataccgaaagccaccacttacattctattttgctgctgccgctagcgctttcatatccacagagcataatttcatttccttgtctagagtttgagtttgtgggccttgactacagttgaatctgtagttgttctttagatgggatattcgttattgcaaaggacacagccatgttgcaggagagtcctcgagtatgggatttccgaaaggagacagtgttgtgtatgtgcttttctcttctggttggtccccctttctgcactctccctgcccgcctttcttccagtcctccaaagaaaaacctgacagcaggaaatgagcttttcttaagtaactttcgtataacaaaagcagtgctcattaggggaatcccttgcttttagccaccgatgtggcacttctatgtggcacttcatcaatagttgctcgtagcaactattgatgtccccttcttgggcctaatgaagtagttatttttattattttttttattatactttaagttttagggtacatgtgcacattgtgcaggttagttacatatgtatacatgtgccatgctggtgcgctgcacccattagctcgtcatctagcattaggtatatctcccaatgctatccctcccccctccccccaccccaccacagtccccagagcgtgatattccccttcctgtgtccatgtgatctcattgttcaattcccacctatgagtgagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctattattgttggacatttgggttggttccaagtctttgctattgtgaataatgcaaggaaatagagacagtatagtccaaaatgtaaaataacacaaactgactttcagtaatttagttagttaaatgtgcaactctttaaatccaaaggcaagagttgaaagtgcaggtgatgtgaacaaattgttagaggcatttaagtgaaccacaaaaattacatgttaactggaacaacccttcacaatattgccagctatccagcttatctgcaccttgatacttaaggtgaccagtagtcagtacaaagagactgagtgtcagagctttttctccacttgacatagaatcagcctgccccagagacttagacctgcaatcatttctgtgcttctaagtaaagcccatttaacaacaaagccttttcttccccacaaaggagtcagatgaagattttgcccatcatagtgacaatgaacaaaaccgggtaaggctcatatattgaaatgactttgtttttacattttaattgaagcatagtatatatactaatattactttggaatgatttatgaccaagtgaggattttttcttgtatacaatttattttcctttaagcatttcatgtatttaggctaactacctcctttgtatatattttttccaattttgctttatagtttatttttcttagaaaagaagtttcaaagaagtgaaaaacacaattggaaaacagagcctctaaaagaagactcagttacccaaactgaactactttgcatgagtccctcttctgttttaaaattggagacaatctagcagtaacattattgagtattcacaagatgaaaacttcttaccctactgtcttagcacggttatcttaatttttgaatagctaaaggcgtattcttttcatagtgtgcatctttcattttctgccattttatgttaacattttataaatgtatccttatttattattattatttttttgagatggagttttgctcttgttgtccaggctggagtgccgtggcatgatctcagctcactgcaacctccgcctcctgggttcaaataattcttctgcctcagcctcccgagtagctggcattacaggtgcccaccaccatgctcagccaactttttttgtatttttagtagagatggggtttcaccatgttggccaggctggtctcgagctcctgacctcaggtaatccacccaccttggcctcccaaaatgctgggattacaggcgtgagccaccatgcctggcctccttattttgaatagcctttgcagtttgcgttgtaaacttctatacttttaaacatactgagtatgatactgtcatagtctctaaatgtataagggaaagggtttatttctagagttgtatttttgatgtaataatgtattcaatattttcttttcttttttttgagacagagtctcgctctgttgcctaggctggagtgcagtggtgtgatctcagctcaatgtaatctccgcctacagggttcaagcgattctcatgcctcagcctccctgagtagctgggactatgggtgtgtggcaccatgcccggctaattttttgtatttttagtggagtcagggtcttcccatgtttcccaggctggtcttgagctcaggcaaaccgcccacttcgccctcccagagtactgggattacaggtatgagccaccacgcccagccaatattttcatatatagaaatcctttgcttcggtgaactgtttcttcagaatgaggtggtatagagttatgttaataactcttaatgtctggtggacattctaaattaagtattatgcatgtagattttcctacaatctcatcactggggtgattattttaaatttcttttagttaaaaatttgcatttaaatttcttaactgggaaatatttttttcacaaaaatgtttaactatcaaatgaaggattttatactttctggttgttactgtattttcctggttgtattcataaatgtggttgatctctataattttaacgatcagtctttcttcataggatatttgtttctatggaatttcctattaagatctgtaaatgcaaacagtttttctttccttttttttttttttttttttttttgagacagagtctctctctgttacccaggctggagtgcagtggcacgatattggttcactacaacctccacctcttcggttcaagtgattctcatgcctcagcctcccaagtagctgggattataggcatgtgccaccatgcccagctagtttttgtatttttagtggagatggggtatcgccatgttggcgcggctggtcttgaactcctgacctcaggtgatctgcctgcctcagcttcccaaagtgttgggattacaggcgtgagccaccacgcccggccacaaacagtttttcaaaaacagtacagtatagtgagtaaaagcactagcttatgcaacaggttggttttgtgtgctgcagctaacctcaaagttgtaaggattaaattagataataaagtgcttttagtaacatgcctggcacagttcattgattcaaacattgaaaaaaaatttttttaattatacatagtagtgtgtacctttggaaaaattagaacttaacagataaggctaagtttgagccttccagtcctttccttctctgcatactcttcagaggtaactgggatcatgttctgggagcatgtcattccaagtctgtttctttgcttttataaacacatctgtttccatagaaatgctgtagtgtttgcagagggggcggggcgtggtatcatcctggatttgttattctgcgcttttttgcttgacctaccttggatggctctctagtcgttacagcttttaccttttaactattactcagtattcttactaaggtaagactatgctgatgatgtttatatttctctagtaaaaggctgggcatggtggctcacgcctgtaatcccagtgctttgagaatgtaatcccagcgctttgggaagctgaggtggttggatcacctgaggtcaggagttcgagaccagcctggccaacatggtgaaaccccgtctctaccaaaaatataaaaattagccgggcgtggtggcgggtgcctgtaatcctagctactcagagggctgaggcaggagaatggcttgaacctaggaggcggaggttgcagtgagccgagatcaccccattgcacttcagcctgggcaaaaagagcgaaactccttctcaaaaataaataaataaataaaaatatttctctagtaagccatttttgatattttaatattctgctttttatattcttgttgttacattcttataaaggatacatttttaggccgggcttggtggctcacgcctgtaatcctagcagtttgggaggctgaggcgggtggatcacctgaagtcaggagttcaagaccagcctagacaatatggtgaaactccatctctactaaaaatacaaaaaatttgctgggcgtggtggtgcatgcgtgtaatcccagctactcggaaggccgaggcaggagaatagcatgaactgggcaggcagaggttgcagtgagccgagatcgtgctgatgcactccagcctgggccacagagctagactccatctcaaaaaaaaaaaaaatatatatatatatatttatatttatatatatatatttatattttatatatatttttatatatatatttttcttagattcaaagtaaatcttgtgtattatttcttccagcacatcttttgcttcataacttgctgcatcatgtttatgattattattttaaaaagctgttacttctttgaaggaggagcctaaaggctgacagtatctcttctttagcttaataactagtagttctaatttggtattttatactcttagcacaccacacaaatgagtgatgaggaagaggatgatgatggctgtgaccttttcgctgactctgagaaggaggaggaagatattgaggacattgaagaaaatactagacctgtaaggaaggctgtagttgctatcacttggcagagttttagaaccaatgacttgtttttctttttattgtgacttactttgtacatcactcattttggcatatttgtcatttcatttacactttggaaaataatggcaagcatctcaaattgcctcacaagtaccactttcttgtccagatgttatgattttatgagtcagatcattcagaatatgtctagttccagagtttgaagaccatagtgctcctgtctctccatccattcacctttttcttattttcgtatttagatttttaagtattaaagtcaagtattaaaaagaataaggaaataaagggcatctccctttgaaggaacattttatgagtcctattccttgggtgagctgtatagggtacatatgtttaaattcatttaattaaactctgttttctcctcagttcaatttctttgctcttgtatacataatgttgttaggtgtccaaagtgaagtgtactagtttgttacaaaaaagcgattcttttgatttctcctgctgtagaaaagaagcagacctacatcgtttgcagatgagctggctgcccgcatcaagggggatgccgtgggtcgagtggacgaggagccgacaagtgagccccagccgcgttgatggggagtagggggggagtagtgcagggccctctgctggcttcaccaaaggcggatttctctttttattagtaattactacatatatttattagtaattgctacatataatttaaattgtagcgcttattccttttttggttaatgagctcctttagataactgaacactgtggacccacaagaaaaacgtacatgtacacatgtagataaccctttacatataatttcaggggattaatagaaactccagagaaccatgggcaacagcttaagaattcctggctgaatatttactcctatattttgaacacgtaagaatgtgctatatagcatattctagttataacagggtagaaagataacacaataattctttcaacaaatacaatcctgttatgcacatgagcctggtacgaaagcagaaggcttctgccttacaaagagactcttgagtgcccactgtgggcagggccagggggttcagtgctctggtgcagctgagatgaaaggcagatgtcttgctcttagctgtgagttatgaggatgacagacgtggaaagaaccaggatgtgtatactgagggaggacttagtactattaaaactgtgaactgttcttcaagccttaccctcaggagaagcaaaacctcggaagacactcaaagagaagaaggaaaggagaactccttcagacggtgggccttttccctcaattctgttattttaggagcctgttgactaaggaatgttgcttacataattcatgaagtactgctttacatgctgttttccctctgacaaatgggtctgtctccatttacttttctaaagcctctgggctgggcgcggtggctcacacctgtaatcccagcgctttgggaggccgaggcgggcggatcatgaggtcaggagtttaagaccagcctggccaacatagtgaaaccccatttctactaaaaatacaaaaaattagcttggcatggtggtgggtgcctgttgtcccagctacttgggaggctgaggcaggagaatcacttgaacccgggaggcagagattgcagtgagccttgatcgcgccactgcattccagcccaggtgatggtgtgagactccatcccaaaaacaaacagaagccttggaaggcatgttttggggtgctgggaggatatgtgggtgtggagtaaaaattcctgtagagatttgatttattagattttacagcaatcatttcttgtcttcctagaattcttagaagtatagaaacttaggaatctctagcatttgttttcaataaaggatacaccaggcctttttctgcaaacagccatgtccattacattagacttgtccctgtgtcagtttgcagatccctttgtttattctgcccttccttcccccagattggttggggaatgggtcttgaatgtggcgtctgacccgaatgcttgcttcagagtaaagctagatccagggtgctggcctagagaatgaatactgtgtgccacagacgtggacagacttgagagtggaggcccagagagtcttttgagggtgtcagtggactgtgccaggggtttagtgtgaaattcatcagactgcctcacactttgttaaatagtgtcagataaactccatgccagtttggagacacagcagatgccaacccgggaatttgagttctggacccatctttaatactccctgcaaaacattgctttctgtttgctagatgaagaggataacttattcgcaccccccaagctgaccgacgaggacttctcgccatttggctctggaggtggcctgttcagtgggggcaaggggctctttgatgatgaggacgaggaggtgagtccatggcacccagcaacactccctgcagctagctgtgtcaggggtccacagggaagatataggctttgcttgtttagtgggggaaaaacagtttctcagttggaagttgcttctattttcatattttgggacattttgaactaagaatcacagagtgagaaatgccgtatccttctatgctttgttaggtgaggagaagatgtgcacgtgttaatgtgaataatttactaggtgattgtttcttgccttatctgttgtcttccacgtttgtttttaattcctggacaggcctaaattattttagggtctgattttgccatagttatcactttgcaactgattttctggcagagtagtaaatatgtagctttaaatcttgtaggttatttttccttaggaatcctcacatgcagctatgctttctcctggttttttgaattctttgtcatataccttatttcaaccagagtgacctcttcacggaagccccccaggatcggcaagctggagcctctgttaaggagggtaagctggggctgggcagctgcgtctccgtgtgcagagttccaaaactgtctttctcactaggagatggaacaaggttgttcccaagccttgtttctgtgttaagcaggaagctgttgtttttactgtggtccagttgaaagtaattcatcttcactaattcatgtcttggaaaaaacagtaccatctgtaaacccataccacagtcttgcctctttgttaggagagaactcatagaaagtcaaacaagaaaagtaccctagagcaatgttgaggatggttttcattgaatgaagtttaatttaaagaaacatttttaacattctgtatataagttggagaccagtaattccccaacccagtgtgcattaaaatcatctgtgcaggtttttttgtttttttgttttttgtttttgtatttttagtagagacagggtttcaccatgttggacggttggacaggctggtcttaaactcctatcctcaagtgatcacccgcctagacctggcaaaatgctaggaatacaggcatgagccactgcacctgtccccttggtgcagtttttaaaaaacacaaatataaatatgttttttaacctacaaatgttactccataggtttgtggtagttcttgggacttgggaattagtgattctaagtgccgagtctcccgggcacaggcatcagagctgggccttggaggccgctccttgtgcctgctgtgcgggctgctagcctggctctcctctgctttctgctgtccatgttttggcatcagtgacttgcttggtttccccctttgctcttatgtctttatttttttactgatgactcacatgtttttgcggttctttttcacccgttcattctcatccaactggaatgggtagaggtggaactgtttgggggagccctggtcatgctgtccctgcctctgctgtgctcacctcctcccttggtgtcccccagctgacccactgctgtggcttgatgacggtcagcatgctcttccattggagtcacagctcagattgtgttaatccccaaaaaaaagtcctgacatcggtagagaagaaaatactaaagaattttaaaatgacttgttcaggaaaaagtggtttcaaaaggtctgatactagctgtgttttacatcgcacgtatttcaggaagaaaatagcaaggaaagttatttcccttgtaaaatggttaccccttgctttctcattctagagtcttcatcatccaaacctggaaagaaaatcccagcaggagctgtttctgtatttttaggtaacataacttaggtttgttttctaaaaactacacaaatactgttttttgcatttcaaaattatcatcttctaaagtctggctggagatgaggaagtacctgggagcttcaaagggctttgagcatcttatagaaagagctcatttactgatattagctcttattctcctagagctcagtggccttggacttttttgtgtttgagctgacctggtgattctccgttgtgagatgttctgtagcagtaatggatggaggctattgggccctgttatgcattttgtggattaactgaaatggaaagtttttggtgggtgataatttttttctgtaaattcaaccggcccacactggctcacagctgtggctgtcttgtctttccacccacaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggtatgtgttcctgcctccgtttctaggacttcagccagaaaaagaacgttgcctaaaaagaacataagctcacctagttctgtatctcttacagtgccagaatcccttctccagcattcctgtcattgagttgttgtgtctgtacttacataggtgtggtgcctgggaggtctgttttatgatccaatcttttctgctctgtaagctaattactatgattattttccttatagagagctgaaatccttttctgtataatttttgcttgcaatttccagttctgacctttggtattgtaaagttttaatcatcctttcttccagccgaccttagtcaattacatgagcagcaggttgtgtgccggccatttatttcccagcttctcatttctctgccaaaaagctcaggtggccttggtctttcctcagatgatgttttcatccccttggccacttcggcattctcctctcttttcctcttaaatgtaagtcctatgtcctgaagtcattcccataaatcatttgtttttaaatgtgcagatgaatcttccaggggcttttgtcaaaatgaagattccgattcagtaggtccagggtggggcctgagaatttacatttccagcaagcttcatggtctgtagatcacacttcgaatagcaagacttagatccattgactgctcttccagaaaagaaaggtagatccctagatccctaaggtgcacatgattttcagcaactttaaaaaataaaaaaggatggcataggaatggatggaactagaatgcatttagaagccggctgtttggactcactctcttccagtgttaggtgtagaaagtaaggatggaagccgaagtgtgagggaaaacgatagcctagttaatctagaaagagtgcaaacggatgcagaatgcacacaggtctcagtgaagatgacaatgcacacaggtctcggtgaagatgacagtgaatgaaggtagtagtgctttttgtagctccacagggctcttacttagtggatatctttgagaactgatttagaatccctagtaaattgatgctgctttctttgacaactcctagtctcttcagacattcatgagtcagtgacctcatttcagcaacacatgccctattcggtacagcagtgcttatggtgatgaaaggttggaaaccacccaaatacttatcagtagagtaagctatggcccttctattcagtggactattctgtgacagttaaaaagaaaggggtctacgcttgttgacttgggaagattttgtaggtacattaagtggaaaacacaaatggtaagacattgttcaaattatcttcttatttatagccttatttataaataactagtgttaattcattagtacatcctttgggggaattagaagcatgtatgctgaactgttcccaatgttcatcttgtttgagtagactggtggaattatgaggggatttcattatttgcttttatctgcttttgtacagtttgattttttttaaaacaggagccaagccttcatttctcagattccttagatgattgacttggtggccctcttaaatgatctttcttcctctagatctctcttcaccttgtaagccagtccaagctactctaagtacaggaaatggctgcttggataagcatgtcagccacgtggataaactgtctgttctgtctttcaactgaactgctactatgcactttgaaaaattccaagggaagagtatagttccacttactatttctttataactaatcaagaaacaacataactttttatgtttattctttgggagggaagaattttttaatctgtgaattttgtgataggatgtttgacgttagtgtcattttatgccttggtattttttacaggcaaagtccaatccactgccgatatctttggtgacgaagaaggagatctgttcaaagaaaaagccgtagcatcgccagaagccactgtgagtcagacagatgaaaataaagcaagagcagaaaaaaaggtgagcaggagggaagacttaacgcaggagcattgatctgccgcattttaataattcatcctgaacccagagggaagtgctgttccctttcacgttcatattgaagaacttcaaacagaaagtggaaagaacattgcagtgaacacccaaataactgccacccagattgatcagttcttagggttttggcaaacactttatggatgtaaaccttgttacatatctatttttttcctgaactatttgcatgtaagttgtttgaactgtttgctgcatggaactgtttccatgtagtcattgtgacattctacccctaaatatttcattaagcctctcttgaaaagacttccatataagcgcaatgccattatcaacagctgtgagactaacagtaattctatagtagaatctaatatctagtctgtattagaattgctccagttgccccagaatgtctttgtaaaatcaccccaacaaatagaatacagatttaaaattatctcgcatatagttcatactgcaatttcctctcttgtccccaaaatgccatttacagcagtgatccccaacctttttggcattagggacataaggagagtgcaacctgcaatctagatccctcacatgcacagttcacaatagcgtttgccttcctgtgagaatctgatgctgccactgatctgacaggaggaggagcttaggcagtaatgcttgctgctcacctcacctcctgctgtgtggcccggcttctaacaggccatggactggtctgcagcccagggttggggacccctgctttatagtatttttttatgttttgattttttttttgttctaagaaactcaggatttggacagtgtgtctgcattgcatttggttgtcatgtctctttggtctccttaatctagagcaacacctcccacatctttttttttttaatatccagccacttgtattgtagaatgtgtctcgtgaatttgcttgattattttcctatgaatagattcagggtgagaagttttggcaagaatacaagcaggcagggttgtgcacttccagttggatcacctcccaagacacatcaggtccactgtctgcctcattcagacacgtttgtcacttggttgttagggtgcccaccacactgcttcattggaaaggtaccctgtcctcttttgccattgctaagttgatctctaaagcgatagttgaacacagtgtgaatacctgttctctcccagccttttactcagtgttttgaaaatccactgatgatcttttcttgactcagttaatctgttagcgggcacaaaccactatttttttaattctatatttcttattagttggcattcttctgaatgaagttctttctctccctctccttccccgatttttagtattgctttgggatcatgtattcattcttcagtgtagatgataatccattaccatcattcttcttcttttttttttttttttatgagacagggtcttgctctgttgcccagactggagtgtagtggtacaatcacagctcactgcagcctcaacctcctgggttcaagcgattctccagcctcagcctaccaagtagctgggactatatgcgtgcgccaccatgcccggctaattttttgtggagacgggttttgcccatgttggccaaaccatcattctttttgatgctcagattgacctgcatttggccagtgtgtgtgtccccagcagtctttaagcccttctgactgcttgacctttcactgctgtcctgtacagctggtccctcctctttctacagttttgtctctttgtgtcgtgtcctggctgtgaagccctgactttctcctgccgaccacctaaggcccagcattcagaacctgtcaggcccgtcaggcagcctgtctttccatgctgtctctcattgcatatgtcccatctgtgcacccattgacccagactgtgtgtcctgctccctgatacaccagatgtgtcctctgtttgtcttgctgttctcttaacagccccctcagcttgctgcctatcacagcagagactccgtgcgttttctcgattgattgagtaaaccctcttttctgggtatcttacgtgttaatgcttaatttttctttttctttttttcttccccacccccccccccacccccgacaaaggttaccttatcttccagcaaaaatctcaagccctcatcagaaacaaagactcaaaaaggcttattttcagatgaggaggactctgaggtatggaattcttttgcttagttgtgggtattagtctatggatatgacatagaaactatttttgaatcaggtttttctcaatagagttataagactttttgttaagtactccagttctttaaaaattatctctagaggccaggagtagtggttcatgcctgtaatcccagcactttggtaggccaaggcaggcggatacctgaggtcaggagttggagaccaggctggccaacatgatgaaacccagtctctattaaaaagacaaaaattagctgggtatggtggtgcgagcctgtaatcccagttactcagaaggctgagataggagattcacttgaacccgggaggcagaagttgcaatgaaccgagatcacaccattgcactccagtctgggcgacagagcgagacttcatctcaaaataaataaatgaataaaaaataatctcttgagagcacaggggctttagaaagcaatatgtttacaatacttttcactttgggttggactgtatttacatttcctgggatgaaaatcctctctctttaggatgctcagattttaaactgttcatgggctcatgatgtgatgaggagcttgcaccagagtggaggtcaccatgctacttcctttattcacattctcactaactagaccatgccttaacgctgtagcagatgggttctggcatagccatctgtcttgtcgagactgagaccactaacagcctctgggaccctggttcataggttgctttggtccctccaggcaccttagaaccacctctcagaatttcactgcttttcctgagtctctcaggcctaggtcgtcttagatccaattttaagttggccttttaggagatcatagaactgtatgagattgtaatgggaagtaataagccccttttacagaaaaatatgtggacatggcagaaacttacatgtatttcaagaaactgtgggctctagattaggctgtcatggttgggctttgcactcacagcaaggatgaacatggaaccctttggaagtagagtgattgcccttgatgtaaagaatacctttgaggctatcactgaaggcgagtgtacaaaacgtaggaattaaccaaagtccagttaagtcacaaccctgacccctgagaaacagcatgatggggcctccaccgtcttatgctcatggatcccatgtgtcacccacacctgcacctcagggtctttgcaccggcccctgccactctgaggaatgctgttcccagaatccagcttgcttcctcactcttcgatttctctgtgaggcctccctgatgaaatacacacagcaggaagcctgctagcacataccacgctgtgctcctgttcctctttcctatttcactgtttaccacagcacgtgttgccagggacagtgtatatttacttattcattgtctctacttcccactaaagtacgtgccatgagggcaggactttgtattccctatttgtatccctaacaccccgtccttaataccagtgcttggcatgttgtaagccatccagtaattgttgattagacaagaaaaccaaatgtgaacaatttcagtgacttacgagatgttctggttatttgttgctatgaaacaagtaactcaaaaacctagtggttcataacacccatagttttgttgtctcacagttcgagaggttgactgggcttagctaggccattgtcactgagggtctcttgtgtctgaaggtggctgggctgaggatcaccttattcatatgtctggtacctgggcactggggcccctgggacatctctcactagccctgtgtggctcccagcatgtagtcagggaagccggtcctcttacatgctggctcagggctgtaggggagagtcctcagagagagcccgatggaggccatgttgccttctttgttccagccttggaagtcaacggtgttccttttgcttcatttgttggccaagatggtcacaatggcccatccaggtttatggggagaggccataggctccccttcttgatggtgggagtgtaaatgtactctcagacttgtgtgaaaaccctaccaaaggctttgccccatgtgtgtcatcatagagcgaatgtttttattggatattgttcagattctaaggcaaggagaggtaaaactaaggcagtctaagtaagagttaaagctttggacccgaaggaatgcgtcctgactcctttctctatatctcaagtgtgaggctgaagcttgccctgtggtcattttgggggaacatatttgaggtaatggaagtgtcttttcttgcagtaccaagaaaggtatcagttaagggtccgaaactgtgatgttgacatttgtttttgttctttgctttggtttactttcattttcttagaacagcagaaccctttctcttgccattgtgtaacatgcaggagggacacgggatgcctggaattccccttgtggcctcttctatctaaataaacccatgggactccggggagcacaggggaaaaacactgtgtggaggagatctcacttagtgaactcattaggtctatatttaggagtagacagcgaccccataattaaaaaaaaaaaaaactgtccaaagaggtcttagaaatatcttcttgtcctatttaattgttcggctcttgtgtattgaagtttatcttcccaagggaatagatgtcccattttatgtttctacttcatgtaggtcaacttgcaggtctttctttgcaggataagctgatgttttataacattttgaaaatttcttgatttttatattttttagctattttgagatgaaattatactctttttgcctaggctggagtgcaatggtgggatcttggctcactgcaacctctgccttccgggttcaagcaattctcctgccacagcctcctgagtagctgagataacaggcacccaccaccacacctggctaatctggtatttttacaaaattaatataggctggtcttgaactcctgacctcaggtgatctgcctgccccagcctcccaaaatgctgggattatagacatgagccacagcaccgagctgaaagtttctttagaatctatcaggtcttatcctggtttgcaatgtcatatacctatagttaagctaagtagactagcaaacatttaaaaataaagtttaatttgtatttacttaaaagaaatatgtcggccgggtgtggtggctcaagcctgtaatcccagcacttgtggaagccgaggcgggcggatcacaaggtcaggagatcgagaccatcctggctaacatggtgaaaccccgtctctactaaaaatacaaaaaaattagccaggcgtggtggcaggcgcctgtagtctcagctactcaggaggcagaggcaggagaatggcgtgaatccgggaggcggagctttcagtgagccgagattgcaccactgcactgcagcctgggcaacagagcgagactccgcctcaaaaaaaagaaaaagaagtaagtcataatcttaggggaggagggtgttactaaataaaatagttgtagctccattaatttgggaatctagcccctgtttctttattgaccctgtctaatctttgattctttagacggtaatgggaagccatgcttatatatttatttttttagcatggtgtaggaaattgattcaaaaacttattcctgccttctgtcattcaggtgggaatacagaagcccctgggctctgcgaggccaccagatcctgtagctctcctcctccttagtgccactgcacacaccctgcacagaccctgaggcctatccctttaaggactctgtctgagccaccttccctctcaggaaagaagcctagacacatggcagctgtcatgtctgagtcacttgtgttttatactgacctgatattttaaaaactgatattcctgttaaccagcaactttaatttcaatccaacaggatttgttttcttctcaaagtgcgagtaagttaaaaggtgcgtctctgctgcctggcaagctccccacgttggtttccctgtttgatgatgaagatgaagaggtaaacattgttattgtaacactagataatttagattaggagaaaacggttgttgatgcaactttctacccagaggctcatatactagcaaaaggtggtagggaagcagtcaggccacctgaagtttatataacaaaaatatttctgtttttatttcagtgacttcttccttatattttcctagctgtgcaatggagaagacattagattcttgatgcagttcttttttttttttttttccgagttggagactttctctgtcacccaggctggagtgcagtgatgcgatcttggctcactgcaaccgggttcaggtgattctcctgcctcgacctcccaagtagctgggactacaggcgtgcaccaccactcccggctaatttttgtattgttaatagagacagggtttcaccatgttggccaggctagtttcgaactcctgatctcaggtgatccgcctgcctcggcctccctaagtgctaggattacaggtgtgagccaccatgcctggcttcttgacacagttcttatggagtgaaatctacaggttttatttttagaaatctgcctttgagaaatacaattgaccctttaacagtgtggaggttattttgacttccacattgcagtgaaaaatccatatataacttcttacttcccaaaaacttatctactgatagcttactgttaaccagaagcctcatggataacataaacaggtgattaacatataaatagtataatatctatttatatatttttgtattcctgacatatccagcttttccttattttttttatgatatttctaggccacatggtttgtctgcaagatttttcaaattgttgcaaatgtccaaaaaaattttcaacatattactgagaaaacatttgtgtagaagtggacctgtgcagctcaaacctgtgtcattcagggtcagctgtactttagtctagaggatggatcaacatatacccaatgacctacaagaatgttttggatcaagtggagatacaaaggagaaggcagccatgtcctgaccattgtctttctttcccatcctggctggagagagcacagtggggaagagaaataagagagaagacaacccaaaccttaactctcatgcagtactgggcggtggtgagctcaaaggctttgccatcagacccctgggttcatatcccagctccaccacttgcaaaccagggacctggggcaagtaacttaaccttccttaagcttatgtggcttaacagtgagtagggtcactgtggcagctgtaactactagtgtgaagctcttgcagagtgctggcacataataagtgcatagtgaatgtgagctctgtcattagcatccccaatggacaccagctcattattctcctggcctgtcctacattaccgcactctccttaaaggagacttcatccaggaagacactcccttcatccatcttcacattccagggctgttcacctgagtttgtccatcctaactcagattcaggccctctgatgcttttgttccccttatctgaataaaagcaccttaataaatataacttttggggagtgcttgaccacagaagaatttacaaatgccattaaacttagtacaccagcaattttatttagtaagctatttctccactttgtataatctctttgaaactaatgagaaacacaagtcatgccttccctccatcccaggtgtatgtctttctgacctgtaaaggagtggagacagacccccagttctctcctttcagccattgttctggtttctcattcgtggagacaacagtgtgagtttctggctgctgcgggggctcccgtgcccattgcaggctgtaaccccctgaaatgagcagagaggcacttgcccacagggtgactggatggggctcagtttctccttgtacttcatgatctcatttgcatgttgttctcctgcttatatgcagctgttctgccttcgagttctatggtaatctctttcccttctatgggtgcagtgagaaaaggctgtagtttgggatttactagcattttgcggtttttccccgccagagttgttatttgtatacctgactggagacttacttccttaaagtttgatataggaggacatcctatgttttctgattataaagttgtcttacctttctgccatttgcttttctaggataatctttttgggggtacagctgctaagaagcagacattgtgtctacaagctcagagagaagagaaagcaaaagcctccgagctctccaaaaagaaagcatctgccctgttgttcagcagtgatgaggaggtgagctgaggtttctgctaaagaagaggggattatttcatgggatttaagagttaaagccatcccaagtctttttctacctgttttatatctcgtgatgttcagtcaccaaaggcgatgttcacaagattgtcttttctgacggaagacatttaatgtaatatattaatttaaagatgaatctcttcaaaatggttaggaataggtatgactcccacacaatagtgtatgctccttcaaatgagttaggccggctaggggggaaatgatttctcagccatcgctagttcatggtcgagtcccttagaacaaatgacagattaaccagagaaaagtgtgcaagtttacgtaagataagttttaccagacacaggagccttcagaaagaaaaactcaagagaaacaggaaatcctgtgtcaattttatgcagtctgatgaagaagcggacagttttggggagcacgattagatgaaaggggtgtgacctgatgggaataagctggggggagctcagcaaggcctgtgtggtcagatcattctctgcatctttacaaataaggaggctcctttcctctgggaatagggaggactggaatgaaggttttatgacctactccagagagggttagaggattcttctatgtcctgcttcagaggagaagggccagggaaaggtcagagagacctttctgcttctgttttctcaaatgccaaggtgtcatattttgaggtagcatgtcccgtataccccaatggccatatatactagtatcttgttaaatgactactgtgtttcattaatttagaactatagttaggaggagttacctattgaggttaaactcctttttgagggagtcttaacaatatttctgtttgtgatctggatagatactaccaaatcagttagtttagttgctaactcaatcagatttagtagcagggaatcagatttagctgtgcagaaaaagactttaaatatgatgatataaaaaatcctgagtagtaaacatcttcctgtgttataataattcctctttttttttaacattgtaggcaagttaatagggggtgaagtggatatataagtcatagatatgttcatgttcttactgaaagcaatttaaaaattccgaagcagattgcaaaaaaaaatgtattaaaagcttatgcggccgggcgtggtggctcacgtctgtaatcccagcactttgagagtctgaggcaggcagatcacttgaggttgggagttcgagaccagcctaaccaacatggagaaaccttgtctctattaaaaatacaaaaaaattagcaggttgtggtggcgcatgcctgtaatcccaactactcaggaggctgaggcaggagaatcacttgaacccaggagatggaggttgtcgtgaaccgagatcacgccattgcactccagcctgggcaacgagcgaaactccgtctcaaaaaaaagcttatgcaacacacatgtgaacaagacacaatgaaaaactgctagtaatccttttactacaaaagtctgagtctggcctttagaaagcgtttaaggaattcccacccagctgtgctcatgccttcacatcaaggaactcccaagcatatataatttgtgttttctactcaaatgtatgaatttatgatagattatccagtttttttcttttaaacattgtcggtgattgttccccctgtagcaacagccagacatcagtgtagttgctcctactagagtattatagtggttcagggaaaataaaaacattacctaaagcttggagcaaaaagacatgcagaagaaagacagccaaggttctagaacaggggcgtccagtcttttggcttccctggcccacactggaagaagaagaattgtcttgggtcacacataaagtgcgctaatactaacaatagctgacgaactaaaaaaataaaaaggttcgtgcataaatcccataatgttttaagaaagtttacagatttgtggtgggccgcattcaaagccatactgggctgtgtgtggcccatgggccacaggttggacaagcttgtcctagaacaaaggctgtcaacttcggctgctcattgggatccatggggaacttaaaagagtgctgacaggccgggcacagtggctcacgcctgtaatcccagcactctgggaggccaaggaggtgggcagatcacctgagattaggagtttgagaccagcctggccaacatggcgaaactctgtctctactaaaaaatacaaaaattatctgggtgttgtggtgcttgcctgtaatcccagctactcaggaggctgaggcaagagaatcacttgaacccgggaggcagaggttgcagtgagccgagactgcgccactgcactccagcccgggccacagagcaagactctgtctcgaaaaaggaaaaaaaaaaaaaaaaaaaaaaagaagacctgacgagtgctgacagtggatcccagctccagagattctgaattaatctggttggggtacagcctcgtcattggagttttgtgatactctctagtggatttcagcgtttagtcactgctaaacattgaggagcacttctcaaaccttcatgtttaggaaatcacccaggcaccctgtgaaatgcaggttctgattcagaaaataggcgcggggcctgaaattctgcataatctgctgctggcttgtggactccagtttgatttgcaagactctagactccagagatagagcacttatgcaagtgcttgggagttctttgatttgaaggggtgtgagcatagtcgagtagaatttccttaaatgctttctaaaggccacattcagacttgtggtaaaaggattactagcagtttttcattgtgtcttgttcacatgtgtgctgcatgagtttttacacttttttttcaatctgctttaggatttttagaattaaaatattcttctctggagttggaagttcttgagttcttggtatttttacatttggcttccttcttatagcctctgtaattaatgttgattccctgaaatagacaagtcgcttgtcgtaatacagtgcagaaccacagtgggaagagacatcgtggcaggtgttggaggaggaaatcatgagaagctctgtgaggtcagagagcccagctgtctagatttgagttcaaagaaaagtcttaagcatgagctttcttcaagactgatgcactaagtttaatacttagtttaaatacaacttagtttaacaaatataagtttgattttactccccatgttttataatctaaattgccattggacttttttttctttttttgagacagagtctcgctctgtcccccaggctggagtgcagtggcacgatctccgttcactgcaagctctgcctcctgggttcactccattctcctgcctcagcctcccgagtagctgggactacaggctcccgccaccacgcccggctaattttcttgtatttttagtagagacggggtttcaccatgttagcaaggatggtcttgatctgctgatctcgtgattcacccgcctcggcctcccaaagtgctgggattataggtatgagccactgcgcctggcctggagttttaatatatattttatgttttaaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacaggtgagatagtcattggaaggagtccctcactccgttaccgtggtaacaagaaaaggaatctgatgcacaatctagttcatcgggtgattgctaatcatggatcacatagtgattgtgccagtgagaatgtctttgcttttcaatggcaccatcttttccctcagtacccggaaatgtttgtctttgtggatccttatctgatttcttccccaatcattattttttaaccatattctttttctttgtttgtcagggatttgagtatcttttgtttgtgatttttctctgggctactctaaagtatgtcaggtttggtcaggattacttaaaagttactttaggccaggcacgttggctcatgcctgtaatcccagcactttgggaggccgaggtgggcggatcacgatgtcaggagttcaagaccagcctggccaatatggtgaaaccctgtctctactaaaaaaatataaaaattagccgggtgtggtggcacgcgcctgtagtcccagctacttgggaggctgaggcagaagaatggcttgaacttgggaggtggaggttgcagtgagctgagatggcaccactgcactccagcctgggcaacggagcaagactccatctcaaaaaaaaaaaaaaaaaaaaaaaagttatttgaatagaaatctgctcagcatttaacacatcctgttaggaggaagttccctgtagagctgtgcagtatcactccaggggctgataacccatagccaacctaggtgcctctccccattaatgctggaactgaagctgctaggatattcagagtgagcgtgggctgtggttggtataacatgctgccagattagcttatgggttcagaattacttccctgcaaatactttttttccttttgaaagcctgacatgattactttgaaattcacctgaatgttattagcagaaagaagtaactgattggacatgtaaatcctatgctttggtgtggttaagcgtcatttgatagattcagaagtacgtcaggtttctgtctccaaatactcgaatcttgtcaagcatcaccatttctgcattaggcctctgtaacttgacactcggatgcatctttggtctctgatttagaatataggctctggaaacttgatattaaattctgattctgccagttcctgtctgaataaccttgggcaagttacctaacttccctgtgcctcaatttcctcatttgttaaacaaaaataaaaacagcatttctctcatcggtttgttgggatgatgaggtggaatctaaatgtgaaatgctgagcacaagagctggcacattctgagccctcaggtattgccagttagcatcgtgactgcagggaaatagtacattcctttatttttgttgctctctcctgggacattcttcttcctgtgttgcctggccaccttctttcaaaactaagtgtaagtcttgtttcataagaagccttcccggctgggcgcagtggctcacgcctgtaatcccagcacttggggaggccgaggcaggcagatcacgaggtcaggagttgaagaacagcctgaccaacatggtgaaaccccgtctctactaaaaatacaaaaatgagctgggcgtcatgtcacgcacctgtaatcccagctactcgggaggctgaggcaggagaattgcttgaacctgggaggcagaggttacagtgagccaagatctcaccactgcactccagcctgggcaacagagagagactccatctcaaaaaaaaaggcctttcctaactttaaacagacgagaaagagaagaagtagggagtcgagggcggtcatggctccaccttcataccccaacaccctcagctgagcattttctgcactgtatccaggttagcttattcccatgagtgtccactacccccaccccacacaaggtcataaatctggcagtctgaaccccatcttgtttgtgggtcctggttccagccacacaccatacctggctttcaggaatgctttctctgctccagatacatcctacctcctattgttcccgaagttgtctgtcaagttttgtgtatggaaagtaattcataccttcatcagatctcaaaagaagctttacacacacaagaagaagttgaggtgaggatgtggaggaattggaaccctcatacactgctggtgggaacgtaaaatggtgtagtcactttggaaagtagtttggcatttcctcaaaatgttaaacatagagtcaccatatgacataatagtttcattcctatgtatatacgtataaagagaaatgaaattagttgttcatataaaaacttgtacatgagtgtttattgcagccttagtcataacagccgaaagtgtaaacaacccaaatgtccatcaactgatgactggataaacaaaatgtataaccatacgatggactgttcttcagcaataaaaaagaataaagtagcgatgcatcctagaacatgaatgaacctagaaaattttatgttacttgaaagaagctggtcacagaaaaccacatattgtattgttccatttatatgaaatgtatagataaaccacagagacagaaagtagattagtggttgccagggcctgtggggcagggggaatggagagtgatggctcataggcatggcggttctttttggggtcatgataatgttgtgcacttaggttgtagtgatattgcacaactcgatgagtatattaaagaaaacattgaagtatgcactttaaaagagtgaatctggattaagaaaaccattgaagtacgcactttaaaagagtgaatctggccaggtgcaacggctcatgcctgtaatcctaactgattgggaggccaagtggaaggatctcttgaggccaggtgtttgagaccagcctgagcaacatagagcgacctcacctctccaaaaaagtaaaaaaattagccaggcatggtgacgtgtgcctgtagttgtagctacttgagaggctacttgagttcaggaatttgaggctgcagtgggatatgattgtgccattgctctccagcctgggcagtagagtgagaccctgtcttaaaaagtaaaataaatattaaaaataaagtaaatacaaggtgaattttatggaatgtaaattatgtctcaataacgctactaaaaaaaagaaatagaagccaggcacagggtcatttcccagtgctgatcctggccctgtgatctctcttggcaaccgtcttcatgacaattctggaaataggcctgtccgctttgattctttttgtgctataggaagtgggagagaatgttctgcttgggaaggctcaggcatcgtgtgccttgcagcggtaacagctgatgaacctgcactggatagtaacaggaaaggggcaacctgaggcaggagggacagaggctggtgatttgttggagtcagatttcatctatttcaaaggtctttcctgtttgctttcaactgtgtaaggtcaactaatggcttgggtgtttgggtggtaggtggattcctgtaggtgcagtctagaagaaatattgttgttatggtttttgtttttttcatcacacttttccttaatttgaccttttgtttgtttgtgtagccaaaagaagacccagagagtgtcactcctctttgaagacgatgttgatagcggaggctctctgtttggctctcctcccacatctgttcctcctgcaacaaaggtattcttcatctcttagtcccaggaaatgtccttgagtttatgctgcatcagtagtggtacttccccgaatcagctcttcatacctaaccttggaggctgagtcttatggaagaccttatttgcctggtttcagaaagagatcttctgattaatagtattctagagaagaagcacacgtgcaaaaccatcattcagtgtcaggtgtaggaacaaggaactgggtctcagaagaggcttgggccccattgtcatggaattctgctaacattagactaggccagttaaggcaaaatcattccttttatgagtgtgtgtcgagtactaacactggtcctggtttatattagccagtcagtaaaaaggaaggaaattctcacatgtgctacaaaatgcatgaaccttgaggccgttatactctatcagtggagaaatggtcacacaggtcctagtacagttagactgtggaatactatacagtggtaaaaaaaacccagggtggagcttattgggatgaaaaacatactgcaggccaaaaaaaaaaaaaagcgtaaacacgtaaacatggtgtaatttaaactttacaaaacaagaaatacacatgaatgcctggaaaccggcctgaaagcatcgatagcacattgttaccagtgattatgtccagggaaaggtatggaatggggaacttcatactctcaatgcctttttaaagcctttttaaggaaggcatttgtgcattactgtggaattagaaataaactccaaacaaaaaatatctaggagatatggaagaagacccttcctgttaaatggagttgctcagcttataccagaagctctcagccctgggccagcatgctgcccaccctgggccccaggctccctgctgctgcttctacggggctcctgagcctttccttgggtgctctgtacttacatctccccctttaaggacatccagtggttgtacaattaaaggagtcaggagatctgattggtttttctttgtaaattataaataaactactctggaggataactgagcaataaattaatgaattttggagcctctggagctgtaaaacttctttcaacctatggtaattatgattgttaaataaaacaaaaggtcaagacacacaacttaagtagctgaatagcctacacgtttttgattatttgtgaaatataatcatctttagacaatagtaaataaaagatatttcttgtttacagatatttcagtgtaagttaattgtgacttggttgtaagcctatgttgaccaaaaggttaaaccacaggcaggagaacttaaagaaatgtaatgtgagttttgttttgagccaagcttgagaactactagcccagtaaagagactccacacaaactgagaatgcgtcccagagtgggccacacgagacacagcatttatacatttctgttatatagaaaatgggaaaagggggcagtgaagcaacggtgactttcttaattcagattggtgctcggtgacattgaatataagataaagtaaatatgtggttaatgtattttcctcattagccttttaccctaatgagtacataggggtcgcagttgcagggtcaggagagggatggttgattttgtgctgcctttgtgcttcatccaataggcaggttgtaatcggtgcctgtcagtgtgatatttgacagactctggccttgcaggtgaggttcagctttcgttcataggcccggtttctattacccatatggccaagatgcagccattttagacaatttttttttcttcagactttccttattttctgacacctatcaagaaagtaaatttgaccaggcgtggtggctcacgcctgtaatcccaacactttgggaggctgaggtgggtggatcacctgaggtcaggagtttaggaccagcctggccaacatggtggaaccccatctctattaaaaatacaaaaattagccaggcatggtggtgcacgcctgtgatcccagctactagggaggctggggcaggagaatcgcttgaacctgagagatggattttgcagtgagctgaggttgtgccagtgcactccagcctgggcaacagagtgagactccatctcaaaaaaaaaaaaaagaaagaaaaaaacaggaagtaaacttcatgacaaggatgagcttgtcttcaagaagattaaaactggtactttgggtagcattttctgtggtttaaggaccttagttatatatgaaggaagaatatgatttgccatacttaagtctctttttgtctcccctatcaactatttgcattgaattattattatttttttttttttttgagacggagtcttgctctttcgtccaggctggagtgcagtggcgcatcttggctcactgcaagctccgcctcccgggttcacgccattctgcctcagcctccctagtagctgggactacaggcacccaccaccatgcccgactaattttttgtatttctttagtagagacggggtttcactttgttagccaggatggtctcgatctcctgatctcatgatccgcccaccttggcctcccaaagtgcttggattacaggtgtgagccaccgtgcccggcctgcactgaatttttatgtagttttcagtgagtccaggatgttccacaaaagccttttcctttgattacttcagtgttgccttatctcttctgaaattctttatgccttccagtgttcttttatgttaagttcaatggttttgcactttacttatctcttcctaactaaaaatccccttgctctcttctttcttcattcatcacattttaaaatcatgattagcaatgtccttccttagtttcccaaatctgccttcctaacttgatttaggcattgcctcaaagcacacttcctcgtgtcatatggtatgatttgtatctgtactatactataatagatctttagttttttctcaagcacttgttgataagtcacttgctgcaaaaatgccatgaattccaggaaagtcacaaacctcagtttcctagtccccaaatccctgcctccctgataaggaagagatgagaaatgggctgaagtgcttgcagacttgtattgaacactgagttggtataaaacactgggactgtccatgaaaatatagtgtatagtcctttcagatgaacagacaaacagatgtgtgctagctgttatataagttaggaagaaagtcaaggaagggtcaagtagagagataaatattatgcttattcaacaaagcaactgacacttaactgaagaggacagagaccgtgggtgacatctgcgtgggggccctgcttgaaggatggggaggatttgcacctacagacatcgagggcagcgtggcatggaagtttgaaagtttgcagcgaccttaaggaacagcagggaaaggaggagatgcatatgagtagagggatagaatggggtatctgctgagtgtcatttgcttcatgcaaggagtgctggtttgggttgggagaggacctgatccagcaggtgttttgttttagcaagacaacgctggataatgtcttctagttgaaatataagaggagtgaggcagagagagagactcataatcgtctggtggcagagataaggatctgagggagggaggcatgggggttgacagacacaagtagacagatacaggtgatgtggtggcgtgaagtgtcctgtccacaagtcccgggtggtggtgtttgttgcttctcccttttggtgctaccttcactatcctgtcctctcttccttgatcacatttagctgaagccctaagaggatggtttgggcttgttctgtatatggccatgctggtcagacacacttttttattgttgtggatgtcatgtactcttcttttggtagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggtggacttttttctcttgtatacttgaatgcatttgtctctcgtatgttgtttcaaacacacacaaccccttaagttttttgaccacagaaaataaatggcccatttgtagacagatttgaaaacatagacaagcaggctgtgtccccacagtgcaggaagcctctgcagggcctttcctcccggcccttctccaagacatgtgcgcactgtggtgtgcctgctcctgtctctgtggttactgtcacgtcatggcatctttgctttctaacttgttctcttctgtgcagtgttcctgttacccttggtcctcctttggtccccaagtgcacttgaatttaaatgtcagttttaaggagattttagtttagcatccttttacttttagatgatattggcaaggattacagagtagagtgaaatttctactctttctaaaacactagctttcaagtcctggacggtctgccgtctcttgcaggaggcctgtgggtagttctgctggccacacctgggcatccagctttgtggttgccttcagtctctatatgcctcttttctttctctaacttttcttatacgctgtgtgtccagctgcttaggtctaagatctcccagggcctgtgtgaagagcgttgcatttgcatttgctgctgaggctccttggagctacagtgatacaagcatttcatttgtacctgtgttcctgtgtgaaattctcttcctagtggctgtgtgtggaccccagtcctatcccagtcctggtccacacttgactctgactggttgctgtactgccctctccctgagtgtaagccccttgcggactaggcccagtttgttttgctcaccatcatatctgtagtactggcatattaccttgcacacagtaggcactatgttataaactttgtatttctttaaagaagcatttttttaatagtttgagtactctgaaatcgggatgtacctcataatcaatggtatcttacctgaaatgtgccatttgttgaatgaataaatactgcattttagaattatttcagagattcttcttcaattgcctatacagtgtaagccttttacaatttgagggtctgattttcctgattagatttcccccttggggcttatgtattagttaaatgctacgaattcatggtccactcccaatgattggcacttgtattggttatctttgacacttagaagttcttcctagttcatgagcaaccagtgtgcatcaggattatagccatcctatcacttgataggagagagggacccatggtcttaatgcttggaaaagttatctttggctacggatgattgtacaagactgtctcttggagcagccaatcaagaattgacctcagtgttttgttacttgggcacagatgtgattcactgtgccctgagtcatgcaaatgtggcagttactgaattaacgagaagcttggcaggctccatgataggatttgtatttccaggtgttacttattttttccccctattattttcattttcaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaaggtaagcaaaaagcaatagtggttcaagtctctggatgagataaaagactctcatctcatggttgtcattctgtcatgtgagtttctgaaggaatcttaaccttcaatgtagtgtgttaatgattctgtgcagtcatttagatatttgggaatcttaatcaggaactcttacctcaagtagcagtgttaggataggggattagaatttcaccccccctcttctgggatttacagaccttgttgttccttctagcaaaactttgccccttggccagttgtgggatgtaaacagcaggaaagggaagttaggctggagttgtacagttaagtatttctaacattcagtttaagaaaaagtgttgtagatgaacctttcatactgatcaggtgtcagcaaactatttctataaaggaccatataatgactattctagcttttgcagcctatttgggctctgtcataactgcctagctctgccattggcagcatgaaaacagccctaggaaacatgaagatggatgggcatgactgtgttccagtaagttttattaataaaaataggtgatggtcagctgggcatggtggctcacacctgtaatcccagcactttaggaggccaaggtgggtggatcacaaggtcaagagatcgagaccatcctggccaacataatgaaaccctgtttctactaaaaatacaaaaaatagcttggcgtgatgacgcttgcctgtaatcccagctacttgggaggctgaggcagaagaattgcttgaaccaggaagtcagaggttgtagtgagccgagatcgcaccactgcactccagtgtggcaacagaacgagactccatctcaaaaaaaaaaaaaaaaaaaaatagatgatggtcattctgtgaggttagtatgaccctgatattaaaactagacagtgacatcaccagaaagctagatatcctttatgaatgtagaggccaaaatcctcaacaaaaatactactaaacccaattcagcaaaatataaaaaggattgcacattatgagaagtgagatttacccctggaatgcaaggttggttcaacatctaaaattagttgatataatgcactgtatcaataaaatacagaattaaaaggcgcatgatcatctcaacagatgcagaaaaagcttttaataaaatccaaaccttttcatggtaaagcactcaattaggcataggaggaagcttaatgaacttgataaaggacatctatgaaatccctcagctgacatcatacttaatggtgaaagactgcatgcttttcaaccctaacatcatgaacaacacaacaatgtccactcttggtaattctaatcaaccttgtactggggattctaagcaggccatgtaggtgagaaaatgaaataaaaggcattcagattggaaaggaaaaagtgaaatgaagcaatctgtatttgcagatggcatgatcttttatatagaaagtcttaaggaatctgcaaaaaacatccattggaaataattaaagtcattaagattgaaggatgtaagatcaatatgtgaaaaccaattgtagttctgtaagctagtaatgaacatttactaacttacaaaagttactactagtaactttctttttttttttttttgcaatggagtttcactcttgtcccccaggctggattgaaatggcacaatcttggctcactgcaacctttgcctcctgggttcaagcgattctcctgcctcagcctcctgagtagctgggattataggcacccaccaccatgcccagctaatttttgtatttttagtagagacagggtttcaccgtgttggccacgctgaccttgaactcttgacctcaggtgatccacctgccttagcctcccgaagtgctgggattacaggcatgagccactgcacccaacctactagtagtaactttcataagcaattaccagcttatgaatgaaattaagaaatcagtttcttttatagtaataccaagaagggtaaaatacttaggagtaaatttagcaaaagaagtacaagacttgtaaactaaaatctacaaaacattgaaagaaattaaagacctaaaattgatggaaagacatctcgtgtttatggaccagaaaccttaatattggtaaggtggcaatacttccttcccaaattgatttattgtaatctctatcagaattccagcttgctttttgcagaaatggacaagctgatcctaaaatttttatggaactgtaagagaccaagaatagccaacagtcttgaaaaggaagaacaaagttagaagactcacacttcctgatttcaaaacttactttaagacaggatggtattggcataaggttaaaatatatagatcagtgaagtagaattgagagtctagaaataaaccctcacatttacagtcagttgcttaaggtgccaagatatttcagtggggacagaatagtcttcagcagatgtgccaggatgctgattatctacatgcaaagggatgaagttggacccattaataaataaactcagatccaatgtaagatccaaatgtaagaactaaaactgtacaactcctagaatctagagagtatgtgagtaaattatcatgaccttggattaggcaaagccttcttagataagacaccaaaagcacaagtgacaaaaatagctaaattggactttatttaaatgaaaaacattgtgcttcaaagggcaccatctggaaagtcaaacgaccacccacaaaatgggagaaaagatttacagatcatgtatttgataaaggactcagatccagaatatgtaaaagacttataagtcaataataaaaagacaaatagcccagttgaaagaagggataggccaggcgtcgtggctcatgcctgtaatcccagcactttgggagaccaggacgggaggattgctttaggctgggagttcaagaccagcctgggcaacatagcaagatcctgtctctacaaaaaattttaaaaattagccaggcctggttgcgtgctcctatagttctatctccttgggaagttgaggcagaagagtcctttgagcccaggagttcaaggctgtagtgggctatgatcacaccattgcactcaggctgagtgacagaacgagaccctgtctgaaaaaaaataggtaagacagacatctgaatagagattttactgaagaagatagacaaatggccaaaaaggatatagaaagatgctcagcatcagggaagccaaaaccacagtgacataccacttcatacccgggaagaggaccataataaaaaaaaaaaaaaagggaagtaacgagtgttggtaaggatgtggataaatggaaattctcattccttgctgctgcaagtgtggaacagtacaaccactttggagaacagtttgctgttcttcaaattcttataacataaagctaccacacaatccggaattttattcctgggtacatatccaagagaaataaaaacatgttcacacaaaacttgaatatgattgctcccagcagcattattcgtaatagccaaaagatggaaacaatggctaaacataatatagtatatccatacaatggaatattatttggtaataaaaaaggcaaagtactgatacatgctgccacatggatgaaccttgaaaacattctaaataaaataagccagtcatgaaagaccacatattatgtgattccatttatatgaaatgtccagaataggcatatcaatggagacagaaagtagattagtagttactgggggctgggagtagcagtgagcaggaatggataattactgctaatggtttggggtttcttttgggagtgatgagaatattctaaacttagattgtggtagtggatacacagatctgaatataccaaaaaatcattacattttatacgtaaatgggtagattttatggtatatgaatttgatctcaatggtgatgttatgcaaaccaggttggcaggtcatagattgccaatcctttttatagatctaaccaaagaaatagtctatgtttatttctacaaaaaatgttatatgaatttttttgttataccaatactataagcttatttataaatgagagctgcacacagtgaatatgattaatttgatatattttctcccagtctcttactgtgtatggttttgtaatatttttccatagttgtgaaatatttaacattacttgctgtgttaaactcatttttatatataacaataataattattgttaatgtgatttattttgttagaagtaagtttttcattagtttttttggtttttttgttttgttttgttttgttttgttttgagatggagtcctactgtgttgcccaggctggagtgcagtggcgtgatctcggcccactgcagcctctgcctcccaggttcaaggattctcccacctcagcctcccaagtagctggaaccacaggcacacgccaccacacccggctgatctttgtatttttagtagaggtggggtttcaccacattggccaggctggtctcgaactcctggcctctggtaatccacccaccttggcctcccaaagtgctgggattacaggcatgagccaccacgcctggcctttttgttaagttttaatctgtggctgtgataaggaaatagggatgaattttagaatgtcaggtctggagcattgtattatcaaaccaataatgttgatggtaacttttaaatgttagatatctagtaaacaaaaagggactcactcggagtctgaaagtagggcagaagtgatggacagccataggaaggcttgtggtcgcacctgtgccaggtctttggcctgcagtgcttacaggtgagggacacatacttgaccactctgtgtagtttgtgcttgattcagctgctgtctcttcttccctttggaaatgagatgaagagaattcattcagttttatgttttttaccttcaaaatgtttctcattatggaactaatggattgcttttctaataaaaaatttagatactatacaaagtttatataatatatataacctggaaagattatctctaaagcttgtgcatatatatatatgtaaactttgtatttataaatatattttctggtatttttggaagcgccatagcattccattttgtcaatgtttcattcccctactgagtggcttttaggctgtggccagccttttgctaatataatacagctgcaggggacatctttgttgtgtccatctttacatatgtaacttccttgagataagttcttacagctctaatcacacatgaccttccctcctgttcccagggccgcgatcctgatgcccaccccaagagcacaggtgtcttccaggatgaagagctgcttttcagccacaagctccaaaaggacaatgacccagatgttgacctttttgctggcaccaaaaaaaccaaggtcagttccaaatggttccccacagtatgacttgttattgtattgggtgctgtctcaacagctcacctagttctctttgtaaattgttttgcttttggatattgaacttgggtcttgtttattctagctgttagagccaagtgttgggagcctgtttggggatgatgaagatgatgatcttttcagctctgccaagtcccagcctttggtaccagccttttgttctcaatactgggttgtgtgggaaagattctgggaaaggaaactaacgtccagttagatcattaaggaaaatcctaggagagtcgtgctgcttcctactaaatgaatggcaaataacatgctgaggggagcgtgtgtggaggatgcaatgcttagtttctgttgttcctcattttatgttccctatactaacattaaaacattaataatccaggctctctgactgtactgcacatctgtgtgatgtttaaatggttgattgaaagaccattgcatacactggggtgactaaatattcgtgcctttcaggtgcaaagttttgagtctgagttttagcctttctatgtcattttctcccccagccccagtaggtttttgtaagtactctgttttctttttatcatagagaggactcctgtgacagccacagtcttcagaatgctatttctgaaatgctacctttgagttggttcagccctcatttgagaaagtatttttaagactcagaagccaggattgttttttgcattatgatttttccttaaaatttctaagatatttgatggctttttggtattttttttcttttgaaggtacaagagaaaaagagagtagtgaaaaaagaccactctgttgactctttcaaaaaccagaaacatcctgaatccattcaaggtagtaaagaaaaaggcatatggaagccggaaacacctcaggttagaaatcctctttaaggattttcagctcttgtttgcatcccagtacagagaaattccattatgcagacccacagttattcagacttgtctgcattaaggaggaaacagcaaccagggctaccgctttgtcttcactgcactccccccaagtcatctcccctctcctcgctccacacgccagagtttcatgaatctatactttaatagttagtgttttttgatgccatgccagatttaactctgaagtggagttaaggtaggatgaagaatcttcttcccactaaagaatttatttctccctctggatttccttggaatagaattaaaatagaaataaatataaattacatctgatttcctgcctgctctcagtgttgcctctcccaaggtcattgctgttgggccgtactctgcagcagtcttcccagaacgctgtggagctcctcctgggaacagcccaggactggagagcgagtgccagttccacgtgcaggtgtcccagggtgtctcactgaagccttagtgtcctgagccgtaaacctg

SEQ ID NO: 147 - protein, 1522 aa, Homo sapiens
MSVRLPQSIDRLSSLSSLGDSAPERKSPSHHRQPSDASETTGLVQRCVIIQKDQHGFGFTVSGDRIVLVQSVRPGGAAMKAGVKEGDRIIKVNGTMVTNSSHLEVVKLIKSGAYVALTLLGSSPSSMGISGLQQDPSPAGAPRITSVIPSPPPPPPLPPPQRITGPKPLQDPEVQKHATQILRNMLRQEEKELQDILPLYGDTSQRPSEGRLSLDSQEGDSGLDSGTERFPSLSESLMNRNSVLSDPGLDSPRTSPVIMARVAQHHRRQGSDAAVPSTGDQGVDQSPKPLIIGPEEDYDPGYFNNESDIIFQDLEKLKSRPAHLGVFLRYIFSQADPSPLLFYLCAEVYQQASPKDSRSLGKDIWNIFLEKNAPLRVKIPEMLQAEIDSRLRNSEDARGVLCEAQEAAMPEIQEQIHDYRTKRTLGLGSLYGENDLLDLDGDPLRERQVAEKQLAALGDILSKYEEDRSAPMDFALNTYMSHAGIRLREARPSNTAEKAQSAPDKDKWLPFFPKTKKSSNSKKEKDALEDKKRNPILKYIGKPKSSSQSTFHIPLSPVEVKPGNVRNIIQHFENNQQYDAPEPGTQRLSTGSFPEDLLESDSSRSEIRLGRSESLKGREEMKRSRKAENVPRSRSDVDMDAAAEATRLHQSASSSTSSLSTRSLENPTPPFTPKMGRRSIESPSLGFCTDTLLPHLLEDDLGQLSDLEPEPDAQNWQHTVGKDVVAGLTQREIDRQEVINELFVTEASHLRTLRVLDLIFYQRMKKENLMPREELARLFPNLPELIEIHNSWCEAMKKLREEGPIIKEISDLMLARFDGPAREELQQVAAQFCSYQSIALELIKTKQRKESRFQLFMQEAESHPQCRRLQLRDLIISEMQRLTKYPLLLESIIKHTEGGTSEHEKLCRARDQCREILKYVNEAVKQTENRHRLEGYQKRLDATALERASNPLAAEFKSLDLTTRKMIHEGPLTWRISKDKTLDLHVLLLEDLLVLLQKQDEKLLLKCHSKTAVGSSDSKQTFSPVLKLNAVLIRSVATDKRAFFIICTSKLGPPQIYELVALTSSDKNTWMELLEEAVRNATRHPGAAPMPVHPPPPGPREPAQQGPTPSRVELDDSDVFHGEPEPEELPGGTGSQQRVQGKHQVLLEDPEQEGSAEEEELGVLPCPSTSLDGENRGIRTRNPIHLAFPGPLFMEGLADSALEDVENLRHLILWSLLPGHTMETQAAQEPEDDLTPTPSVISVTSHPWDPGSPGQAPPGGEGDNTQLAGLEGERPEQEDMGLCSLEHLPPRTRNSGIWESPELDRNLAEDASSTEAAGGYKVVRKAEVAGSKVVPALPESGQSEPGPPEVEGGTKATGNCFYVSMPSGPPDSSTDHSEAPMSPPQPDSLPAGQTEPQPQLQGGNDDPRRPSRSPPSLALRDVGMIFHTIEQLTLKLNRLKDMELAHRELLKSLGGESSGGTTPVGSFHTEAARWTDGSLSPPAKEPLASDSRNSHELGPCPEDGSDAPLEDSTADAAASPGP

SEQ ID NO: 148 - DNA, 181561 bp, Homo sapiens
gaattccagtcccaaaagagtggagggatcttggtaaacaccagcgacattacagcaatagaaaagccatgacctagtagtaacggcaaaattaaaaactattatacctagaaaaggataaaaaaacttcaaaagaataaaagcaatgggtggtactctaactacctgtcagaagtaaatatagccctttttggagaaatgtaatatctatcaaagtctctacaatttgtaatccatgatacaataaaaaattacgagacagaataaaaatcagaatgaattactagaaaacaggagaaaaatcagatcagagaaaaagactgacaagtgcttcagatattgtagttatcaaagagggactttaactgtaatatatttaaaaacaaaaaataataataaaatagatgaaaagatgaagatgtccttattctcttacagccttagaaaaactaaaattgagggataaaaattgtgtgggcattccttaactgaaaaatacagtaggtggtaataagaacttatttgataatatttaacagcagacagagcatagcagaaaacaggactagtcaataggaagacaggatggtagcaaaagtccgaactcaaactcaataaaaaaaaaaaaggtaaaaacagaagataagagatatatccgaaactgtcaaaaggtctagcaaatttataagtcccacaaagagaaaggagagaaaaataagataagcaatatttgaagagataaacaattatagttttttcaaagttgattaaagatatcactcacaaatacaagagtataccaatccttctcagactcttccaaaaaaattgaagaggaggaaatacttccaaactcatttcatgaggtcaacattaccctgatcatgaagtcagtcaaggacactacaaaaaaaaagaaaattacaggccaatatcactgttgaaactagatgcaaaaattctcaacaaaatgctagcaaaccaaattcaacagcacattaaaaggatcattcggcccagtgtagtggctcacgcctgtaatcccagcactttgggaggccaaggcaggtggatcacctgaggtcaggggtgcaagaccaacctggccaacatggtgacaccccgtctctactaaaaatacagaaaattagccagaaatggtggcaggcacctgtaatcccagctactcgggaggctgaagtaagagaatcgcttgaacccgggaggtggaggttgcagggtgccaagatagcgccattgcactccaacctgggtaacaagagtgaaaccatgtctcaaaaaaaaaaaaaaagaaaaaaaaagatcattcatcataataagtgggatttatccttgggatgcaagcatagtataacatgtgaaaatcaataattgtgatataccacattaataaaatgaagggcaaaactatatgctcatattaatggatacagaaaaagcattttacaaaattcaacattctgtaatttaaaaaaacctcttaaccaactaggtatagaaggaatgtacctcaccacagcaaagaccatatataaaaaacctagagctaactccatgctcaatggtgaaacattgaaagcttttcatctaagatcaggaacaaaacaaggatgcccatttcaccacttctatccaatatggaagtcctagccagagcaattagggaagaaaaaagaaataaaaagaatccaaactggaaaataagaaattaaattgtcacggtttgcccacaatgtgaacttatatatagaaaaccttaaagatgccaccaaaaaatgatcagaacaaataaaagaattcagtaaattttcagaatacaaaaatcagtagcatttccatacactaacaacaaattatcctataaagaaatcaagaaaacactcccatttacaatagctacaaaaaatacttgataataaatgttatcaaggagatgaaagatttctatactgatatctataaaatgctgatgaaggaaattggaaaagacacaaataaatggaaagatagcttgtgttcatggattgaaaaaatcatatttttaaaatgtccacactacccaaagtgatctacagattcaacgaaaaccctatcaaaattcccatgtcatttttcacagaaaaatgactgtatacctagaaaaccctaaagactcatccaaaaagcttctagatttgataaatgaattccattaagtttcaggatacaaaaccaatgtacacaaattagtactgctatacagcaagagtgaccaagctgagaatcaaatcaaaacctcaatccctccgacaacagctgcaaaataaaataaaatacttagcaatatacctagacaaggaggtgaaagatctctacaaggaaaaccacaaaacactgctgaaagaaatcatagatgaaacaaacaaatggaaacacatcccatgttcatggataggtagaatcaatattgtgaaaatgaccatactgacaaaagcaatctacatcaatgcaattcccatcaaaataccatcatcattcttcgcagaactagaaaaaaataaccctaaaatttatatggcaccaaaaaagagtccacatagcaaaagcaagactaagcaaaaagaacaaatctggaggcatcacattacctgacttcaaattatgctacaaagctatagttaccaaaacagcatggttctgatataaaaataggcatgtagaccagtggaatagaatagagaacactgaaagaaagtctaatgcttacagttcaattggatcttcaacaaaacaagcaaaaacaaagtggggaaaggacaccccatgcaacaaatggtgctgggataatcggcaagccacatgtagaagaataaaaccagatcctcatctctcaccttatacaaaaaccaacccaacaggaatcaaagacttaaatctaagacctgaaaccataaaaattctacaagataacatcagaaaaacaattctagacgttggcttaggcaaagagttcataaccaagaacccaaaagcaaatgtaacaaaaacaaaaataaatagatgagaagtaactaaactaaaaggcttctgcacagcaaaagaaatagcagagtaaaaagacaatccacagagtgggagaaaatatttgcaacctatgcatctgacaaatgactgatatccagaatctatgaggaactcaaacaaatcagcaagaaaaaaacaaagaatcccatcaaaaagtgggcaaaggatataaatagacaattctcaaaagaagatatacaaatggccaatgaacatgaaaatatgctcaacatcactaatgatcatggaaatgaaaattaagtccacaatgagaccatcttacacctgcaagaatggccataattaaaagtcaaaaaataatagatgttggcaagtatgcactgaaaagggaattcttttatactgctggtgtgaatgtaaactattacaaccactgtggaaaaatgtgtggagattcattagggaattaaaagtagaactaccatttgctccagcaatcccactactgggtatctactgagaggaaaataagtcattacatgagaaagatgtttgcacacacatttatagcagtacaatttgcaattccaaaaatatggaaccagcctaaatgcccatcagccatcaagtggataaagaaaatgtggtatatatacaccatggaatgctatcagtcataaaaaggaatgaaataatggcattcacagcaacctgaatggggtgggaaccattattctaactgaagtaactcaggaatggaaaaccaaatattgtatgttctcactcataagtgggagctaggccatgaggacacaaagactaagaatgatacaaaggactttggggactcaaggggaagggtggaaggggaatgagggatagaagactacacactgggtacagtgtacattgctcaggtgatagctgcaccaaaatctcagaagtcaccactaaagaacttattcatgtaaccataaaccacttgttccccaaaaactagtgaaataaaaattttaaaaattaacatataagatacctagaaaaagcatacattttaaaagtacttactacacaaagtaaataaatttttgaaaccaatctgctttgttctcacaagaaaataaaaatagcctgaaataaggatctgaaatataagtcagactaatactgagatgccagctattgaatttaggattccttaaaaatatcttaccaaaattaacaccgaaggaaacagaaagagtaggcaacccttttattaaaaaaccagaaatatgtcaggcacagtggctcaagcctgtaatcctagagccctgataggctgaggcagttggatcacttgagcccaagagcttgaagctgcagtgagccatgatcacaccgctacacttcagcctgggtgacagagccagttcctgattgaaaaaagaactaacagtcttcccacaaaaggaagacaaaccattttacaggcaaattccaccacaatttcaagcatatcattctaatcttatataaattttttcaaaggataggaaaagaggaaataatccccaactcattctgagttcagcacaattttaatacaaatactagacaaagaaagagagaaaactattcttagaccttgtcactcatggatttagatacagaaattctaaattaagtattagcagctgaataaaaatgcataaaaaagataatactgcaagaccgaactgagtttgttccaggaatgcaaaaaaggcttaatagaaaatattaaacatcatttgccaatcaacatattaaaaacatttaatcatgtcaacaggagtagaaaatgtgtttgataaaattcagtattcatccatgataaaaaaagaaaaaacatttagtaaactagaaatatcattaaacttccttagcctgataatggtatattcaaagtacctaaggcaaacctcaatttcttttttttattattatactttaagttctggggtacatgtgcacaatgcacaggtttgttacataggtatacatgtgccatgttgggcaaacctcaatttaaatgggaaagccatagacacactctctttaaaatctgaactaagactatttgcattaagaattgtctaaaagttttcttcagttcattaggacaagaaaaaaagacattaaaggcagaaagattggaaaggaaaagacaaaacattttatgatctgcatatttgtttatacaaaatgtaaataatctatggacagattatttaaaataataaggaaacctaacaatgtggccttatataaactcagtatgtaaaaatcaactgcatttctacacattagcaataaacaagaaaatggaacttttaaaaaaaatatctttacaacaacaaaaataaaaggaacctagacataagtgtaataaaagatgtacaaaatgtgtacacagaaatttatgaaactataaaggcattaaagaagatataaataagtaaaaagatttcctatactcaaggatacaacttactgatataaatatgccatgtcttcccaaatctatctagagatgcactgtaactgcaaatcaaaatcccaaaagtttttttggcatttaagcagattctaaagtgtgtatagaagattaaatgattaaaaattgcctagacactctcaaagaaaaactaaagggcttaccctaccagatatcgatacttagtataacattacagtggcagggacagacaatttgatcaaggaaacataatagagattctagaaagaggattatctatagatatacagttgacccttgaacaacatgggtttgaattgcatgggtccacttacgccaagatcttcttccacctctgccaccccaagatagcaagaccaacccttctcttcctcagcctacacaacgtgaaggcaatgagtacgaagacctctaaatgatccatttacacctaatttatagaaaatatatttcctcttccttatgactttctcaataacattttcttttctctagcttactttattgtaagaatatagtatatgatacttattgtaagaatatagtatatgatacacacaaaatatgtgttaattgactacgttattggtaaggctttgggtcaaaagtaagctattagtagttaactttttggaaagtcaaaagttatacaccgattttcgactgcaccttttgttcaaaggtgaattgtacttagtaatatgatgaaggtggcatggcagatcatggtgaaagtgagacttttcagtattgcggctgggaaagttgttatccacatggaataaaatgaaatagcatgctacattactgtctattgagatggattgtgtatttatttatttgtttgtttgtttgtttgttacttactgagacaaggtctcacgctgttgcctgggctggagtacagtggtgtgatctcagcccactgcaagctccgcctcctggattcaaatgattcttgtgcctcagtctcctgagtagctgggtctgcaggtgtgcaccaccacacctggctaatttttgtattttagtagagacacggcttcaccatgttggccaggctgttctcttggcctcaagtgatccgcccacctctggattgtgtatttacatgttaaatgttgagtgcaaaactttaaaatttttaggagaaaattaaaagaaatatctttataatcctagtgtatagaaggatctcttatgcaaggcacaaagagcactaaaccgcaacattttaaatgatagttttgcctacattaaaatttaaaactactacttatgagagtataccttaagaaaagagaaaatgcaagccaccagcttggagaaaacatttggtagtcgttaatacctatgactaaaagaggattttattctagaatctctaaattactcctataaatcaataagaaaaagacaaagcttattagaaaaatggtcaaagacaaaatagacactgcacagaagatgaaatatatatggccagtaagtatatggagagatgctcaacccaatcaataaccagggaaatgcacatcacaaagacataccattttatacacatttgattgagaagaaggaggtcaagagaaggacaaccataaataagaaaaatttgacaactggagaagatgtggcatttctaatatattgctgatgggagtaacatgacctatctactttcaaaacaatttggcattatcttattacttgaatattcacacacctcctgagccaacaattctactcctacttaggcacccaggagaaaatcttgcacatatgcactagaagaccgactaagaatgttcaaggtaacactgttcatgtcacagaaagcaggaaataactcaattgcccatcatcaacaacaacaacaaaaacagatagatcaatcagagatcctgagtactgatggcgtttcttcagtaactgaacatagctatgcctgaaggtgggcctcaatctagactgctcagtgacatgatatatatgctttctttttttgtttgtttaaactaaactgacttgggttgctcttactttcaagtaaacgagtttgtattgcaccaagaaaattctaacccaaatataaagaaataggatttgacagattcaatgacttaaaacaccaaagaattctcataaacacaagaatgtgctttcagagcaaatttcaagactgagctggtttgaagagaaagaggtttgactacagtcacactaacaaatccgaagaagccagaatgaaattacctggacagtgatgtctctgccgttgccattccaaaagaggccaactgtggggagcaggtaatgacgtatttatttgagagatcacctcttcatatgaactggaaaattcttaaaaacaaaaatatcacattcttaatttcgcagaagggagaccccaactaactaatgcatagtattatatattaaaagtctacttgtaactgattctgttttccaaaaaaaaattaatgttagatattgtggttagattcttaggtcagatacaaattgcaaaattaacttttgatgccactgacacactatatttcaaatgaaaattaacagtaaaaatgcattaatagtaatttaatacattaccatataattgggtttatttttaaagcagttaaaatgagacgtgatggctagtgaaggaaagctgacttttgtgcagattctgaggaagaagcttacattttcagacattttataagctgctagtactggtccaattgctagtactggtccaatttcatttgaggctttcttttcccaaacgcagagaaaataccagcattattccttccttactagtacaaattagggctactacttggctcacaaatgtgagaagaaaaaggaagcggttttataggaaataaatagaaagggacgccaggcatggtggctcacgcctgtaatcccagcactttgggaggccgaggcgggtgaattgcctgaggtcaagagttcgagaccagcctggccaacatggtgaaactccgtctctactaaaaatacaaaaatttagctgggcgtggtggcgggcacctgtaatcccagctactcggaaggctgaggcaggagaatcgcttgaatccaggaggcggaggttgcagtaagccgagatcctgccattgcactccagcctgggtgacagagcaagactccgtctcaaaataaataaataaataaataaataaataaataaataaataaatagaaaggggacaagaagcatgaaggagcaagtaagtaaaagaggcaaatgttcctgaaagaaagcaatggttacttactgaaatagagctcagaaacaaaaaggaaaaggattaaacggggtttccttcaaaactagtatagacgtggtagggaagaaacttccaggtttaattgggtttttgcaccaggtagggctactaaaagtagatgatgtgcttattttatgaaatatctatcttcttctaagggtatagaagaaaacaagaggcagggaactttttttttttttttttttttttgagatggagtctcgctctgttgcccaggctggagtgcagtggcgcaatctccgcccactgcaacctccgccacctggcttcaaccgattctcctgcctcagcctcctgagtagctgggactacaggcacgtgccatcacacccagctaattttttgtatttttagtagagacggggtttcaccatcttagccagggatggtctctatctcctgacctcgtgatccgcccgccttggcctcccaaagtgctgggaatacaggcgtgagccaccgcgcctggccgaggcagggaactattgattgtatccaccagggattaatagtttaggtgctgaaatttgaggactattgatcttgccccaaatcccatagagaaaacctccctgccacccaagccaaatgcattcctgttgcgaatcccccgctctcaacttggttcagcctccaccatgaactggatccattccttcctggtcaactgcatcacacggttatctttcacatgccaggaatcaggctctttagcaaacactgcacagcagaagcgctccactctgagtgcacagacatatccacaaagacttcctttatcatatactccaaggaatttgcatgaataatttatcttcttcttctccatacagaagtgatgcacaggcatcttcctaatggacttttcgatttctctttctaagtcatcgaggtcactcatctctgctttaaagccaattatttctttatcttcatttaaaccaatgaacaaatatcctccatcagtatttgcaaatgcagaaacatattgagggagaatctctttaattcgttgtaacaacttttctgtcgagaagtttttaatttcaacatgtgtggattcagtaaaggtcaatttttctttccgatcaagttctgttctatcaaaaaaaaccccggccaaggccttcatgttattttcttcttgtatatcaacacggggcctctttgccagcaattctggtcttaaatacaatctccctctagtctttttcatgtctttgaggaactccagtgcagcagtggcattcatgacttttgcagatgttatatctcttttgtacaaattggagctcaaggtggtaatccgcagaccagaggtgttcaagctccatgacttcacaaaaatcagaaagtagttaccattctgcatgaagtctaagtactcaggaacaaataacagaatgttactaaaagaattttccaaatctagtcctattccatcttttgtataactatagtcttcattctcaatttcagccttgatcactccccctccagaattgagcagagcacacatagctcgtgagaccctttcattctgcttttttctcagtttacaatccttcatttttttcctactgttctctccaagagtgactcttcccacatctagaaccaactcggcataattcgtttccaaatcaacactgatgttcattttcccagcagctatgcagtgtccaagcagaaattcttttctgtaaaatagacagagccattagaataggacctgaactagaaagatagcaaattctgtattatgaggcaaatgcaaaaaaatcctgtgctgtatatattctactagactggtaagtatatggatatgaagagactggcaaattttgagctaagaccgcaataatttatactcctactgaattttcaaatttgttactatagttctatataatgtattctaattatgtaatctctttatccgccttttttctcctttctagtccctaatattgtacaacctgttttctctctccttttcttaaacaacccctggagtgagtctatgtttttatcttctcagtgaaccaggctttagttatacatattatttctacttttctttttattttaataatttcagcttttaccttaattatctccatttatgggtataaatcttttggaagatttcccgttaaggtctaatgacatccaacatgtcatgttaattatttttccttcttataagaatgaaatagatttataaattttggccattgatcttaagcaaagtgggctaagtcattgtgccctttttaaatctaatatccacatattttcaataaggaaaattcttatatacaaaacacctgtgctatggtttgaatgtttgtgttcccccaaaattcatatgttgaaattataactcctgaggtgatgaggtttttgggaagtgatcaggttatgagggtgaagccctcatgaatgagattagtactctcctaaaagggaccccggaacactagctcatcccttccactatgtgagaacacagcaataagtaggcagtctgcgacaggaaaagggccctcaccagaatccaacagtgctggcaccttaatcttaaacttcccagcctccagaactgtgagtcataaatttctgttatttgtaagccacccagcttgcggtattttgttatggcggcctaaacaaactaagacattgtgctttagtctatgtatccctaatccattagctctgttcccttaaaatctattaggatcactgctttgctctaaatggaaacttttaagttaagaagtgtaacttaagtttaacttttttttaagtgtaacttaagtgtaactttttaagttaagaagtgtgacttaagtttaactatttttaaatgtaacaagtgtaacttttaagttaagaagtgtgacttaagtttaacttttttttaaagtgtaatttaagtgtaacttttaagttaagaagtgtgacaagtttaactttttaaaaaaagtgtaatttatgtgtaacttttaagttaagaagtatgacttaagtttaacttttttaaaagtggaatttaagtgtaacttttaagttaagaagtgtgacttaagtttaacttttaagtgtaacttaagtgtaacttttaagttaagttaataagtgtaacttaagaagtgtaggttttccgagtggcatagagacaattgagaataaagtccatcataggtagtaattgctatactagaaaaggaatgtaaagggggtcagaatattcctgtccacagctggaccaatatcatgcagatactcagctaaggttgtggataccacctgtgtccatataaattcctgatcacatgtaaacaatgttaacattagagccccaaaccatttggacagttggggttgaatcctttagttctttgtccatgttttctcttagctctttgaagatacttaagacagtgcctgttttttattttattaatttataaataaaatcctatatattgatcatgtacaatgtgtttttttgaaacttgtatatattgtggaatggctatgttgagccaactaccatatacattacttcacatacttatcattttttgtggtgaacattgctactattttagcaactttcaagaatacaggcccagcacagtggctcatgcctataatccaagcagtttgggagactgaagtgggaggatcacttgaagccaagagttcaagaccagcctagacaacaaaacaagaccacatctctacagaaaagtaaaataaaataagaattggcttggcacagtggtttgtgcctatggtctcagctacttaaaaggctgaggtgggaggatcacttgaatccaggagtccaaggctgcagtaagcgatgatcatggcactgcactctagcttgggcaacagagaaagaccctgtctccaaataaataaatacataataaagaatacaacatattgttaactatagtaatcatattgtacaatagagctcttgaacttattcctcctatctaactgacattttgtaacctttaaccaacatttccccaaaccccatcttcccccagtaaccactattctactctatacttctatgagtttaactttgatagattctacaaataagtgaaatcatgcagtatttgtctgtctctacttggcttatttcacttaacataaagtcctccagattcatccatgttatcaaaaatgacaggatttccttctttttcttaaggctaattagtattttattatctatatgtaccactttttctttatccattcatctgttggtgaacacttaggttgcttccatatcttgcctattgtgaataatgctgcaatagacatgagagtacagatatctctttgatagactgatttcattccctctggatatttatccaggagtgaggttgctgaatcatatggtggttctttttcttttcttttcttttcttttttttttttttttttttttttttcagaaacctccatactattttccataatggctaagctagtttaaattcctaccaatagtgtgcaatggttctcttttctctacaccatctctttttatctcttgtcttttttataatagccattttaacatgtgtgaggtgatttctcattgtggttttaatttgcattttcctgatgattagtaatgttgagcattatttcatatatctgttgtccattagaatgtcttctcttgagaaatgtctattcagatcctttgcccattttttaatctgtttttttttcttactattgagttgtttgggtttcttatatattttggatattaacctcttatcagatgtatggtttacaaatgttttctttcattctgtagcctattcttttactctgttgattttttcctttactgtgcagaagctttttggtttgatgtaatcccatttgtctacatttgctttcattgcctgtccgccattgggatgacatccaaaacatcactgcccaggccaatgtcttggatctttttcatatattttcttctagtagttttataatttcagctattacatctaagtctttaatccatgttgagttgatttttgtatttggtgtgagatgagggtctaacttcattttctgcatgtggatatcaagaacgttattttaaaatctttgtctaatatgtctgatgtctggccttcctcagagatgtgttctgccaatttactttcttcttttgaataggtcatatttttctgttgtgtgtatgctttatgaatttttgttggaaatcggacatttgaaaaaacagcgatctctcacagtctttgcagacaaatgctatggcaaggcaaaccttcagtgatgggctaagtatactctgatcttagggatcagctcaaggaaaaagcttaaggtcttctcaggtcttttctgagcatttatcctgcctggattgagcggggctttcttgattcctctacatacatgcctgcttttgaatgtcttaatttcccaaagaatctcaccccagctcatcttctgagccttagatggttattctatgtctctagctataatctcttgcctaagacatctgggggtctatagtcttcttgcagctttcctgagcagtggctgtcacttctcctcacctgagatctgagttaggggatacagaaatgaatccttcaggcagtccccagacaggttacaacattgaaaataagttttactatgccccaccaattccagggaggaaactaggagcagtgatgctgcctcctcaagactaagaccttgccatgcagggcaaaaacttgggcaagggtgagtaaaaacaccatgaaatttcctacagttttgaatgctgcttttccttgattgggcattcatttagttgcaacagatctttgttgttagttcagccagttttgggttgcttttgatgtttccatggagaaacagagttgaagcttcctaatccactatttttctgacatcattcctgtcaccatttctttatattaaacgcaattcgataatatttttaagattttgcacccatgatgtccctttctcctattcttgttgacagacaatgcaatcaatagcttcacaaaatgagttgaggatgtgagctgtatttctattatttcacattttacccaacatgaggacctttttgcagtgggagagttggtcatggttggccatactgcccaaaacgaaaatatactatttgaatcttgcttttccatgtatcaatatagtatatacaacaagttttgcaaaaataataattagctattctttaaaaaccttattaactgcataatttcatacatggtattaatgtaccattatttaactattaccttacaactgaacattgaagttgctttcaatcattcgatataattatactagaatcttgactcagttatttcaatgtttgggtatgctaatcacacagtctaattttcattgagtctaagagtgccctggcaaagcacttcaattatatatacagatacggttcagatatatacaaagatggttaaatcgagtatgggaggccagaacatgtagacagaaaagaagccagatttcaggatataagaaatggaaccttgaaggggaaaaattatgtaagagaagaaagagtctgaatctgtggaaataaaggttcatggtgaaacataaggttatatttgaacctgtgccttaggtacataattaagctgaaattatgtaagtatatagagtgtatatatgtacacacagagagagacagaagtttgtaaaagttaaattactgtgtcaagtgacaaaaacttcaaagattttgatatatattatcaaatactttcccaaataattgtatcagaattatcgctagcaaatttatcttagtggtgattacagcactttgccttgaaccttttggggggaagaggatatggtataaaagctactagaaagcatcttagtggggattacagaactttggcctgtaccttttgcggggaagaggatgtggtctaaaagctgttagaaagcatcttagtggggattacagaacttttcccctgtaatttttgggggtaagaggatgtggtctaaaagctattagaaagcagcatctttccctcagtgtttcctgaaaactcagagagaacaaagagaggctgccttctaagagatattggacctagcattcattcaaataggctccctgggcctgggtccatagaagaaagcatttgcatatgacccagggagattccaaaaaaagagaacctaagtggggaggacctgactcctggtagttgaacaagagtgaagccaggtaagcacaatcattgaagtttaaatttaaaactcaatagtagtctcaatgtggcataattatgctagaaagcagaggaagatgtatatctctgccatgctgagctttctccttagtattatagcacaattagtgttctttagacccaatttcttcatatttcttgcacatgaggctgccccaaaggcaagtccaccttccctgttgaccagacagaagagattctccatctctacccacaaaggctgcaggagaatcagttccacttctacccaggcgcacagccccagccctacaattttctggtaatgcctcaccaagcagcctctgctctgctccccgattcttttttgcagcctctctaactagagtcttgtcccctttcctcttagcccacctttctgcactgtctacatcaggctgggctctgtgtaaacttttttgcctaacccaccatacacagaaggggacagaaatcacatctcaccctcagattgattaaggagggtgctcataccactgagaaacttggaacccatgggagctgcagttgagccaccttatagaggacccagcacttgtgaactagcctgggatcccggtcaccccagtccaacatctgcagctgtgtaaaactttccatagttgaaaatcactgccttcaagcatacatctgggacaaaacccttaaaaaatgagctggggattgagcttaccaaatccctagggcctaaaacttactggcctcccttaaaccttgggtctaggtttacaggttagatgtttccactgaaatcctttatacttttgactataggggaaattctatcagacctgaactcactatttaggctttgttgttggctatctttaatgggaaaggagacggcattcagatctccttagagttatgtcagaacagcaggttagtaggaactgcccacagggtgggacagaagttgtaagagctacctcctgggaaacaaaaatcatgcaacactctttgccctcctaggaggtcactttgcatttagttcaggacagcactgctctcatccttcccgccttctagataataaaccagcagggcatgagggtgcttggtttttcttttaggatctagcaatgcagttcatcagtgcctggtcgcatttcacctaaagaacctattccccaactccctgcatgttcaggactccaggaggatggataaccctgggaggtctggacacccaccaagcctggcctgaccatagagcactctgccctccctgcctctctagctctgcttgaacactgcagatccctggctcactggccccacagctctttaaattttctggtaatgctttaaattttctgggctgctccccagcccatgcaggagcaaaagttccacccgacctatagcttccaagtccaccattctgaagtcctcaacagcctgcagtttattagaagttgctacagagacaggaaagtgttaccggtggagggtgtcctgctcactgaaacattctgtttgcaggagaaaaacaaaaacttggtctgttctaggatctatgtgtttccttaaagtcttagaatgagcaactccattttggtttggtttggtctgttggggccatgagctcagtccaaaacactggcctttcacaattttgttttctaaaattccccctttttgttcaggttctcacttaggtgagaatgtaaccaaaacgtaaggccttagcgccgctctcagttaccatcattttggctttccagtctcagcacaccatccataggttacagtgtcctcatggtcgcatatttgtttcacttctcatcattccagttgaagagagaccatttgacattctagagatggctgcatgcaaacatcgaaaacctttgagagaatacagtgcaccagggagcctattattatgatgactattgggaggataataccaagagtttggaggatgctccttgcccagggttcccataaaccaaaccagttaaaattaaatagatcaaataatgaactaaataaagaatctaccaacttaagtaaacaatctcctcattaatcccctacaactgaatctcttaatcttcatttaatgtatttctccatagactctaagtgccagcagctgcacagatacttctctgttcagccaattctatcataactttcacaaaagaatttaaagtctgttgtgtaactatggcctttacagtagatgttctgagaacatctatcctatgggttctaggttgtgaaggggttgattgttctcagtgaaccataaaaagctttctttacctggtgaaaatacactgtagcataatcatgggaaaagcttttatacaacaagaaaacatgcattgaaagtgacattgaataaaatccctttgtaaatgtttaaatggcccatcgggtagccaaatgtacctgaagctttgattgtcttcccaggaatatggatttgagaaaccaaacattggttataaacaactttagcaatttataagtcagcggtttccatggcagtttgatttttaaaggtcaaacttcctcgcacttcaaagaacgctgaggccaaacagcaccaaaggagaacatcacactttaacccgacacaaccctgcttagaacagcagcacaagagcctgcatacatgcaactccatcccactttaccattcaacagcaaactccagattccaaacaatattgaggccaaacactactgcaaccggaagagaaaattctaaggagggcttagtactaggcctaagaacctctaccaaaggaacccccttggagaggctgaggtccaaaggatcctccagagcatccccctttagggtccaatcttagagcgtcagacgtctctgaccttaggtggtcaccagtgccactttacatgttttccctccagaggcgatggcctactgtgagctttccttttgtctctggatgaaggccttgacttctagcatccttataatttgataaggccatgctttcccatggttcccattccactagagtgatagtcatgaactttaatgatatgaaatggaggctaggtgggtttcttttaaccttagccagtagagtaggggaagggaagaatttaacataaggaaagaaggtttaagtcacctgaaacacgtgtgagttcgccctggagaagctgcgtcacacatagggatcagggaccacaaccagaaaagacagaaaagagcccttcccgcttctgggcagggcaactatccccattcactccttggccttcaacgcagcactggagagtagcccccggtcagaaacctgcagtcgcctccgtgtctaggcgctacccaccaaggatcccacgttggaaaggaaaagagaaagagagagatttacctgtatggagcagaaaggaaaagggaaaggagaaaaataaatcccagactttgggcttacctcctggttggcttgccaaaatatgttaccagtgaagagtgtccaggttcttggcgtgttgaacaaagaactggacaaacacacaaacaaagcaaggaaagaatgaagcaacaaaagcagagatttattgaaaacgaaagtgcactccacagggtgggagcaggcccgaggatagcggctcaagagcccggtttcagaattttctggggtttaagtaccctctaaagttttcccactggttacttggtgtgcacacaatgtaaatgaaataggagcccgagatcagtctgaatggttgcagaaagcgatcaatgggaggctgaagtgaagttacaaagttatgccctatgaaaacatctgattggacgcagaaagcgaagttacaaagttacattcctatgcacatgaagacttggccctggagaccagtctgattggttgcgggaggggaccaatcagaggtattttcagtttttcagctgccatgtagaaaaggaggggctacaaaggaagtttgtggaaagttgggattttcctccagacccttattctcctgcttcagaagggagagaaagcagaccgggatgggggtgcggggatcttcccgggagtggtggggttgtgttaccagtgccccacctcctcccgagccagcagactccccagaaatgaaaaactaaggctggaaggtttagcgatggagcaggaccaacttaccagctcgcggtgctccctagaagctggattcttcgcaggtgcgagcacaccccagatgccagcgtggacccttgagcaactggaagttaaaaacccacgaaaacagctctgagtgatctctagggagctctcgtttctttttcacccatgtgtattttctaagacaaaaagaaaaaaggtaatttaaagaaaacaaagaacaaaggaacttggcgaggcccaggctacagtccgcgggctcactctccacagagtaaaaagaacgcgaatccttttctgttttccggtcctccccatcctgggctgcggctccacacttccccagcgtggcctgcatttctattgggcagttggcgctccggaagtgtccgcactctttattatcgactctgcgcctttgggcaattgtcactattttggttcatcaaaattgaagaaataccaggcattcttaccatgcccctaaaggggtgactcaacctttccagctgtactcgcattcccagagcagcactgctgcccccttgcttaaaagcacggttgcccccaggaaccaggccagggcagctgtggatggacaggagaggacaaaggtgcaaggagcggattgctccaggacagacagattcaaatacctacccctggcagtgtagggagcatcttggggccatttgggagattcctttattgggatgctccaaaggctagtctggccggatacagtcgtcctgccactttgctttcctttagcccccttattatgataattatggtaatacatgtttttcctgctaacttgtctaagaattggtgtctcagtacatagcttttgaaatgcacacaggccacgatgactcatcacaggggaatgtgcaagtctgagttgctccttctccgcaagctccacctaccccactctggactgcattaactgcctactgcctattctaaaatcttaaggtacctaggaagagtacctattcacattaaataacgtatatattgaaagcacatagctgcgcttttcttcttctcatctgatccagacgccagctctatggatacagtctcaccgaagttaaaaaactattcttcagtcattggcttagaaaatgctagtgccggctgggagcagtggctcatgcccataattccaggactttgggaggccgaggtgggtggatcacctgaagtcaagagttcgagaccagcccagccaacgtagtgaaacccccgtctccactaaaaatacaaaaaaaattagccgggcgtggtggcagacccctgtaatcccagctactagggaggcagaggcaggagaatcagttgaacctgggaagcggaggttgcagtgtgctgagatcatgccactgcactgcagcctgggcaacaagagcaaaactctgtctcggggaaaaaaaaggaaagaagaaagaaagaaagaaagaaagaaagagagagagagagaaaggaaggaaggaaggaaggaaggaaggaaggaaggaagaaagagaaagaaagaaagaaagaaagaaagaggaaggaaggaaggaaggaaggaaggaaaggaaggaaggaaggaaggaaaggaaggaaggaaggaagggagagaagagagaaaggaagggagggagggagggaaagaaagaaagaaagaagagagagagagagaaagaaaaagaaagaaagaaagagaaagaaacaaagaaaaaaagctagcgcaggccgggtgcggtggctcacgtctataatcccagcactttgggaggccgaagtgggtggattgcctgagctcaggagttggagaccagccagggcaatatggtgagagggcatagtcgtgcgcgccttggtagtcccaactactgtggtggactggggagggtgtgggggcgctgaggcatgagaatcgcttggatggaggcagaggttgcagtgagccaagatcacacggctgcactccatcctgaaagacagagcaagggattctatctcaaaaaaagaaaaagaaaaaaaagaaaagaaaagaaaaagaaaatgctagtgcagggattttcccagagcaccaggatggcttccaaggcagaaacaaaagagattaagaagttgttcccatgggaatgtgtgtggcaggcatgacatatcagatcaacttggaatagaaaatgcatatcccaaaaggcccctcaaaagtgagcagagtaaaaacattcacagaacttttaaattatgtttttattaactattgagtagaaacaatatttatagaatacatataaggtataaagaacaaaagtatgaacatctgtgaaccccttacacggctaaagaatattaacaataagcctctcctcagaggtaaaacaccatatcaaagtttacattgaaccttgtgttgctattctttatagtgttttgcggggagggggttggggggttgttctggttgtttttagcccactgcagccttcacctcctgggctccagtgatcctctcacctcagcctcccagtagctgggactacaggcacacaccaccaaacccagctaatttttaaattttatttcattttattttattttttgtagagccaggatcttgctatgttgccaaggcttgtctctaacccctgggctcaagtgattctcctgccttggcctctggaagtgctgagattacaggtgtgagccaccatgctggcttgctgtttgttcatgctgtaaattccctttgttgatttccaaaagtgtttttatacttctaagttgctgagagtccttattatgaatggatgttgaactttatcaaaagctttttcctctattcagatgatcatgtgatttttctcttttgaactcttaatctgtggtgaattacactgattaatttttttttcttggagacagggtctcaaactggcacccaggctagagtgcggtgatgcagtcacagctcagtgcagactcaaacttctggcctgaaggatctttcctccttcagcctccagaaagtctgggattacaggagtgagccacctcactgggcctgatgattgattttttaacgccaaaatcaacgttgaattcctgacttgaaccaccttggtcgtggtgtattatcacttttacaaattgttggattttgtttgctaaaattttgtttagaatttttcatgtagatatttgagtgataattgagtgacctgcaattttcctttcatactttacctatcagacttgttatcaagattatgccagcctcatgaaattagttaggaactgtttcctctttctaggaaagcatttgaataagactgaaattctctaggactgaaattctctcctccttaaacttgcttgttagaacctgctgtgacaatggttacagaatttctgctttgatccacgagttaaacacttttttaattccaaaagatatgaacatttttctagttaccgttttattactagtttataatgtatttgcatgtggggtcaaagaatgtgatcagtatcagttctctgaactctttgaataattactttttaattagaaaaaaatctcaaatattatgcgttcagaagcaaaaacaccccccctccacacacacacacacacacactttattaattacaaaaagcaaattgtaactgcacagtagggaaacctggcagacgccactttatccaaatgatcagagttaacatcatcaggaatggaactaatcactatcaagtgccttctaataccgtgaactgagaaccgtaacagcccttctatggaattcatgccaaaaatgcataacctgaatctaatcatgagaacacatgaaatgacccaaaatcagatactctgcaaaataataggccagtcctcttcaatagtgtcaaagatatgacaaagacagattaacatctccagattaaatgagacttaaaagaaaggaaagctcaatacaatgcatgatcttagatcaaatcctggaccagaactttttctcttttgagaaaaaaacataaagacacttgaggcacaactgatataattcaataaagtctacagattagataatagtatcagggttaatttactgattttgatgatggtactataaatgtccttttaggaaacacccactgaagtatttagtggtaaatgggaaccctgtccgctacttacttttgaatctcaggaagaaaaatggtagaaggaggcacagggacaaggcgagagaaggccatcaggatcatctgtggtcaaaggactctgggcacactgacatttaataactaattttaaacttttgattgttttattattattttgttagacatggggtcttattctgttgcccaggctaggattcagtgacacgattatcgctaactacagccttgaactcctggaatcaagcgatcctctcgcctcggcctctggaatagctaggactgcaggagcacaccaccacacccagataattttttgttgtcttctcgaggggggggtcatgctatgctgcccaggctggcctcatatgatcctcccacctcagcctcctgctaatatataatttaaatatttgtctttcactatgctcaaggctttactaagttttgttaaaagtagggccaggtgttgactgttaattcgtgaaacaaaagatgtgaccgctttccatgcttgagattcagagcagaagaagtttaggaaagtcattatgtcaagccaactagaaactagcagagaccttggtacagcactccatagcaagaagtggcaggagactacaaggacagatctgtgagcattcctggaattctcagaaatcttaaaggaaataagctaggtttaaaaaaattttaaaaaggagggcactaagtggggtatataggaactttctgtactatgcttgcaacttttctatatgtctgaactaaaataaaaggctaatttaaattttcaaaacattttgtttcattttacaatggctggatagattttcagatctttaatgaagcaggtcctatatgactagagccaaattacagagataggcaggtacccatcaaaacccaattaagcctgacacagtggctcatgcctataatcccagcaatgggaggctaaggcaagaggatcacttgagcccaggagttcagggctctagtgaactatgatcacaccactaccctccagcctgggaaacacagtgagaccttttctctttaaaaaaaaaaaaaaaaaaaatttacagttaatcttgcttaatcttttactggctcatttttggctgtatcatggagttgctggcctcagtcttctccttttcctccatttaatcatttattttacagaaccttttttttcagtttaatgaaacacaaactctcaattttttatttaaaacagaaatgcaataaatatataagctaaacatttcctcatcatatggaaaaagaagaaagcatcagtaatcctctttgggctgaacaaaaattcataaatatttatatattttaaaatatgatactgtttcaaatattactagggcaataaatcatatagagagattcaaccagtcagaattagacttttaaagaattactctcaaaggctgaaataactccaaagaccagggagtttactaagaacatttacaaagatagctttttggtgctgagctgtatctcatttaatgcagccagaaagaaagaagaaatatttttctccttattttgctgatctgtcagattttgctcaagttagaagagcctacaatttcaaggctagacaactggaattccatgagttaacacaaataggagaaagactggcagaaaagttcaaaacttacaatatggagggaaatcagccaaataggattacttataaatggaatattgggcatgtggtttcttaattttcattagttatgcaaatattttattgttagtatttagattagtgttttagaatgttttgtagagactgaaaagcaaataagtaattgcattagcattgttaagtatcagtgtttttagtttgatgaatgatcatacagctgtgttctcaggctgcaataacaaaacactagagactggatggctgaaccaacagaaatttatttctcacagtctgggggctggaagtcgaagacataggtgccagcagggtgggggggggggttcattgtgaggcttctcctcttggcttgtaggtggctgccatctctctgtgtgctcccatgccctcttgtttgtgtgcacagggaggaagggaacaagctctctggggtctctccctataaggacaccagtcttagcagatcagattctccactgtgacttcgtgtaaccttaattacttccttagcagccccagctccacagtgaaggttggggcttcaacatgggaatttaggggtgaggatgggacacaaacattcagtccataacaatggcccaccaaactatgaaagcaaatagaaaaaaaaatcacagttcaagaatgacataaaacttaagtagttatgctatagagtaatgcatacagctacgctgagatgttacaatgtaacaacataaactcactgcattttttttcttcttcttctttttgagacagtctcactctgttgcccaggctggagtacagtgacatgatctcagctcactgcaacctctgcctccaggattcaagtgattctcatgcttcagcctcccaagtagctgggatacaggcatgcaccaccatgccctgctaatttttgtatttttagtagagatggggtttctccatgttggccaggctggtcttgaactcctgacctcaggtgatccacctgcctcagcctcccaaacagctgggattacaggtgtgagccaccgtgcctggccaacgctcattgatttttaaagaaaatctttcccaagtttgttcaccgtacatctgatacacactttcagaaccagatttgggtttctaatattaacttctactgaaagccagcattttctcttggcctataatttctctgtaaaggtaccattaatgttcactattacaattaagccttggtctgggttattctgataacaaactctggagatcacaattttaaggattaaataatcataacaatattgtttgttctgccgaaatgattaatctgacagtgactgaattatcttgggactctcccaagccctaaatgaatacagcaaagataaattcaggaaacaactgcttctcctatggcctgtaagctcctaacagaccatgcttctgcagaaaacaattctggacaaattttttaaagcaacaaactacacgaagtcacataaaagaactcgagaactccagccttggaagaaaggccacaggctgagtttcttatttttatggcttttacccagagagcaagacacaggtctgcattgtgcagcacagctaaagttcctttagaaaaccaccatctttctggctgcaagagtcaggggtcagaatggggggcagccaccactgctgaaaagagttgggggaggaacccctgaaaggagagccagaaatgggggagctccaaactctttgtgtcagctctgtccaaatctctaactgacttgtgaactaaaaagaaaggtttctaccatcagcagactgtcacccatagacatttacacagtattttggtttggagttcttcctaatagtcacttcacagaaaaatatataggtgctgttttgccctggaagccagacagatcagaatattgggtaagatagctgggtcagctgtccttggatggatcccaaacactatgctcctttccaggcctgagaatcgccggacactgtccaacacaatgtgcacacccaacatatcacatgcatcactgagctgcaccaccattttcttcctcattgctttcaagagcttagactgatactgctccacttctgtcacggtgctgacaagcacagcaacatcctttggagaatagcccctttcaaagaagcacctgcaggtgtctgccacataggtcactatttgctccaaagtaaagtttttaataatctttgtgttgcctggaacacctggaacccatttagcttcactgagaattgccagatacccatgggggatattaattggaggattttctataattagttgcatttcttgttgtatgtactcggctatttcatctgcattgcgaactactctggtgagctcttctcttggatactgtgctgagagagggggaaggccactgtgacccaagtgactggtctgaaagtagtccagaaagatccagagaactcctggacaatccttttctctctgagtgatggtttttgccttcctataccagtccccatcttcagtacggaaattctgagcttcgtcaatgacgatgtgttgaatgtgttcaaatttttctcttaggaaagtttcccgggtctctgctcggcagatatttctatcactgtaaaaattaaaagaatacactcaggttttctctaagaaaacaaggggagaaaatgattgtatcatgttcctccgagcacagtatattgccacagatcattttaccactcaattctcaaggaagaaggtgacttagcagaaaaaattaaacccagattaaataaaacttaaagacgtaagatccaactgcttacctgataaagttcctcagaggctggttttcacaaacgtagagaattctgtgtgcctcacagtgaaacacattcctgatcttctccatgatcttcatggccatgatggtcttccctgagccaggtaagccgtggacaaacaactctctgttcttgcggaggcttctggagaatatctcatactgctgggctgtgagcagatttaaaacctcacagccgagctggtcactcaagagagacctgaagccgagtaagacaatcacgagggactgcagcagggcttccatgtgctgggtgcctgcaaggctataggacgcagggtaatccatcggagacactgcagcctccaaggcctctgcgctgctctcaggactcaggcagaggaccttggccctgacacacaccttcccggtgtagccccccatgttcactagcttctgcttcaaagtaaaggcggtgcgagtgcagtagtcctggccctctgcatcctgctccctgagaatggtgtagagaatgggggtgctgttctgtgctatcagcagagcatcacagatgactcctggcttctcctgcaagttcaggtccacagcccagcttctagagaggatcacaattccctgggagaaaggtcgcatttgcttgtgtattaactcctttagtccttcatgctgtaaagacagctccttccagagggactctggagtacattccaaatgtcctggtggaactagacaggaagaaaatagaaagatgttttcactgtgtttatgtgattttgtatgaatcacatgttacatttaaaagacagaggaaagcccccaaagaattgtacaatttaacagaaattccttctggtgcatctctggttttttgtttgtttgtttgtctgtctgtctgtttttgagacggagtctcgctctgtcgcccaggctggagtgcagtggcccgatcttggctcactgcaagctctgcctcccaggttcaggccattctcctgcctcagcctcccaagtagctgggactacaggctcctgccaccacgcccggctatttttttgtatttttagtagagacagggtttccccatgttggccaggatggtctcgatctcctgacctcatgatctgcccgcctcggcctcccaaagtgctgggattacaggcatgagccaccacgccttgcctggtgcatatctctttaacccacaacctacaaatctggtaaaatgaatgatgtcacccttctatgtatctcatggacagtggagcatgtcaactgaaatgcaatttactgagcctgagaaagtgaaagccatgtattcaattactcttgcaccttggattcttaatgtggaatgtttaaaaacttttctgataagctaatgactataaagctctcaggtaagtaaagaaactatttggtggtaaacagacctaaggaaggcctaatatatgaattaccttgcccttcataaatgtttggacatacgtaggatatttgtgtatcatattcttttgtcaaatctcatacttaatatgttcaatgtatgaagttaagccatttccctccttgaaaaatctaggtttcattttgtaagtaggaactccgagaaaaaaaccttgctaaaaaatgtttgggcagcagggagaggggttacataacattgtctatgggcttgaattattatttggtgccacctttgaagcattagcgagtcgttccctctagcctcttccaaagagaaattatttgtggtttttctatattcttatattctaccaggtgaatgtttttattccttttacagacataattcctccatccttgaaaagtagaccagaagtggctagttattccattgttccccttgtagttgtactagatcactggtttccaaacccagcagggcatcagaataatttgggaagcttgcccaaatgcatatggctaggcctttcccctggaaattaagcgttcataagttcttggtgtgggcctggagatctgcatgtttaactaccttccatggcatttctaataatcagccagatgtggcaaccaatgggccagatgatttctaaaggcacctgaaactcatccccaagaggcttgtggcattgtcactgtgtacacctggatctgcaggacacaatctttcatggatttgttttccacgaaatgtattaaatgacttccttctctcctgatgtaaaaactggcagtcagtacctggaaataaatgttgttgtagatcagctttgtgttccagacctttcttagaatacactggtctgcaaagtgaaggactgtcagatagactcaactgagactcaaaggcctcagcaaagtctggaggaaactctgaaagaaagaacattttaatttacactatatgatttcatgtctcgctattggaataggctgtacaaggctgtgtctaaatttcatctaacatggtacaagtcaggccacaaagtcagatgctttaccctttcttgactctatgtccaggttcccaaagattcatcattaaaagccctttttctgatccttgaatggtgtttccccatgcaatataatgccccctcttccatgtttgaatagttctttgcttgaattgcagtggaaaaaaactctctttaagttataatcatcaggtttttatatccctgtgcacgcacctccactaacctcaacttaaacaaacctcaaccaacactagctcttgtctcccagagttgattttatgctaatctgaggtacaagctaatcactattatgaggctccaacagattccaattcaatggttttattaaaggaaccaatttccaaggtttttcctttgcttcttcttttgtgggaaatcaccattcacaaaatatctcattttggctttttctcacccaataaaacttcccatctatgaaaagcatggagatttagagaaagtaaatttcagtgggtgtgagaaggtcaagcttagagaataaagaaggaagtggtattggggaagaggtagaaaggtcaggaagggagaatctggttccctcttacctggatctgcgtccatcattttctctacccattcctcagttgtcaaggggcggatgtacttctccctcaccatccatgacttgggagcttccgagaacaccacacaacagaatgccttcactttaatcacacagagatagccatacaactctttcccacaaaacacttctacgattttggtgctgtactctacccgaggttttgaagagcaaaaatgaacaatgggcaacttagaaattgctcttgcaattacatttttcaaagagtcagggtcaacctgttctttggcacatcccaggactttcctactcttatcatccactccaataaaaagatagcctccctcagtgtttgcaaatgcagagatgtactctggaattatattttctacatattgttggatatgttttgtagagaactgtttaaactctatggatggagactcaggaaaagataggatttcaccatattcaatagtgtcagtttggaaaacttcatatgcaggatttgactcagatatgttctggtatacagctttcataattttactaggtggagacccttcattaatcagattatatttggactgtctttccttggtcttcaggaaatcgaatgcctgtcttgaattcatgtgaagcacagaggtgccagatctacagtataatgaagaactaaggctgcaaatgcgggaattgaaagaaccatctttaaggaaaggatcaccactccaagatttaacaaaaatataaaaacaccttccgtgttgcttagtctcaaagaaagcctgcaaatatggatactgaataagctttctcaaggattcttctaaatccagtcccatctctgtgggacgctcatccctgttggccatttccatctgaatcactcctcctcctgagtttaataaagcacacgcggcccgtataactctcgccctctcttggtctctctgagttttctgtagcttttttctgttttcttctcccagagtcacttctccgacatcgatgaccaggtctgggtaagatggatacacacccagggagcagtgatttgcctccatgttgaacttgcaccttaaagtattagaatatttgtttcatttttgattaaaaaattgttacaggcctgcaattcatttattagaaaatatttaaaacgtgtctaatatgtgctgggataagacaatagcaagaaagacaggtatagtctctttaggagctgactggctggcagggaagggaactaatgaaattagcctttaccatcatctgtgacatgggctctaagagggaaaacacattgaatagggtatctgaacgaatctggagaccatggttccataagacttccaggagtaggttccatttaggccaagacttaaaagatgcactagaactggccaggtgaaatcattagcattgaaacacagaagtagtggatcagctgaggggcatgtgtaccatggcatgagaacatctaggtttggaacagattctccatgaacatcaactttagaagataagtaaaagaagaccacattgaaaaggagactgtagaaaagtctgagtatgaaaaatcaaagaagtaagagaaaaatcaagggtatttggtattaacaaagcctggaacaaagtcacctgccaaggttttaagatgtctaatactgctgacagatacagctaggtaatgactggaaagtgttactaaacctaagtttagtaaaattaaggttaactgtgactttgaaaaatgctcttcagacacctgggaaatgggcatcaggaggcaataaaccaggggctaaggtcttggagaacagagtcaatgaagatggcttgaattccagttctgccatttagtactgttatattagtctagatatttactctttctaactctattttcttactataaaacatggtgcagccacctgtgactgttattatgaagattaactcagatagtttacaacaagcatttaaaactatgctttggttcacaggtgttcagcaaaggaacctatattaattgacattattttacaatgggttgaggaatgaatgagaggtaaggaagtagcatcatcaagtgtacacctgctgtcttcttacaccaaaatcagtcctgaagtacctgtaggcagaaacatgtttagagagaggcagcagagttcagaggtcaagattcagaaataaaggctgggacattcacaatcttaccagtttgcctaatttagacccttgcctagaaatttctaccgtcaggattctgtcttgcattccgagaccactgaaacatctttgtcaagttacctgtaaaatattctttttgatatatggggacttcaaagttaaatcttttctctttacccccatgaactttattgttaaagcctagataagctgatagtttttcattggtaactgtattcaaatggcaaccccacccatatcttttgcaggcagaaaagtcttagggagctctatcccagctcttcctttgggtataaaggtattatagtcagtgctacttgcagattctttgtaaggtagagatattgtttcctaaataaaattgaaaccctaaataaaactgaactattcaataacaaattgagaattcaggtgaaaaaaatcaggaagcttaccaatatatttaacaaaagcaactgattctgttgtatttacagaataactttgctagaattcctttcttaatgtaaccagacttcccaccagcacagtgaatgcccaccgcctgctgtcttcttccaccaaaatcagtcctgaaagacctgtatgcagaaacatgtagagagaggcagtagagttcaggggtcaagattcagacttctttgaaccccccctacacatgcatgggaataattagagataattcttgcccttgcttctctgtggaaattgatggaaacagtttcgcctcctacacaggtatactgtaggtaaaatcagaacaacacaaatcctcccatccactcccaagccccccaccccactgaggaaaactggtggggactggctagtctcaggcagaaacagaaggaaacagctgcgacagaggctccctcttgggaaaataaaacacagagctctttgtccttctcagatagcagctctgtattttacagacgttgggagggagacatttttctcatttctcccctttctagattgcagggtaatcaggataatgggtacagggtaatggcaattctaattctgttttgttgttttgttttgttttgttttgtttttgttttgatacaatgtcttcctgtgttgtccaggctggagggcagtggcgccatcacaggctcaggcgatttttgcctcagcctccggagaagctggaaccacaggtgcgcgccaccaggcccggttaatttattaatattagtattatattattattattattattattcatagcgatagggtctccctacattgcccaggctggtctcgaaatcctgggctcaagtaatcctcccacttggcctttcaaagtgctgaagctacaggcatgagccaccacacccggcctaattctgctttttaactcttagattaagaacaataatttacagtggttagtgagtcaatgccaagaaccctgaaacaagagtcccaaccttcgcaacgggggaagcctccaggacgcacttggctctgcctgtttgttccgcccccgcggaaaccgctgctcgctgggcaggggctttctgttttgcagccggaacaggaacacagatagcccgccaagccgccggcgacaccttccaacccctttagctctccgcaccgtccctccccaccgccccgcctccacccgcgccgcgatcaagtcctcatagccttttagggaatttgctcagcaaactagccgaaccccaaaggcaggggagaagcacgcaaataccccgactccaccggctggccggagctggggggcgggggttgctctcctagcttgctccccatccgagtcaacgccagtccagggtcgtgccggactagaccctagggcgtgggtacaaacgggagctccgcagtccccgtaggagcagggaccctctcttacctctcaagctccagcgcgtcaagctccaggacactccgcgtttccctggaggcgccaaggtcaggttcttataaccaatggttggcgcctacctgggcaggtcccacacaggggatgaacgaaccaatgggtcccaggcagggcatggacgcgccaatgggagtgtctacaaagcccgggaacactttgccacgctgtctagaaggcctggcgggaggctcgcgcctatgaaatcccagcactttgggaggcctaagcgggttcatcgcttgagccaagaagttcgagaccagcctggacagcacagtgggacccccgtctgtacaacaacaacaacaacaacaacaacaacaaaattactcaggcttagtggcgcgcgcctgtagactcaaatgtagtctcagatgcccgggaggctgaggctggaggatcacttgagcccgaggaagtccagggtaaagtgagtcgagatcgcaccactgcactccagcttgggcgacagagtgagagcctgttccccctacaaaaaaaaaaaaaaatgtctggaaacgccaagttttctgattgctttcgagtggttcttagttctttcttactccccctccgcccctcctccgtccctatctctctctcctttcccggagcctgcggtcccgccttccccggacccctcctctgagggtccagccaagctctcgcccgagctttccccttccaccgcactgcaactgcccataccccagcttgggcttctctccccactgcctgccccagaaagtgggccttgagacccgggaaccccaggtcaaaatgcgacggatgctcggatcgggcggcactcggttcctggctggatttgtggctccgcagaccccgcgccagagtgggatgtggcggcggccggtgctctgtgctcagtcaacgccttggagaggaggactacgaaacccatacactcggacagaaccctggcaggtgttaaaggctgcggcagagcagaaaagcagaaccctggctggttttcttgtaacacgagcagtgtgacggttaccggggttgaccaagcaccgcgcatcggccaagttctcactgacgcggactggcccaagggtgggagcggcggttaacaccggggtgattaatatacgctccagtggaggctaaagtgagaaaataaaacgtactccaataccacccccccttcgccccagagattaccactgaccactattaacaccctattgtacatatctttacggatcatacatatatattacacaaacatatatgtaatacttttttattaatacaaagtcacactgtatgtactcttcttaatctgcttttttcaatgacttccacctttccatttcagtaaatcttcatataatcatattccagttttttcatttttctttaaaatgcggtttatagattgtgcaaacctgtactgaatccagaactatacatctgtaaagcgctggaaaaaaaaaaaaggctgtcaatctagaattctataaccaccaaaaacaaaacaaaacaagtcctccaaaatggaggcaaaataacgacgtattcagaccaaaaaaaaaaaaaaaatcttaggaaatttgtcaccagcagatctttacaaaaactattaacgtgtttttttgttttttgtttgtttgtttgtttgtttctcagatggagtctcgctcttgttgcccaggctggagtgcaatggcgcgatctcagctcactgcaacctccgcctcccaggttcaagcgattctccttcctcagcctcccgagtagctaggattacaggcgcccgctaccaggccctgctaatttttgcatttttagtagagacgggggattcaccatgttggccaggctgatctcaaactcctgacctcaggtgatccacccgcctcgacctcccaaagtgctaggattacaggcatgagccactgcgcccggcctaacaaagttcttcatattgaaggaaaatgataccagaatgaaactcagatctacacaaaagaatgaggagcatggaagataataaacgcgtaggtaactataaaagattctctttttcattgttaaaaattattcataaaataattgatctttaaagaaaaactatgtattgtggtgcttataacaatgaagacatgaaaattgtgataattgcaacgcaaaggaaggaaggggaaaatgagtgtgtattgttttaaggttcttatatcacacatgaagtcatatactatgatttaactgtattaagttgaaggtgcatattgtaagccctagagctaccactaaaaaaaaagggaacaaaatcatatagactgtaagtcaacaaaggagttttccttgtgactcttattttcttgctgtttttataaaactttacttttacctgtttttgttttataaacatgcaattaactttgtatgctttttttttttttttttgccaactttgctaaactttgtagttaattttgacgatcaatctctatgttcttttaggtcatctaagaaaacaataatatcaaatgtgcataatgagagttttatttcttcctttgtaatctgcatacttttcttgtttccttttcatgtataatgcattggccaggactttcagcacaatgctaaatgaacgaactggtacctaaagacacaacctaaccgtactaaaattccatctttggggatctgtttcctgggatcgccttaaagaacagtttctgtgttagtcagggtcctgtcagaagaccagttattttgaacagagatgttttaaaatgaagaactattcactagacataaagactttttaactcaatcatggaaaaggcaaaaaagtaacaccacagtattatggaggtaactatggaaaagagccatcaactctgaggctaggagaacaaatggaagagatctttgagggagcataaggcagccactgtgagtgttgggaaaatttttttaaaaatctgaaaggtgtttatgggaaagtttataaaaccttattggaaaataataaatatataaataggttaaatcatataccatgtccatggattggaaaacccaacatattaaagaccactttgggaggctggggcgggcggatcacctgaggtcgggagttcaagaccagcctggccaacaggcaggagaattgcttgaacccgggagacagaggttgtggtgagccaaaatcatgccattgcactccagcctgggcaacaagagagaaactccatctcaaaaacaaaaaaataataataattctcaccaaactgatgagtagatccattgagattccattttaaatcccagcagtattttcctagaacattacacactgattatagatttatatataagactcgaaacactctttaaaagaaaaagcacgttgtgagcagacatcaaattttcttatatagcaaaaataattagaaaaaatagagcatggaataaatgacagagcctaggactcacatattgatggaaaaatctatgacagaagtagcattgcagttaagtggggaaaggagagactattttataaattgtgttgagatatctggtatccctagagaaaaaaatattaatttgcatcctgtcctccaaaatctattctgctaaaataaaaacataaatacaaaaaaacaaaatcagtaaatttttaagataatacaggggccaggtgcagtggctcatgcctataatcccagcactttgtgggggggtcaaggtggactgatcacttgagtccaggagttcgagaccaggctgggaaacatagtgaagctccatctctaccaaaaatacaaaaattagccaggcatggtggtgtacgcctgtggtcccagctactcgggaggctgaagcaggagaatcacttgaacccaggagctggaggttgctgtgagctgagatcacaccactgcactccagcctgggtaacagagcaagaccctgtcttccaaaaaaaaaaggcaaaaccatgatgttcccacctgttatggctgttaacgaacctcttccttacagacagctggaaaatgactaggcagtggtgatataaccaatatatccaaggcctgaccaattacgtgggaacccttcttaagtacagattccataagtagaaattgtgcctttgcaaattaggttactcactttctttttttatcttatatgagatgccttctttttctcaactcacatttcacattcacatgccttttttagtctttacataaatacagaatttactttttcatgtacagtaaaatttaccttttatgtatagttctattaacacatgtttagaatcatgtaaccaccacaaaacagaatagagccaccaccaccacacacacacacacacacaaacacacacacacaaactaatgatttcccccaattccagtccctgcaaagcacatatttgttctctatccctagttttctcttttccaggatggtgtataactgtaatcaaatagtatgtaaccatttgggattggcttctttgcataatatctttgagtttcttccctgctgtgtctgttaatttttcattcctttcgattgctgagtggtattccattgtttggatgtaccactttttgtttaaccattaacccattggaagacattcaggttgtttcctgggtttgttaattatgaatagaactgctacaaatagccatgtatagctgtgatggttaatactgagtgtcaacttgattggattaaaggatacaaagtattgatcctgagtgtgtctgtgagggtgttgccaaaagatacttgcttttgagtcagtgggctgggtaaggcagatccactcttaatctggtgggcacactctaaccagctttcaatgaatataaagcaggcagaaaaacgtgaaaatgagagatgggcctatcctcccagcctacatctttctcctgtcctggatgcttcctgctcttgaacatcggactccaagttcttcagttttgagacttggactagctctccttgctcctcagcttgcagacagcctattgtgggaccttgtgatagtgtaagttaatacttaataaacttccctttatatatatatatatctcctattagttctgtccctctaagagaaccctaactaatacagattttggtaccaggagtggttctaaaggaacagatattaaggatggagttttttcattggtttaggggtttctggagttggctgcttaataggattagacccaaaaatgctaaggactctacttctaacagtatggagaacactgatagtccttcacatgaactgtttagagagttgtgcaaaataaatgcatttggcactcctgattcactgctcatgagaggcaaggggtttagtgacactgcctaatacttttgaccatatgcggagaaccaaggaacgtaatgaagctggttggttgctcctaagttcagtaggcaaagtgatgaaagaaaatgatgagctcagggattctgtctcccggcttcagaagcagatactgagcctcaaatctgctaagattaccctgagtgagagccttatctcctgtagagaaagagctgaaattgtggaaaaacagacacaagctcttatgcgagtggctgacctgcaacaaaagatgcatgcatagcctcgccaggtgtctactgttaaagtgagggcattggttggaaaagaatgggaccctgcaacttggaatggggaaatgtgggaacaccctgatgaagctggggacactgagtttgtaaactctgatgaacttagtgagaagggagagcttccccatcccaagtagtggcaacatcccctcctcgacccatgctgccatcagcctttcctccttcgtctgaggagatgaaccctgcgctgcctgaggtaacagtgatggcctcccctgaggcagttgccaggcaagataatgttgattctcctcaggagccacccccaacaccctgtttgcttctagacctataaccaaactaaagtcccagcaggcccctggaggtgaggttgagagtgtgacctatgaggaggtgcaatacactcaaaaagaactgtttgagttccctaatttatataaacagcaatctggagaacaggcatgggaatggatattaagggtatgggataatggtggaaggaacatagagttggatcagtttgaatttattgatctggacaaccaaagttgccatggtggcagggatggcggttatgcatgggctcaggaacatggacttccactcaccaaggctgacctggctatggccactgctgagtgcccaattttccagcagcagagaccaacactgagcactcaatatggtaccattcctcggggcgatcagccagccacctggtggcaagttaattatattggacctcttccatcatggaaatggcggaggtttgtcctcactggaatagacacttactccggatatagtttgcctatcctgcacgcaatgcttctgccaagactaccatcgatggattcacggaatgcctcatccaccatcatagtattccacacagcattgcctctcaccaaggcactcactttacagctaaagaagtgtggcagtgggctcatgctcatggaattcactggtcttaacatgttccccatcgtcctgaagcagctggattgataaaacagtggaatggccttttaaaggcacaattaaaatgccaactatgtgacaatactttgcagcactggagcaaagttctccaaaaggctgtgtatgctctgaatcagcatccaatatatggtactgtttctcccatagccaggattcactggtccaggaatcgaggggtgaaagtggaagtggcatcactcaccatcacccctagtgagccactagcaaaatttttgcttcctgttcccgtgacattaggttatgctggcctagaggtcctagctgcagagggaggaatgctgccaccagaagacacaacaatgattccattaaactggaagttaagattgccacctggacactttgggcacctcctacctttaagtcagactaagaagggacttgcagtgttggctggggtgattgtcccaaactatcaagatgaaaccagtctaccactccacaatggagttaaggaagagtactcatggaatacaggagatccactagggagtctcttagtattaccatgccctgtgattaaggtcaatggaaaactacaacagcccaatccaggcaggactacaaatggtccagatccttcaggaatgaaggtttgggtcactccaccagggaaaaaaaaaccatgacctgctgatgcacttgctgaagacaaagagaatacagaatgggtagtagaagaaagtagtcatcaataccagctatggccacgaccagctgcagaaacgaagactgtaattgtcatgagtatttcctccttcttttattaaaaacatgtttgtgcatgtatacacttgtactaagaaaatatcttcattttatttccttttcctttatcatgtgacataagatttattgacttcatatcagcatttaagtattgttaactttaggtaatagtatttgggttagggattggtgcatttctagttgtatgaaggatagttgtattatgctaaacataattatgacttcattattgtctttatttgaatattatgtataatctcaaatggagatgtttttgggttcaagttgacaaggagaggacttgtgatggttaatactgagtgtcaacttgattggattgagggatacaaagtattaatcctgggtgtgtctgtgtgggtgttgccaaaagagattaaaatttgagtcagtgggctggggaaggcagatccacccttaatctggtgggcacaatctaatcagcttccagtgaatataaagcaggcaggaaaatgtgaaaaggagagacaggcttggcctcccagcctacatcttcagattcttcagtttgggaactctgactgtctctccttgctcctcagcctgcagacagtctattgtgggatgctgtgattgtgaaagttaatacttaataaactcatatatatatgttatatatattaggatatataataagatatatattatatataatagttctatccctgttagttcagtccctctaagagaactctaatacaagctacgtcccagagactccggtattttatctctttgttctcattagtttcaaagaacttttttattcctgccttaatttcattatttactcaggagtcattcaggagcaggttgttcaatttccacgtagttgtgtgatttttaagttagtttcttaatcttaagttctaatttgattgcactgtgatctgagagactgttatgatttcagttgttttgcacttgctgaggagtgttttacttccaattatgtgatcaattttagagtgagtgccatgtggtgatgagaagaatgtatattctgttgtttttggatggagagttctgtagatatctgtcagatcgcctagatccagagctgagttccagtcctgagtatctttgttaattttctgtctcaatattctgtctgatatcgtcagtggggtgttaaagtctcctactattattgtgtgggagtctaagtctctttgcaggtctctaagaacttgcgttatgaatctgggtgctcctgtattggatgcatatatacttaggatagttagctcttcttgttgcattgatccctttaccattatgtaatggccttctttgtcttttttgatctttgttggtttaaattctgttctgtcagagactaggattgcaacccctgctttttctctgctttccatctgcttgctaaatcttcctccatctttttattttgagcctatgtttgtctgtacatgagttgggtctcttgaatacagcataccgatgagtcttgactctatccagcttgccattctgtgtcttttaattggggcatttagcccatttacatttaaggttaatattcttatgtgtgaatttgatcctgtcatcatgatgctagctggttattttgcagacttgtttatatggttgtttcatagtgttactggtctgagtacttcagtgtgtttttgcagtggctggtaatggtttttcctttccatatttagtgcttccttcaggagctcttgcaaaggcaggcctggtggctgtgaattccctcagcttttgtttatctagaaaggatctgatttctccttcgcttatgaaacttagtttgcccggaaatgaaattctgggctggaaattcttttcttaagaatgttgaatattggcccccaatctcttctgccttgtagggtttctgttgagaggtctgctgttagtctcatgggcttctttttgtaggtgacctggcatttctctgtggctgcccttaacattttttctttcatttcaaccttggagactctgaatgattatgtgtcttggggttgatcttctcatggagtatcttactggggttcactgcatttcctgaatttgaatgttggcctgtcttgctaggttggggaagttctcctggatgatatcctaaagtatgttttccaacttggttccattctccccacctctttcaggtaccccaatcagttgtaggtttggtctttttacataatcccatatttctcagaggttttgttcattccttttacttcttttttcctctaatcttgtttgcctgacttatttcagaaagatagtcctcaaactctgagattctttcctccacttagtctatgtggttattgatacttgtgattgcattgtgaagtgctcgtgtgtttttcagctccatcaggtcatttatgttcctctctaaactggctactgtagtcaccagctcctgtaatgttttatcatgattcttagcttctttgcattgggttagaacatgatcctttacttcagtgaagtttattgctacccaccttctgaagcctacttctgtcaactcatccatctcagcctctgctcagttctgtgctcttgctggaaaaatgttgtgatcatttggaggagaagagaccctctggctttttaagttttcagagtttccgcatggattctttctcatttttgtgggcttatctaccaccaatctttgaggctgccgactttcaaattttgcaatggtctcagcagaaaataaacagtccacaatttaaacagaactcatagcattacaaaagtttacagaacccctatgttttcatcatttgtttctaacaacaaagattacaacgacagaattgaatgatcagaatgtaaaaatatttgtgcaaaactgcattaattgttcttactatctaataggggtaaaacttaagaacacacaatgacaataatgaagaaaaactacattaaaagtaattctactttagatttcaaacatgaattatattattactaaacattaaaaaaaaaagtggcaccatgagagcagcaggagcaacaaattatgccagctaaggaaagctgacactggaatatgccaaagttaatctccacaataggtatccatctgaaaagactggaaacaaccgtagggcctaaaactcacttcaatttatttattcttgaatttgtaggtcttaattgaagtatttaagaaagtcttttcccctccctctcaaggagtgtttcttgctttactgtcaatcattcgaagagttgaatcatagactctggatttaccaacaccaatccatttaactggaatttgaagctcatcttcaataaatcgaacatagttttgtgcattaacaggtagttctttaaatgcccttgcatttgatatgtctgtgttccattctcatggagtcttatattgaacttcaactttaagacttcttgatttgctggaatatgaggtatgatttgaccatctaacttgtaagcaactccaactttgatttccataaacatgtccaaaatattcaacttggtaacttccagcgcagtaaatccattgataatatgagcatatttgagcaaaacgaggtccaaccagccacatcttcttttccttccaatagttacaccaaactctctaccctttgtttgtaataattctccaatttccttgagattttgtaattcaccttcaatgtctatttccaaagtgggatgtatagatttgtattgtttagctggaactttaaacatctcagagaagccaacaaggtcagaaacaagatcgcacatcctaagtccactccgagcagctttggaagaataaactgggccaatgcccttttttgttgtacccaaattttttcctgcttgttcttgtctctgttgttcctggacaccatcagcggcttgatgaaaatcaaatacaatatgagctctgtcagataaaataagcctttttcccagccttctagtccttttcctttttgaacatttttctctgcttcttcaaacaatccaggtagatgaattaccacaccatttccattgaatgcagtaacatttggaataattattccactgggtaagagatgaaaatcatactccacagaatgcacaacaactgtatggccagcattatttcctccctggcagcggcacatggggtcctgcgccagtagatccgccacctcccctttgccttcgtcgccccactgcacaccgagcaccaccgtcacccagtttcctctgggccgcgccctggggcggccgcaatcgccgctgggcagggaggatgcctccaggtagttcttggcgaacgccgcagctccggtgacgcgaggagagccggaaggagacgcggccggcgagaggtgagcgaactgtattgctctgcggcctccagccacctgcggaggaagagggagccagaggccggccccgcccccgcccccgccccgctgggctgccacactccagccaatccctgccccgctctccgccacaacccgctcaagtagggggactctgactgccccgcgcaggtggcctgccttggcagcaccgcccgcgggaagtggcggcctggcgcgctactcggagaaggccataatttagcctaccacactaatatgtgcacttaaattttactcatcactgaatctcctcactctcattatctatgtctcacgaattttgatatgttttcattttcactcgactgcatttttaaaatttaccctgagacaacctctttgtcctatggattacttagaagtacgttttaactttctaagtgtttggaaattttcctgttacctttctgccattgatttgtagtttggttccattttggtcatagaacacactctgagtataatttcaattctttaacatttgtttaggtttgttttatggctcaggttctggtctatcttggtatatgttccataggcatttgagaagaatatatgttttgctgttgttgagtaacatgttgactggtggtgttaagttcttctatacccttgcagattttctttaagacggggtctcgctctgtcactgaggctggagtgcagtggcatgatcatagttcactgcaacctcatttcctggactcaagcaagcctcccacttcagcctctcaagtagctagaactacaggcatgcaccaacatgcccccccagaaattttttttaagaatggggtcttgctgtgttgtgcaggctgctctcaaatctgccttatagattttttggtctacttgtactacgaggtacaagggtgatgacgtccctaactacaattgtgaagtctacttctcctttcagtgctatcactttttgtgtcacatattttgcagctctgttgtttgatatacatacatgtagatggccatatcttcctggttaactgatcttttcatcattaatataatatccctatgcgtctctggtaattttctttactttatctgatatttgtatagccgcacctgctctcttttgtttgcataatatgtctttttttttttttttttttttttttagacgaagccttgctctgtcacccaggctggagtgcagtggcacaatcttggctcactgcagtctcagcatcccaggttcaagtgatcctcccacctcagcctcccaagtagctgagattacaggcacccaccaccaagtccacctaatttttgtatttttagtagagatgggggggtttcaccatgttggccagtctggtcttgaactcttggcctcaactgatccaccaccttggcctcccagagtgctggaattacaggtgtgagccaccatacctggccctacatgatatgcctttttccatcattttattttcaactttcatacatttgaagtgagttccttatagacaccatacactgggtcataatttttaatccactctgccaaatggttctttaattggtatatttagaccctttatatattatataattattgatatgtttgggcttaagtatgccattttattttttgatttctatttcttctctgtgttcttaatatttttttcttttccctgccttcctatgggttgaatattgggcagaattctgagttatctattatgtttttagtgtatctcgttgtatagcttttatagtaattgctgtaggtattacattatatatacataatttttcacagtgaactggtgtcatcattttactagttctagtgaaatatagaaattttacctccagtcatgtctctttaaccacctttctttgtttataataaaattgtattaaatatttcctctacaaacatgtagaaccacatcagagaatgttataatttttactccaactgtcaaacataatttagaagactcaagcagagagagaaagcatattgcatttacccatatttttacttactgtgttctttcttcctttctgatgttccataactccttttttttttttcattgcctccctgtttagataacttcttttagctgttctgttagagtaggtcttttggtgatggcaatgaattctcttatttttccttcatctgagaatgccttggttttcctttcattcctaaagaatacattctctgtgcataggattctgagttgagagttctttttattcagtacttgaaaaatgttatgacactttcttctgttctccatgattccactgtcattcaaattgttattctctataaagaaggtgttttcactggctgctttaaatatattttatgtccttagttttcagatatttaattaaaatttgtcttggcacaattttctttgagtttatcttgtttgggatttgcttagctccttgactctgtgtttacctgagttatcaggtaaatatccaagagaacaaaaaaggaaaaaaatgattgggacaaaggagaccaaaaggagtgaaagagagaaggaaaattttaacctagagatacaagccactctaaaatattttgtttaacaaaaaagtgggagaaagtggactgcaggggcttgtccagggaaaggctactgccaagaagcactgtgtccctttctcctccattctttcctcttatcagtcagagatagaaactaaaacagcctaaaactggggggtgtagtgtgacggatccccgaccaggttacttaagggtttatttttgctgcttgcaccctgaaggctgagcactgagcaaaggccatgatgcctacctgaggagaaggtgtccctgacaacccaaacatcccagaatgtctctgggaacataccaaggaaaacagtctcattgcaaacagtaggcaaagagccagaatattcgcttaaaagaagcttagggctgggtgatggggcaggtctctggagctatcctgctcccaccaggaataccttgtatgtaagtcctgataaattcatctactcacaaacctagatttgtctgagccattctttggtttcttggctccttctcagtttgggagtatgttgcagtcccagtttttcttgtaacagcatgagggagaggaatagaaaaaaaaaaaacctgaattcagggtgcctaagtctattttgtgttataaggaattcctgaggctgtgtaatttgtaaagaaaaaggatgcatttggctcacaattctgatgtctaggaaagttcaagattgggcatctgcatccggttatgtcctcaggctgcttccactcatggcaggaggcaaagagaagccagtgtgtgcagagatcacaaggcaagagaggaaacaagagtagagagaggtgccagggtctttttaacaaccaactcttatgggaactaataaagtcagaactcacccccaagaaagggcattaatctattcatgagacatcctcccccatgaccccaacaccttccattgggctccctctccaacactgaggatcaaatttcgacatggggtttggaggggaccaaacatccaaactatagcacagggagagaaaaaaaataaccaactgaattatatgtagataaaatttttgttaatttttattttaggtttgggggcgcatgtgaaggctcattacacaggtaaacatgtgtcatggggttttgttatacatattatttcatcacccaggtattaagcccatacccaatagttaacttttctgctcctctccctcctcccaccctccccccctcaaatagaccccagtgtctgctgtttccttctttgtgttcataagttctttcgtttagctcccatttatcagtgagaagatgctggacttggttttctgttcttaagttagtttgctaagggtaatggcctccagttccatccatgttcctgcaaaagacatgatcttgttcttttttatggctgtgtagtagcccatggtgtatatgtaccacattttctttatctaatctgtcattgatgagcatttaggttaatatagacataatgaatagattgtacatgtacatagataaagatatcaaacgtatatctaaattaaaacaaacatccataatttcacccaattggaaatcgaaaatttgtataccaaagaatttatataacaaaaagatagctaaggtcgtgattgggtttagaactgtaaggttttttgttttctgttttttgctttttttagagagagataaagtcttgctctgtcacccaggctggagtgcggtggtgccatcttggctcactgcaacccccgcctcccaggttcaagtgattctcctgcctcagcttcccaagtagctgggactacgggagcacaccaccacatccagctaatttttgtattttttagtagagatgaggtttcactatatgttcgccaggctggtctcgaactcctggcctcaagtgatccgcctgtctcggcctcccaaagtgctgggattacaggcgtgagccaccacgcctggccagaactgaaagctctaaattaactttaacatttgccaaaatgcaccaattgagaaacctcgtggacttaataaatactcaaattatacttatgcctgaggttccaacaaatttaaacattgtaccccatataattttaaaaggtagctaaatagctttttaaaaatagctatgccttattttatatcttgattgaattgctcatagttgttgtactcagtgccttaaagtatctcgtattgaacatagactccatgtcacaataaataataaattaaaattaaatttttggcactcaaaaattggcttgataaaataggattatataaatcccattaaaatagttaatatggttcaatgtaagttaaaataggcccttgaaggattgaaagttgttacataaaacctcatttatataacataaaagggataaaggagataagtattccctgctgcttgtccgtttaacagcccagtgttgcctgttcttaaacctggaaaataataagcagcaggcacctcacggtggaggactacaacattattgctgtggtcttgtcgactagggcctcatagccagtatctagtatgattaacattattaactctatccaatcaataactgctaaatactctgttcttacagacttggctaatatgttcaatatgttcaattccgtgcctatttcaacagactccactgtagtttgcctccattgctgaagagacacaatatacctcttgcaggctacacctcagtaccttcacaattttgccatcatgcacacatcttacagacaagatcttttttaatacttaatttttctagagcagattcacagcaaaattgagcggaaagtacaaagattttccatatacccactgcccgcactcatgcatagcctcccccattagcaacatctcccattagtgtggtacatttgttacaattgattaatctaaattaatacatcataatcactcaaaatccattgcgacttttacattagcgttcattcttcttgtacattttatgggttcagacaaatgtataatgacatatatctactatatagtatcaaacacaggattttcatggccttaagaatcctctgtggttcaactattcattcctcccactcccttaatccttggaaaccaccgatcattttactgtctccataatcttgccttttacagaatgtcatatagttggaatcatacagtatatagccttttcagatggccttctttttaaagagacagggacagacaagatcttaagtgcatgcaccttcctctgggagcacagatatgatattacattaataacctcctccaaggagatgtcacttaatctactcatatggacataagagtccaacatcttttcatcctttttgggttttcatggcaaaatattcttcacttacaaattttacttaatctcattgagctgtaactcacaaatgaacccactttaaatgtggcagcctcaaacaaaaaggctctaaaatctatccaaattaataccaacagacagacccattggtgcctgcattgattcctttactgaagagactttaacaagctctactcatgcctcctaaagtctagaccacctgtgatggctacgaattgcctgagggctctcagcctcatgctatatgccattaaaaccacaaatgactagctccatactgggctctcctggacatagaggctttcacagattctgagtctgtgaccctccatacctggctacctgttatgctttcagtcatggaaacagcaccctgcaagctcagcctctcagagggcccaggtttgtctctaacctgtctcaaggaggctaccaagtcctgggctctctagcatattcacacgcagaagggagtgacgtccccagtccttggtcccttgccagatgccatagtgctggaggaggtcacctctcctccagaccccttggttacctggaaagctcctttggattgactgagtgaacagcaatagaagttcacggactatatgaatggcactgccaaccaccatacatgatggagctaggtggaatattaccgaatgctggatgccctggccaacaaatggccccatctccatattccttttgaacaattgagccattgcctaatgaattgtccctttcagattaaggaacactaagaacctctttcctcttagatacccaaaatcacgtgtctatgtatattaaggccaccatatgaggccttacaattaccaaggtaataaccaaggcacacatttcacattgcaaaatacacactgaatgggctcccgaaacaaacaggcattcaataaaactttcatgaccctaataggtcccaaatagccagtttaacagagagacataagagtctccccaaacaacttcttttaaagttccagtccaacaaatggacctctcaatgggtctttatcttgccccaggccttaacctatttttatagattttcaatatcaaaccccccccatcaggaggccacagcaggtgtgtatattctctggggtccaattaatagtgattgtccaatgggctaggcagctgcttatctgatatgggacccgtttgagcctaaacttcaaccatgaagcaagcaagcaagcaagcaaaaaccaaaactctgtcaaatgcagctgcacaccattctgttttctgtttatcttttttgttttgtttgtttgtttttgctttttgttttggtctgagacaaggtctcactctgttacccaggctggagtgcagtggcgtgatcacgattcactccccactctacttcctgggttcagacaatcctctcacctcagcctcctgagaagctgcgaccacaggcacacactaccacgcccagctaattttttatgttttttgtagagacagggttttaccatgttgcccaggctggtcttgaatgcctgagctcaagcaatgcacctgctttggcctctcaaagtgctgggattacaggcatgagctgccatgctcagcctgctgatcttactgctggtatgggtgcttttgttgttttatcatctggaggcaccaaccctccatacaagccattgttttaatcaatcatggcaaatgctaagacccacatcaacctgagtctgtatttacttaaaagaaatactcaagacccatatcctagatgacattttcctggataggcactcactgctggagattatgctgcctcagatgacatcgatccagcttaccgtcagagatgaatttacccctgcaccagacatggcgtcaccctaaacacaaaaaccttcaccccagtgacacccatggactgcctcttctcaggcacaaactgcacaccgaacatttggccttttttcctttgatatcagggattctattgtgtttctgagtgtgctgtctgcttagcctatcatcctggcatactccttgctctctgccaaaacatacaccccgcactcctatgcctgaaggaaaatttaatagtagttaccactacctacgtcattctaagaattaatggagggccaagcacagtgactcatgcctataattccagcactttgggaggctgaggcaggactgcttaatcccaggagttcaaaccagcctgggcaacatggggagaccccatctctacaaaacatataaaagttagctgggcatggtggtgtacacctgtagtcccagctactcaagagtctgaggcaggagaatctcttgatgtcgggaggtcaaggctgtaatgagctatgaccacaccactgcactccagcctcggtgacaagggcaagaccctgtgtctaaaaagataacaaaaattaatggatagtattgcctttctctgaaggctgttgcctcctgagtcaatccctcaacccactgggaagaggaccactaactccccagtgcctacccctactaccccctcaagctttcccccgtgacttcctgccctgtgtctctgaccatgaccactcctccttggttatacacacacgctagtctacacatgcattattaatgtattagttcctatcccccaacaacctgactgcaggacctgttttatataaaatatatatatataaaatatatatatattatatatataaatatatatataatatatatatatatgtatttcaaacttttaacccactttaaaactccaccaagataatagtaaaaacctccaaaaatttcagatctactttcttgactaatgacatgcaaatgaagaacttagttatggaccagcctacaagggctctttatacttccacattgttcttctatcttactcttacaataaaatattttctaggctatttagggcaactgtaccccatcctttaaataagtccactattaccaccccaggtttcttacgatgatgccaaataggcccaggggcaatgggtcttactgtgttttcctaggttctgtacttgtctatttggcatccattaatcacagggccaaactaatggccaacattctttacatccccgctgtgacccagagctcatactctaagctactcacacatcgagccaatattttccctaccctacataaacccagggccatgtaacagacaactggggaccgtccctaggccccaaagcccatcagaattattcaaactattgagtcctaagctgttccccctgcccagctggacctttcccacagaaaccctaataataaaggttccgaattagattttcccctcacttctgctcctctttccttaaccaactggatgctttaccacatgaccctgcatgacagagcaagtccccttctcttggaactataagtaataaagtcttttttcaatggcgctagtccatctgtgttgacactcagtcacctccataaatcaaaacttcaagagtacattttcatataatattttatcaggcatctgaaggtttcaccaaagtttatattttcctactgcaaaactatgttccatgtagatctggcccatcttgaggctattgttcctgcgttcatcctcccatggtcacatttcttggccaacagaaccatagaaattggtctgccatgtgttaacgtttagtccaaatcatttttccactttagctctgcttcaaatggggctggcctggtgatactggagacaataaatgcgcctgtaagttccagataacaggctcttgtcattttcccaatctttcctcattgcaatgttccacagctgtaggtgtgccaaggcctctgggtcccagtgtagcaccttgaatgcacagttcacacagtggtggcttcagggtgccagccaggaggagttctggtgcactcactgtttgatgatggtggtcttccccatgcccaggtcacccatcaccagcagctgatacaggctgcctgaggttcagggctggaaagactccaagagtgtgaacatgctcccactgttttaagttcttttttttttttttaatttttattatactttaagctctgggatacacgtgcagaatgtgcaggtttgttacataggtatacatgtgccatggtggtttgctgcacctattgacccatcctctgagttccctcccctcactctccccaccccacaacaggccctggtgtgtgttaatcctttccctgtgtccatgtgttctcattgttcagctcccacttatgagtgagaacatgtagtgtttcattttctgttcccatgttagtttgctgaggatgatggcttccagcttcatccatgtccctgcaaaggtcatgatctcattcctttttatggctgcacagtattccatggtgtatatgtaccacattttctttatccagtctatcactgatgggcatttgggttggttccatgcctttgctattgtaaatagtggggcaataaacatatgtgtgcatgtgtctttttttttttttttctgagacagagttttgctcttgtcacccaggctggagtgcaatggggtgatcttggctcactgcaacctctgcctcccgggttcaagcaattttcatgtctcagcctcccaagtagctgggattacagacgcctaccaccactcccagctaattcttgtatttttagtagaaatggggtttcaccatgttggccaggctggtctcaaactcctggcctcaggtgatccacccgcctcagcctcccaaagtgctgggattacaggcatgagccaccgcgccacgcctgcatgtatctttatagtagaatgatttacattcctttgggtatatacccagtaatgggattcctgggtcaaatggtatttctggttctagatccttgaggaatcgccacactgtcttccacaatggttgaactaatttacattcccaccaacagtgtaaaagcattcctatttctccacagcctcgccgtgcagtggagactttttaataatctttcttttaataaaagattatttaaaagttttaaatattcttttaataaaagattatttaaaagttttaaataatcttttatcttgacttttcaataatcaccatttgacttgtgtgagatggtgtctcattgtggttttgatttgcatttctctaatgataagtgatgttgagttttttttcatacgtttgttggctgtataaatgtcttcttttgagaaatgtctattcatatcctttatccacttttcaatggggttgttttttccttgtaaatttgtttaagttccttgtacattctgggtattagacctttgtcagatgggtagattgcaaaaattttctcccattctgtaggttgtccgttcactctgatggtggtttctttccctgtacagaagctctttagtttaattagatcccgtttgtcaactttggctttcgttgcaattgcttttggtgtttttgtcatgaagtctttgcccatgcctatgtcctgaatggtattgcctaggttttcttctagagtttttatggttttgagttttgcatttaagtctttaatctatcttgagttaatttttgtataaagtgtaaggaagggatccagtttcagttttcagtttgagtctttagtccatcttgggttaatttttgtataaggtgtaaggaagggatccagtttcagttttctgcatatggctagccagttctcccagcaccatttattgaatagaagatcctttccccattgcttgtttttgtcaagtttgtagaagatcagatggttatagatgtgtggtgttatttctgaggtctctgttctgttccattggtctatatgtctctttttatgccagtaccatgctgttttggttactgtagccatgtagtgtagtttgaagtcaggtagcataatgcctccagctttgttctttttgtttaggattatcttagctatacaaggtcttctttgattccatatgaaatttaatttcatttaattctgatttgattccatatgaaattctgtgaagaatgtcaatggtagtttgatgggaataacattgaatctataaattactttgggcaatatggccattttcatgatattgattcttcctgtttatgaggatggaatgtttttccatttgtttgtgtcttctcttgtttccttgagcagtggtttgtagttctccttgaagaggtccttcacatcccttgttagctgtatttctaggtattttattctctttttagcgattgtgaatgtgagttcactcatgatttggctctctgcttgtctattgttggtgtaatggaatgcttgtgacttttgcacattgattttgtatcctgagactttgctgaagttgcttatcagcttaaggaatttggaggctgagatgatgggattttctagatataaaatcatctcatctacaaataaagacaatttgacttcctctcttcctattcgaatacctttatttctttctcttgcctgattgccctggccggaacttccaatactatgttgaataggagtggtgagagagggcattcttgtcttgtgccaattttcaaagggaatgcttccaggttttgcccattcagtatgatattggctgtgggtttgtcatgaatagctcttattgttttgagatatgtttcatcaatacccagtttattgagagtttttaacataaagggatgttgaattttgtcagagtctttttctgcatctattgagataatcatatggtttttgtcattgtttctgtttatgtgatgaattacatttattgatttgtgtttgttgaatcagccttgcatcccagggatgaggcccacttgatcgtggtggataagcttttctgacatgccactggattcggtttgccagtattttattgatgatttttgcaatgatgttcatcagggatattggcctgaagttttcctttttttattgtgtccctaccaggttttggtatcaggatgatactggcttcataaaatgagttaggcaggattctttcctcttttattgtttggaatagtttcagtagaaatggtaccagctcctctttgtacctctggtagaattcagctgtgaatctgtctggtcctgggctttttttggttagtaattactgcctcaatttcagaacttgttattgacctgttcagggatttgacttctccctggctcagtcttgggaggttgcatgtgttcaggaatttatccatttcttctagattttctagtttatttgcatagagatgacagagtcttgctctcttgcccaagctggagtgcagtggtgtggtcttggctcactgtaacctccacttcctgcgttcaagcaattctcatgcctcagcctcccgagtagctgggactacatgtgtgtgccaccacacttggctaatttttatatttttagtagagactgggtttcaccatgttgcccaggctggtcttcaactcctgacctcaagtgatccatccaactcggcaagttctccattttgattcatctcttcattggctgcatttcattgcaatatagttttcaagaagatattagagaactatgttttccatgtccattggataagaatgtctgatatttcctttatagtcaaatgacatcttggtatggcaaaacatgtgtaggtaattaatttttctaatttcccttaaggaatatctataaagaacttaggaagaagcgaacataggctaatcccagttttccaacatcacgtcaagttgcctaacttgcaatgttttcaaagacgtatttttagagaattagagaatgttaccaaatatataatgaaaaatatctctgtagcccagtccatcttccatgattcaagtgagccttggacaagatttaaacatccttatctatactgattatctgggagatgctggaaatgtcaaaggctaattggtctataaaagaattgattctccagccgggcgcggtggctcacatctgtactcctagcactttgggagaccgggggggggggttgaatcacgaggtcaggagttcaagaccagcctggccaagacggtgaaaccccatctctgctaaaaatacaaaaaaaaaaaaattagccaggtgtggtggcaggcacatgtaatcccagctactcgggaggctgaggcagggaattgcttgaacccaggaggcagaggttgcagtgagtcgagatcgtgtcactacactccagtctgggtgacagagtgagactcatctcaagaaaaaacaaacaaaccaacaaacaaacaaacaaaaacgaaacaaacaaacaaacaaaaagatttgattctccttaggtaagatatttgaaagggccttttccaagtctttcattgtttgagctgttgtccaatagtaggattcagggtaaattacttgcgagtttaaatcatactggcagcttgtcttgccttcagggctcaagtagaagatctttgtcatgacacacacttttttagtgtaaccaccaatttttgccagcttctgttttaaagtttgggcagtttgtgtagaatagtctttaaactcctcatcctgtaccatgtggaaggtgtataggactggaggcttgtcctgggaaatcagaagagcatcacagaggactttgtggttctcttgcaagcccagatccaaagaccagctcctagagaagatcagtgagcccttattgacagagcccatttcttcacatattaattgcttaagtccttcatgttgtgagaacagatttctgcagaaggtttttggagcacaagttatcttttctgatagccctagatggggaaataatgataaattataaaagactgagaacttccaacttaagccatggatacaaagcagcttgtattagattaattctcccaccaaaagcaactataaaagctatgtaaaagtgtatcagggccaggcatggtggctcacacctgtaataacaacactttgggaggcagaggcaggaggatcacttgtgcccaggtgttcaagaccagtctaggcaacactgtaagacctcttctctacaaaaaggttacaaagttagccaagcatggtagtgcatgctggtagtcccagctacttgggaggctgaggtgggaggatcacttgagcccaggaagttgaggctgcagtgagctgagatcatgccactgcactccagcctgggcaacagcatgagattctgtctcaaaaaaattctacatatatatatatttttttaaatttatatatatgtatatatatatatcataaaactataatttaaaggactggagagcaaccaatacaagcaggacttaaagggctacaatctttaatacagaagaatcacaggaagtagcttcacattcacctctgctttttccctaaggagattttccatatcacagcatgggtaaatagagcccatgcagaaatcagcagttttactgggctaaagaaaacagaggtcagacttcagggctgccagaggagctgggatttcagaaacaaaatcccagagaagatgaaactgaagagaagaagccaaaatctacccacaaatttccctcaactcactggctaatacaggtgagatgctagaaacacagaagaaaatatcaactagggctgggtgtggtggcttatgcctgtaatcccagcagtttaggaggccgaggcaggtggattgcttgagcccaggagtttgagaccagcctgggcaatatggtgaaaccctgtcacaaaaagaaagaaaagaaagcaaggaaggaaggaaggaaggaaggaaggaaggaaggaaggaaggaaggaaggaaggaaggaaggaaagaaggaaggaaggagaaaatatcaactgatcaactgggagattaaagagctgaacatcactttcatcagcctcacggtgctcaggaaacacaaattgtaattcaactcccagccaagtagaagggtcttggtaaataccccagactttaagaccccagaagagccatgacctagtaattagtgcaaaattaaaagctactatacctagaaaagcataaaacaaaacttcaaaagagtaaaagttatcactggtgttctgtctgccaaaaaaaaaaaaaatgtgtaaccctatctgaagaaatgtaacatctactaaagtctctacaatttgtaatccataatactatacaaaattaagagacaggataaaaatcagaacaaattactagaaaataagagaaaaactggattatagaaaaagactggcaagtgcttcagacattggagtcatcaaagagggactttaaaataactgttacatcttttttaaaaccccccaaaaataaaataggtgaaaagatgaagatgtcctgatcctcttacaggctcagaaaattgaaatcaatggataaaaatcatcaggggtttggtggtcttaagccccagtttgttcaagggtcagttgtatgcagtaatatcccagaggtggcgatcagcaggtgaaactgagttttcagtaactggatctaggaaaagtggttatccacatgggataaaatgaaatagccccctacatcaccgtttatggatgtggattacatatttaaatgttaaatgttaagtgcaaaactttaaaatttttaaaagaaaataaacagaaatatctttataaccccggggtagggaaggatctcttacacaaggcacaaagagcactaaaccacaaaatttttaaatggcaagtttgactatatccaatttaaaactgctagggagaatatgccttgggaaaagagaaaatgcaagtcatgaacttggagaagacgtctgaaatctgtactatctgtgactaaacgaggattttatgttagaatctgtgaattgctcctagaaatcagtaagaaaaagataaagcctattacaaaaatgagcaaaagacagaatcgccacttcatagaagataaaatatcttctatgggagatattttcttccatgtatatacccaaataaataccgatttgactgaggaagaaaagaagttcaagagaaaagaagttcaagtagaaagatgaagagagaagtctggcattggaaaagatgtggcatttccaatatattgctggtggaagtaaagtgagctatctactttggaaataatttgacattatcttattacttaaatattcacacactgcctgaacgaacaattctacccctacttaggcacctaaagaaatagaatttgacaaattcaatgactaaaaacaccaaagaatttccataaacaaaagaatgtgcttccataacaaatatcaagacagagctggtttgaagagaaggaggtttgaacacagttacaccaacaactccacggaagccagaattaaattacctggaaggtgatatctcagtggctgaattttgaagttaatatattcacgaagaggataactctgggagacaggtgatgatgtacttgctggagagggcagttcctcacatactatggaataatgttagaaaacaaaaatcacgctcttaatttggcatgggagagactcaagctaactaatgcacagtataccaaacgtctacttagaactgatcctgcattcccaatacagaacattagatattgtggttacatattgtggttagattcctaggtcagatacaaattgtaaaattaactcttgatgctgctgaaacactctatacttggaaggaaaattaacagtaaaaatgcattgatagcaatttaatacattgccatataactgagtttattttaaaacaagttaaaattagaagaatgtgatggctagtgaaggaaaactgggttttatgcagattctgaggaacaagtttgcattttcagagattttgtaagttgctagttctggtctaatctcactggaggctttccttttccaaaaccagataaaatatcagcattattcttctcttattggtacaatttaggttactctttggctcataaatgtgagaggaagaggggaagtctttacaggaaataaatggaaagtgggtaaagaaagatgaaagagcaagcaagtaaaagagtaagtgttcccaaaagaaagcaatggttagttacagaaaatgagccctgaaagaaaaacgaaaagaattgaacaggctttccttgaaagtgagtaaagaaatggtagagaagaaacatctagaatctttgcatcagataaggctactaagagtagatatttagttattgtatggaatatctatcttctaagtgtgcagaagaaaacaagaggcagggaagtattggttgtatccaccagagatgttgaaatttgaagacttttaatcttgtccctaatcccaaagatacaataaaaccttcctgccacccaagccaaaggtatccttattgccaatcctccttcctcaacctggttctgaatccaccatgaactggatccattccttctcggtcaactgcttaactctgttatctttcacgtgccaggaatcaggctttttagcaaacactgcacagcagaagcgttccactctgagtgcatacacatatccacaaagccttcctttatcatatactccaaggaatttgcataagtaatttatcgtccccttctccacacagaagtgatgcacaggcagtttcccaatggaattttttgttacttcttctaacttagtaagataactcttctctgctttaaagccaattacttctttatcttcatttagaccaacgaataaatatcctccatcagtatttgcaaatgcagaaacatattgagggagaatctctgtaattcgttgtaacaacttttcagtcgagaagttttttatttcaacgtgtgtggattcagtaaaggtcaatttttctttataaccaagttctgttctgttaaaaaaatcagcagccaaggcttccatgttactttcttcttgtacatcaacacaggccctttttgcagggaattctggtcttaaatatgctctccctccagttttttccatgtctttgaggaactccagtgcagcagaagcattcatgacttttgcagacgttacatctctcttgtacaaactggagctcaacgtggcaatctgcggaccagaggtttccaagctccatgatttcacaaaaatgtgaaagtagttaccattctgcatgaagtccaggaaattaggaacaaatggcagcatgttactaaaagaattttccaaatctagccctattccatcttttttataactatagcctttattctcaacttcagccttgatcactccccctccagaattcagcagagcacacacagctcgtgagacattttcattctgctgttttctcagttgacaatccttcattttttttctattgttctctccaagagtgactcttcccacatttagaaccagctcagcatagtttgtgtctaaatcaatactgatgttcattttcccagcagctaagccatttccacgcagaaattcttttctgtaaaatagagccgttagaataggagttaagcctgagagacagcaaattctgcattatgaggcaaacgtagaaaaatcctttactgtatattttccactagactggtaagtatatgggtctgagataactaatttctaacaaattttgagctaaggctgtgataatttatactcctactgaattttcaaatttgttacaactgttttatacgatcttattctaataattttaatcttgtctttatgtgttcgttgtgtcctttctcatcactaatattgtacaatttgttttctctcttctttctttaagtaaatccctggagggattctatgtttttattttctcagtggacaaggttttagtcatgcatattatttcttctttactttttattttaataattttagcttttacattcattaattatctccttttatgggaaatccttttggaaaactgccagatagggtctaagagggtccagcaataataatcttaattattttttattcttataagaatgaattagattcacaaattttgggcattgatcgcaagcaaaacagaccaactccttgtgccctttccctatcaaacatccacgtttacaaggaggtaatcgtgggtggcaagccacccaggtgccaaggcaagagactgagggcacaagctcttccagtataataaagaaaatatatagaataagaatagttatactaaaaatagattatagatatgattatatatgattatcattaatcattagtttgtggtattattattccaatattataataatctttgttctacaattataacctagaaaaaaaccaggccatacagagataggagctgaagggacatgatgaaaagtgaccagaaaacaagtgtgagccctttgttacgcccggacagggcttctagagggctgcctggcctagcggtaacaccagcgccagggaaggcacccgtcacctagcagaccttggtctaacagtagcatcagtgcctggggaaggcacctgttacttagcagaccgggaaggggagtctccctttccccgggggagttagagaagactctgctccaccacctcttgtggaaggcctgacatcagtcaggcctgcccgcagccatctggaggcctaaccgtctccctgtgatgctgtgcttcagtggtcatgctcctggtccactttcatgttccaccctgtacacctgggtctgccttctagatagcagtagcagaaatagtgaaagtactaaaagtctttgaaatgcgtagaagaaataatggcataagccgtgctctctgtctccatcttggctgccaaacagggaagggccccctgtccagtggacacatgacccaagtgaccttacctatcactggagatggctcacactccttaccctgccccgttgtcttgtatccaatcaataacagcgcagcctggcattcggggccactaccaggctccgcaccttggtggtagtggccccccagcccagctgtttttcttatatctctttgtcctgtgtctttatttctacaatctctcgtctccgcacacgaggagaaaaacccacagaccctgtagggctggaccccacagataatattggtttttttgtttgtttgttttgttgtttgttttttgtttttgtttttgtttttgagatggagtttcgctcttgttgcccaggctggagtgcaatggcacaatctcaggtcactgcaacctccacctcctgagttcaagggattctcctgcctcagcctcccaagtagctggcattaaggcacctgccaccatgcctgcctaatttttttgtatttttagtagagacagcgtttcaccatgttggccaggctggtctcgatgatgatcctgacctcagatgatccacctgccttggcctcccaaagttttgggattacaggcatgagccacaatgcccagtcaaggtaatattcttatatacaaaacacctgtgctctaccttgaatgtttgcatcctctcaaaattcatatgttgaaattctaacacccaacatgatgggcgtttgggaggtgattaggttaaagggtagatccctcatgaatgagattagtgctcttctaaaagggacttcagaaagctagggatggcagcctgccatcacaaaggctgcagcagggaggggcagctagggctgcacactttctggagcccgtgggagccctgcctcttccaagttgggacgtgagctccccaggtgctgctgcagccacccaaaccaccactgtagacccaggcctcccgctctctgcagcatgctagaatcctgccccacaaccctgccccatgcagctgcagccacccaaatcgagattgcagattcaggcatctctgcactcttggggcctgagaagatccccctgccctcgcaggctcagaagtgcctgctcccactgcctggcttctccttctccctgctgtcggtgcccactctgatctgggagcaaaggctggccaaactccggagacataaatggcagtgggaggcagacagattcctgggtcaaaggcggcgggtccccagtagggccacaccttcaggcctgggagggcctgaaggctggggaccgggctgccagtgctgtagactgtggggacttgtggtgcctcttctggggctgcatgtggaccaatggcacacacttcctcccctctgaggtccataaaagccctgggctcagccagagcaggggcagaggaggaagagatgaagagaggaccaacttcagagaggaactaccctctctgctgatagcaggagaggacaggacaaccagccgcagagtggaactaccctctctgctgagcgcttcagagacctgaagagacattggctgcagagagaagcaacggtccccagggcctcctctctgctgagagcagcaaacgtaggaaggaccagtagcagatagaagctaccctccccagggcctcccctctgctgagagctgaacattccatgggatgacctgcctacagagaggagttactcactgcaggtctcctctgagctgtcctaacatttaataaagctcatcttcgtcttgttcacccttcacttgtctgcatacctcattcttcctggacacaggacaagaactctggcaaaggtgccgccagccacagaggtttctggccagaaaatcaacaccctgaagatcctgtaacacaagctcaccccttctgccatatgaaaaacacagaagaagttgacagtctgcaatgggaagaaggtcctcaccagaatccaatgatgctggtatcttgatcttggacttcccaggctccagaactgagtaataaatttctgttatttataagtcacccaatttatggtattttgttgtggcaggccaaacagactaagacagtgtgctttagtctatgtatacataatccattagctcttttcctttaaaatctattgggatcactgttttgctatagacgaaaacctaaagactgtaggtttgtcaagtggcctagagacagttgagagtaaagtccatcataggtagtaatcactacactaggaaagggctataaaggggtcagaatattcctgtccactgctagaccactatcacgcagatactcagctaaggttgtagataccacctttgtctctataaatttctgatcatgtgtaaacaataataaaattgaggccccagatcatttggacaattggggttacatcaagagaattcatatgcaaatcatggtggtgacatacagaggaaaaagaaccgtctattccatataacacttaacaatttacagggaccagagtagatgttcaataaatgacacaactccttgtgcaccagagtagtcaccactccccatgtgatttggggactctgtgcttttgcataggtgtgctctgagactctaatgttttcctccacctttgtcacctgataaactctctatcatccatcccagaactcccatatttgtccttcactctctgctactcccacataactttgtacctatacttggcactaatttcaccatagatctagggaaatatttagaaacaaagcagtgaagtggccagagcagttgttttcaaactgcaggaaatcaagcgaggactcccaatcatttaagacaccagaaggaaaagctttggttcagttcctaccttagacactgaacctcagggggttcaaagcacgttccatgttctggaatgccctccttgaaattatctaaaccatttccagtgccaggtaccaatcagcaccagcagtgtcatcctggcagggtgccccagactggacagaactactagcatccctgttccttccatctgggaaactcaatggcccttcacccaagaaaccctgggacttgtggctgtggggttgtcctaggacctcatggctaggtcctattccaggagaatagcctggcaagtgcattgctctcactatctggagcaggatttctttcacaggatcaagtcagattggattgccaggatggtgctgataatgctgatttgggtttattcaaattgtttatattgacagaggctcacaaaaaaaaaatttactcgggtagaatttattactgaagtcatctggtccatggcctttcttagttgggttttagattactgattccatctccttactagacataggtctattcagattttctgttttttcctgactcagtgttggtaggtgatgtgtttctaggaatttgtccatttcatctaggttatttgatttgttggcatacaattttttacagtacactcttataatccttttgatttctataaaatcaatagtaatgtctcttctttcttttttgattttagttgagttttttctttcatcaatctagctaaaggtttgtcaatcttgatcttttcaaaaaaccaactctttatttttcattaattttttcctacatattttgactttttagtatagtcattttgactagatgagatggtatttcattgtgatttcgctttgcagctctctgatgattagtgatgttgaccttttaaatgtttgtgagcagcttgcatgttttcttttgagaagtttctgttcatgccctttgcacattttttaaatggagttgtttgtttttttcttgattcatttaagttctttataaagtctggatattagtcttttgttggatgcatgacttgcaaacattttctcccattctctaggttgtctgtttactctgttgagacttttgctgtgcagacgctgtttagttaagtcccatttgtctatctttgattttgtggcatttgcttttgagatctttataataatttatttgcccagggcaatgtctagaagagtatatcctagattttcttctagaacttttatagttcgtggtcttacatttcagtcttaattttgagttaatttttgtatatggtgagagacagggatccagtttcattcttctgcatatggttagctatttattgaatagggtgtcctttctccattggttattttggtggactttatcaaagatgagttggttgtaggtgtgaagctttatttcaggggtctttattctgttccattggtctacgtgtctatttttgtatcagtactatgttttggttactgtagccttgaagtatagcttgaaatgcagtaatgtggtgtaaggctccctatcctgttttgttctttttgtttaggattgccttggctattcaggctcttttttggttgcatacaaattttaaatcattttttctaattctgtgaaaaatgacattggtaatttcataggaatagcattgaatctgtagattgttttggggagtgtgaacattttaatgatactgattcttccaacacatgagcatggagtgcttttgcatttgtttgtgtcgtctatgatttctttcagcagtgtttcatagttctcctcgtaaagttctttcacctccttgattagcccctgctctccaattcttcttgcagcctctgtaactggagtcctgtcccctttcctcccagcccaacttcctgcactgtctgtatcaggccttgccctggatgaacccttttggctcacccaccatacacagaaggtgacagaaatcacatctcaccctcagattgcttaaggagggtacgcataccactgggaaacttggaacccatgggagctgcagttgagccaccttatagaggaccgagcacttgtggactagcctgggatcctggccacccgagtccaacacctgcagccatgtaaaactttccatggttcaaaacctcaggcttcaggcatacatctggaacacaatgctaaaattaaataaataaataaataaaaacgagctgaggactgagccgaccaaatctctagggcctaaaactcactggcctcccttaaaccttgggtctaggtttacaggttagatgtttccactgaaatcctttatacttttgactataggggaaattctatcagacctgaactcatgatttaggctatgttgttggctatctttaatgggaatgggggtggcattcatatctccttagagttatgccagaacaacaggttagtaagaactgcaacccacaagggtgggacaggaggcagaagagctacctcctggggagcaaaaagcatagagcgtgatttgccgtcttcggataccactttgcatttagttcggaacagcactgctttcaccctttccctcttctagatgataaaccagcagcgcaagagggtgcttggtttttctttcaggatctagggcgcagttcgtcagtgcctggtcacatttcacctaaataacccattccccaactccctgaatgctcaggactccaggagggtgggcaacccccatccgatggacacctgccaagtctggcctgtccatacagcactccccacttctccagctctgcaccaacacctcacgggcttgagccaccgcgcccggccgccctgcggctttttaaggcgctccccagcccacgcacgggcggaagttttgtcatctacagctttcaagtcctccattgctaagtctacaacagcctgcggttttgacagacattgctacagagacaggagccaactttcccagaagggagagaaagcagcctcgggtctccccgagatcggtggggttgctctggcagcgccccacctcgtcccggagcccacggaccaccccccccggacccccggaataagaaacggaggctggaaggtttggcagtggagcgggacgaatttatctgccagcaattccctggaaacaggattccttgcaggcgctgtgccagcgcgggcccttaagcaactgaaagttaaacgcccacgtgaatagctctgagggatcacggagaagttctcgtttcgtctgtacctatttgtattttctaaggcgaaaaaaaagttatttaaagaaaaagagaacgaacctggcgaggtccatgtctgcgcactcttcaccaagtagggggacctgagttcttttccactttcctgctctccgcgtccgtgtgcggctagcccctcgctcagctgcatttctatcgggcactcgactccccggaagtggtggcaccgcacgcgctgttatcgactctgcgcctttggaaacggtgtgtctgcgaatccaacgacgggcgcggtgactcacgcctgtaatcccagcactttgggaggctgaggagggtggatcaccagcttaggagatagagaccatcctggctaacatggtgaaaacccgtctctactaaaaatacaaaaaaattagccgggcatggtagcgggcgcctgtagtcccagctactcgggaggctgaggcaggagaatggcgtgaaccccggaggcgcagcttgcagtgagccgagatcgtgccactacgctccagcctgggcgacagagcaagactccgtctcaaaaaaaaattgacgaaggaccaaacccctaaaggggtgacattccagcttgactcgtatcccagagcagccctgctgtccccttgcttgaaagcgcagttgacgccagaaaccgggggagagcagctactaatgcacaggggaggagggaggtgcgaggagcgggttgctctcagagagacagagttgaacaactaccccttgcggtgtaggaagtatcttgcggccttctaggccaattagttggcttcgaacagtccagtggctcctctaactggatacagccctcctgtcacgttgctttcgtggggcccttgttatggtaattacgataatacacgtttctccagcccacacgtctaagaactgttgcgagaacccatactttttgaaatgcacacaggccaaaatgactcactaactgaggagttcaccagtctgaattgccctttctccctagctccatcccactccggactcaattaagggcctgccgttggaagtcccatctagaatcttaaggtacaggcagagtacttcttcacactgaatgagcacatgcattgaaagtatatagctggccgggcgcggtggctcaggactgtaatcccagcactttgggaggcagaggcgggcggatcacctgaggtcaggagtttgagaccagcctggccaacatgaagaaatcccgtctctactaaaaatacaaaaattagccgggcgtggtggcacgcgcctgtaatcccagctactcgggaggctgaggcaatagagtctcttgaaccggggaggcggaagttgcagtgagcccagatcccgccactgcactccagcctaggcgacagagcgagactttgcctcaaaaacaaaacaaaacaaaagtacatagccgtgcttttcttcatttcatctgattctcacgccagctctaaggaaacagcttcactgaagtgaggaaactcttcttcagtcactgacttacaaaatggtagtgcagggattttcccagaccaccaagaaggcatccaagaagtaagcaaaaaagattacgacgtcgttcctataccgtggcagtggctcacgcctattatcccagcactttgagcggaggagacaggaaggtcgcttgaccccaggacttcaggactagcctggcaatataaggagacgtcatctctacaaataattttttaaaataaccgggcgtggtggcagtgcacttgtggtcccagctactaaggaggctatggtgggaggatcacttgaacttgggctgttgaggctgcagtgagccgtgatcaggctactgcactccagcctgagcgacagagtgaaaccctgtccgtatatatatgtacatatatatatgtaaaatgaatgcagcaatataccccccaaaattatattaagaccaacagaggtttactctcggtatccaagagtgatttagatgtgaaaatcaatcggcctattcactgcattaatgaaaaaaggaacatcacatgatcatttcaatagataccgaaaaagcatttgactcttgaaagttatcctcagaaagaatacatatgacgtctgcacttattccatagatcaaaacaagtcaccttgccaagcctaatatcaatggggcagaaaactgtcatctacttccggagaggaacaccaaccttgtggaatattatgacagtttatacagcacagcatcttatgctccaagtgggacaaaaatcccacaaccagtcatgatttttaaaaagaacccttagcaaattgggaatagaaagaaatatccgacatccagatcctcaccacgaacacttccaccacctcctgttccctctccctccaaagcggcgccgtagccaccggccccctcctccccagtgccccaggcgcggagcagaccgccggcaacctcctctacaccacgccgcagggaccctccagcagagccgggctgctgcagccaccagcgctgggacgaggcggcagtggccctctggcaaagtgaagtctggagctaggagaaagcggtcatcagtacctctcggatggttcaaaaacccccaagggcaaaggaagagctgcactaagaagtccagatactccaaaaactccaaaatctacctcagaaaaaacacggtacgatagtctcttgatctgctcaccaagaagttcattcagctcctgaaccagtcacccgatggggtcttggttttgaacaaggcagcggaagtgctaaaagtgcaaaatagaaggatttatgatatcaccaaagctctgaaaggcatccatctcattaagaagaagtctaaaaataacgtccagtggatgggttgcagtctgtctgcggatgggggcatgctgacccagtgtcaaggcctgtcaaaagaaatgaccaagctcactcaggaagagaagaaattagatgaactgatcccaagctgcacgctggacctcaaactattaaccgaggattcagatcgtcaaaggttagcttacgttacatatcaacatattcgaaaaattagtggccttaaagaccaaactgttatagttgtgaaagcccctccagaaataagacttgagtgcctgactcaataagagagcctacaaatacatttggcaggtacccaagggcacattgaggtttacttatgtccagaagagactgaaacacagtccaatgacaacaaacaaccaagaccccaatgggaatatccttaaacccacctcgttggtttcaaccaactcaggacatagcgattgctcaatttctatgggaaacctttctcctccggcctccccagccaacctcttacagcagactgcggaccaaattccttctaatcctctagtatgaccatttgtgaacttactgcctcccctgctgcaagatgaccatttgtgaacttactgcctcccctgctgctcctcctgagcctcggggaggaggaaggcatcagcgatctctttgatgcctatgatttggaaaagctcccactggtggaagacttcaagtgtagttgattatgcttcatgtgaactctccttaaaaaccaatttttttaaatcatggaaccagaacatatgtcatgcaatgttgtcccttcctactttcttcctccaggagagtatcatgaagtaaactacaaacttcagaagaaagctgacattttcatgaattttttaaaaattaataaacaaattgtctaaacgcacagttgcaggctcccttgggaaagccctgctttgctacaggctccaagatctcctggctaggtcagcaagtgagaaaatgtacaatcagttgtctctcaccccgacttttccttcctccttcctccccggattggcttgctgtgcctgagggatgggctgcagaatggggtctggccacctggcctgctgggaaacagcaatcttccttaatagcatttcaagccatgccttctccacagaatgcatgtctttgaggtctgctgatatggaatggaactgcagcaaatgcaaacttgaagtcatgcaaaagtatgaaatgaatttcttcagctcttcttaggaatattcaaattactgtcataattcagtttaagctatgaactgtgtgtcccagtaggaggtcaagaagatctccacaggcttctggatgaagaacctgttttcaaatatacttgttgcagatacagaagactagtagagttctgccactctaagctgttgtggattttcctgtctccatgaaccactcccattcccctgtccccaatgtgtttgtgagtttctagttgatttgtagcaaatgcctacttagttctttgtggattgttttgaactttttatttttttagctgccatttaagcattcctgtggcacccatcaccatttcaatttaattgtttactttgaagcgatttttgcaaattcacattacttcagcagagggagagaacctctactgatcagagcatctaaacctgtgtgatctaaggtttatcagcttctgcaaggagctttgtcccaccatgcttccattcccagaaggaggagcttggagcgagtcagtcctggggcttgctgacatgggtgacccattggaaaggagaaccaggttgggtgacttagccccaaggagcagcaggcatgggtccctccatccttgggcttcctgggcccctgtgatgggggaaagggctctcttataccacactcaaggagaccacttctcaggatggagtcagatggagagacctctcgggagaaagacatccccgttgtgtgagtggcatttccttaagctggcaggaacggggagctcccactgtgttgggggctggaatagttctggccagaccccgttccccttcctctatgaaggaataagttggaccaagggaagttgggggcgtagaaaatgaagcaaaacaattccagggtgtctcccgctttactcttcaggaatggtgtcccaagttggaggttttgtgtcagctgcaaatcctaccagttatgtccaagaatggctttccctcgggcaggtggcagtggtcatctcccactgggaatatggcgtagtatctccggtccattccttggatgctaaggactgtgggaatgagggggtcagataaagaacaaacctcaaaacaaacaattaaattgaaatgttatgtgcctgacccaatggtaggcacatagtaggcactcaactcatatgtttaattgaattgaaaatatcccttaggggaaaaaaaaaacacacacacacacaagcaaaaaaccacaagagcctcagccagtttactccaggtagatttccacaatatgcaaagtggtggtggggtcaagacaggtgacaccagcactttaaattctttgtgtgggtatgcgtgggtgtatgtttgggaagaaaaacgaaggtgcagactatcttccttttttcttcttcaacctccatccctggcttcctcccctcacacacactggacttggtacaaaatgtcagtgtggtcctagaggaagcattggggtgggggagggagagggagctttgtgtaaagtgcctactggaaatgcactgtggggtttttcctgtatgggaaaccatttatgccaagctttcccctatttcccaaatttatatcatctggttagctgcctctgcttccagctttgtataattctctttgccagctgcacaaagctgattttctccaaagtctaaagactgagctcacctggctagattgttgtgtgttttgttgaaattgttcataatgtaatgccgtatttattgttttaaaaatgaaaggaatactaataagtcttaaaagttccttcatgcctaagattttttccagttactgggcttaactggtgtacattaattagatgtccatactgtattttgtttgcatcaagtaattttctttttgacttagtatctggcacacaaagtgggttagtactacagtatttgcattactttaagtacaaagttaggtatgtgcttatatgtacagagttgtgcatagcaatcattttatgtaagttgacatgtagtctactcacattttcatttttagcagttttgtacaaaaatagcaattaatttgtaaacactaccagaatactttctagatggcatgtaattttttaagagtgttattttgtttttgtttttgttcttagttgtggttcttcttttcatttttgttgtacgtgtagatctgtaaataaaattgcagtattcaaagcttaagctttcgggaaaaagaaaataagaattcagtgtgtgcatgacaactcgtgtgtatgagaaggagggatttgaaggaagatgacttgcagagtaagtcgggtagcagttgtcagagtgtgggaatttattttcctacggggtacgtgattttgtaaaaaggaagtatttctcccaaaattgggagtaggcaaattactaatcggtttagctttgtgttgtatgctagtttaaaaaagaaaatatgtaatataatgtaaaaaaaaaacaacaaaaaagcttttatgatggattttgtaaacagatttgttacagggtgacctgttctctagctgtgatcttaccacttcaaatgggtgtaatttgaataacttttgtatggtaaaggatcaataaaatgattttttaagaaaaaaagaaatatccttaatctgttaaagattatttataaaataaaaacttttaaaaaatcacactcagtgaggaaatattaaaaactgtcccatgagttttaggaatgaggcaaggatactctttactttcactcccattgcagcttgtgctggaggccttgggcactgcactaaggcacacagagctgaagaaccctgaaaaacaataaatctctaatacgacagcaatgtgccagggcacacaaatagaccagcagaccaatgggacagcagagaggatccagaagcaggcaatatatagtcagctgatttagaatgcaggaagggagcaagctggagcaggggagggaggggcttctgtggtgggaggactggttcagggccaggactggggtgaggagagtgacgcagggccaggcaaaggcagagttggatcctgtctttatttaacatttttatgttttatttatcaccgatttttgcgttaattttattaatttatttattttatttatttatttatttatttatttatttattgagacagggtctccctttgtcacccaggctggagtgcagtggctggatctctgctcaaggcaacctccaccacccaggctcagatgatcctgagccactggagtagctggaactacaggggcgccccaccacactggctcatttttgtttgttttctgtagagagggggttttgctatgttgcccaggttggtctcaaactcctaggctcatgcaatctgcccgccttggcctcccaaagtgatgggattataggcatgagccaccacgcctggccgcattaatttcgattttttaaatattgtttatcttgttcactgagaggtgatgtttgtttggtgtccccttcaattttggactagcaagtgcttcactctccttaaacagccctccccataggttcattgtcttaagtgccgtgatggtttcaagggtttctaggtaggtcaatttccttcatattatacactttaaatacgtacagtttcatgtatgtcgattatagctcagtatagctatttttacagtaacatataaagcaatagagtgaaggctctgtgcactggcggcagccgtggtctccggcccagtttgtggcatctccaggacacaggccaaaacaatcccccagggcaacggccttggacctgagactcctgctgcaggtgtccctgctccccgcgccttctttggctctccccggggtgggttgcggcgctcagaagcttcggcccgcgcccacctccctaccccaccccacccccaccagtccgattctgctcgcgagccgcagagattggtgcccactcgacccttttcggggcaggcaaggattagaccgggatctgacaccaactggcgctgtccttcgcgcccactaacaactggtcagggtgaggacccccagacccactgggatgagggcagaatctgaagcgtgcagggtgagcgacagaagctggagaaagccgatttgaaacacacacacacacacacacacacacacacacacacacacacacacaacaaaacgccaagacgtgccagtgtctacagcgccttcgggggcatttaaattccccaccaggaaaccgagaccgatgctgaggtctcgcctattcctgggtgctcagtgaggtcgtccccacccccggaacggctgtcacagcaagcaggagagcagccctgggaactaaggacgtgaccagttaccagggaaacatcctggagacaccacctgtggtcatccctggggaatgaggttcagaactattcctcagtccaggcacggtggctcacgcctgtaatcccgacactttgggaggccgaaatgggcgaatcttatgagcccaggaaatcaaggctacatcagccgtgatcgcgccactgcactccaactttggcgacaagagtgagacccactcaaaaaaaaatagatttcttaaatgttaattatgaaatatttcagacgtacaaaaaagtgtaccaccaccagcgcatccactaccaccttagagaatgaagccccgcgtttcctcctggacaagtttccctccctccctacccttccttcttccgacttcccccctccccaccgtccctccggcccctcctttcccttccctcccctcccctcatgacctcgactcccttcccttctccctggaaggagcggggcggaagatcgagccccagcgctgccccacaaccaggctggatttaaagcctgtgcagtaggcgtctgtcttcgcggtggcagcattttcctgtcctccccaggactgggagagtgcagcgctcctctttccctttgcaggtgtatgaaagcgagatcgccttctcagccttctctttgcgcctccccagaccctcagctctccagtgattcttatggctttgtgcagggagcgggtcacccattcagcaaaaagtcaccaagggcccaaaacgttttgccagagaaataggatggctgaaaatgttaccctaatggtacaaatggaataactctgtaggcgcacataattacctgtgttttcccagggcatcaaaagccactgtaggctgggcacggtggctcacgcctgtaatcccaacaatttgggaggccaaagcgggaggattgcttgagcctaggcagcctgggcaacaaagctagactcctgtctctacaaaaaacaaaactagaccgagcgcagtggctcacgcctgtaatctcagcactttgggaggccgaagcgggcggatcaccttaggtcaggagttccagaccagcctggccaacatagcgaaacctagtctgtaccaaaaatacaaacattagctgggcgtggtggcacacacctataatcccagctactggggaggctgaggcaggagaatcgcttgaacccgggaggcggaggttgcagtgagccgagatcgtatcactgcactccagcctgggcgacaagagcaaaactccatctaaaaaataataataaataaaataaatataaaaataaaaaataattttttaaaaaagcaaaaaacaaaacaatgagccacctaggcttagtagcactgtctgtagtcctagctactcaggaggctgggcagggaagactgcatgctaatattcatttccattataacccaatttagtggaaggccacgtttacattctcatactgttctatttagtgcaatgaatacactcatctgacttggtaataaaatgtagttattttagaagttccaaagcaatccgacagtcttgaaaacgccttctttgcattttcaaagaaaatgtttatttcacaccagggagaatcagggagaagattcaaaagcattgtgtaaaccttgaattcatgaaacaattttaacaaagggtacaacttcagaagcattaaatttgattgtcttgtatttttgttactaaataatactaaaaccctctcaatcttcgtgaaaagtcttagtaaggaaaggattcttgggccaggcgaagtggctcatgcctgtaatcccagcactttgggaggccaaggtggaaagatcgcttgagccaggagtttgagaccagcctgtacaacatagcgagaccctggctctaaaaaataataataattaaaataaagagtcacagagcggccgcccagagcggcggcgagggcggcggggcgcggggctccaggacacagctgagccggcggtcagagcgagacctgcagcagagacgacggaggcggaagcatctcgatccgggaggcggcggcgtggggagccggggccgcctgggatgttcagtcatgaaatgagtgcgtaccgaggagatccagatggcagtgtcctgctacctcaaacgctggcagtacgtggactcagacggtcccctgaagcaaggactgcggctgccacagactgctgaagagttggcggccaatctcacggtacacagagaatctcattgtgccgacatagtgtctgcagtcccttgccaggcagagccccagcaatatgaagtacagtttggacgactgcggaattttctcatcgattctgattccccgcatagccacgaagtgatgcctctcctttatcctctctttgtctgcctccatctcagcctggtccagaacagtccaaaaagtacagtggaaagtttttacagccgcttccatggaatgtttctgcagaaagctagccagaagggcgtcattgagcagctacagaccactcaaaccatccaggacatcctatctaacttcaagcttcgagcattcctagataacaattacgtggtccatctccaagaagacagctacaactaccttatccactacctccaaagtgacagctatactgccctgtgcaaaatgtttatcttacttattcatcttgatgtgcagcctgccaagacaacagactaacagctgtatgcaagtggcagctcctcccgcagtgagaacaattacttggaggcccctgatatgcccagccctattctgcagaacgatgctgccctggaggtcttacaggagcgcattaagcaagtcaaggatgggtgtccctccctcactaccgtctgcttctataacacctagcagctgttgaacactgcagaaatctcccctgatagcaagctgcttgctgctgggtttgacaactcctgtataaaactttggagcttacaatccaggaagttaaaatcagagtcctgtcaagtagacatgtcccgcatccatttggcttgtgatattctggaggaggatgtgtgaataccgttttttcttccctgcacctgccttcctaatttgcttagaatgtccttaccaaacacgacatatcttagaatggacttcctaattttcctcatcatatagctaaagccagactaatgccatgtaacctgtagccattgaattcctgcacatgcctaacctaaggtgtaaaaacaatttttagcaacgtaacttaacattattaatgaatggtagtatttatactatctgaaatgtggataacaaccctaagcctaattaaagacctttagctaataatgactttagctgagatttgcagtaaatatgcacttatgtgtgcgtacatttgctcaggtataaataattagaagtaagattactgagtcaaagggcctgcattgtaaactgtaatgaatattgcttttcccacagaaggttgtgccatttcacagtctcagcagcagtagtgagaacactgctgtccctgcaccctcaccacactggatggtattgcctttctgaggccagtccgtatcctgtggatccatgtaccccagggtgttcccagaccccactttgagaagtaacacaggaagtagagttgctagctctcccctgtcagtcagtgttcaaccttttttggtttgtaaccatttagtcattgaaaagggcaggcgcagcttgggtttcaggtcactgaaaatcactaccttagaaaaaaatgtaggccaaggaagatagaaattaaacttcacagagttaactttccttcagagtgttcctgcgaaagctgtgggccaaaatatttttgtcttatcaccactgaaattcaggtagctctgcctcatgttactttggatggaaaattctttatacgatgttaaaaacttaaggatcaaaaatatcacgctaactaagttacagttaatgataaggatatcaagaatattcggtgtgctaaattaagccattgttttcctgtttctgttttctgagtctgcgtccagttagtatggcctttgaatttttgattactgcaaccgagacagtataattcaaggatttccttatgatgagtaaagagtctgattcctacgtagaagctttaatttctagtattttttttaaactaagggaggagaccacccctcatattgtcttatgccaatttctgcctctaaagaaagaagaagtaaaaactaaaaggcagaaatgaaatccacaggcagatagcctggcgccatgcctcaggcctggttaaagatccacccctgacctggccaggcgcagtggctcacgcctgtaatcccaacactttgggaagccaaggcgggtggatcatgaggtcaggagatctagaccatcctggttaacatggtgaaaccccgtctgtactaaaaacacaaaacattagctgggcatagtggcaagcgcttgtagtctcagatactcaggagactgaggcaggagaatggcatgaacccaggaggcagagcttgcagtgagccaagattgtgcctctgcactccagcctgggtgacagagcgagactctgtctcaaaaaaaaaaaaaagatcgacccctgacctaactggttattttatctatagattccagacattgcatagacaagcactgtgaaaatcccctgtgctgttgtgctccattctgattaccggtgtatgcagctcccagtcatataccccactgcttgctcaatcaatcacgaccctttcacgcagactcccttggagttgtaagcccttaaaagggacaggaattgcttactcggggagctcggtttttggagacgtgagtctgccaatgctcctagctgaataaagcccttccttctacaactcagtgtctgaggggttttgtctgtgtcttgtcctactacattgcttggtattctgaccagaaagcgaggtgattaacagacatggtctaggcagccccttaggcagcttaggcctgctctgtggagcatccctgcaggggactgcagccagcttgagcaacatggatcctgagagcactcctgggtaggcattttccctggtggaatgccttgttagagcagagcatggcagaccccaatggaggatcaatatggtggctgaacaccaggaggaactggcacttggagtccggacatctgaaacttggtaagactggtctttagaccttgcccactccattttagtggaagcatggcctgatcacccacagcgtgcctgtaccggcactttggtttttgtttttgacttgacttggattgcttgatacttcggttttggttttgacctggcttggatttcttgatactctgattttggttttgattctggtttggtgtaaactgtaaaagtgcgtgtgtgccctttttatccgttctttgttttgtggtgtgcatgaggtgtgagtgtggtgttttgtctcaaggaagcatgggtcaggcacaaagtaagcccaccacactaggaaatatgtggaaaaatttcaagaaaagatttaagggagactatggagtactatgacaccaggaaaacttaaaactttgtgtaaggtagactggccagcattagaggtggccatcagaaggaagcctggacaggtcccttgtttcaaaggtatggcacaaggtaacttgtaagccagggcacccagaccagttcccatacatagacacttggttacagctggttttagaccaccccccacagtggttgagagaacagcagcataagcggctggcagaggcaaggaaagaccagcagagagagagaaaggaagagacagagagacaaagagggagtcaagaagagagagagagaaagagaagcagagagagaggaagagacagaggcaaaaggaaagtcaaagagagagagagagacagaaagtcaaagagagagacagagaaatatacaagtagttaagaaaaaaaaagtgtacactattcctttaaaagccaaggtaaatttaaaacctataattgataattaaaggtattctccataagcctataacactccaataccactttgttgtcagtgtaaacaagggggtatcccaaaagcactgaggccttcctatcaaaaatccttagccctgtaacctatggatggcccaaatgcattcaatctgtagtggcaactgctttgctaacagaagaaagtaaaaaataacttttagaggaaacctcattgtgagcacacctcaccagttcagaagtatcctaaggaaaaaaaaaaaaaaaaaaaaaaaaaaacgatgatttaacattaaccactgaaaattcccttaacccagcaggtttcccaacaggggatctaaatcttaattaccatacaaaggtccgaccagacctaggaggaactcccttcaggacaggatgatagatggttcctcccgggcaattgaaggaaaaaaaaaaaagccatctataccaattctaagttagtttggactaaacaaggtcttattaatagcaaaggataattgaaatcccaaacttacaaggttttcaacaaaagtaaagtttactaaaagttaacagtgtaacatgtattatagtaacctgtaatcttgtggccttagacagtctagtccacagacataaaggaagtttgctttggaaaagaacggttatcttcaggaaaaaaaggggggcagaatttatgcaaaaataatgttatatggtaaattcttgtcctgaaataaattaaccggttgtttaaagaaagaaatgtttgtaataagtcagacagctgaggcatgttgaagaattgtctgtgaaagtcgtgaaagagaaaaaaagttataaaaaaaagtgtgttagaaaaagaatttatgcaagaaatgttgtataatttaaaagtaattaggcctcctgaatgtaaaactattgaagagacagttttgtgcaaggtgtataaggaaagtaaagtatacctttggtaaagggattataaggagacataagaatgtggactttttacctacattaaagggttaaaaaaatgttttaaaggtttaagcaagttttcaaatgttagttgtgtgtaaattctgtgtgtaaatatattagctaaagttaaaggggtatcatccagtttttctgagaactggacattaaagtaaaaacacaacaggtttctcttaaagcactaacctgctctttaacaaagattataaaaggttaaaaagagtctataaaaatcttacctaatggtccgacattaaaaattgaataaatatgcctacaaagttttattaaaactaactttaacattaatagcatactaatataaaggtgaaatttagcttatctggtataaaaatcatacaagaagaattgtcaaatataaaatagtgtttggcttctttggtctaaaaactaataaaaaataggtactaaaggaaatttcgtagtagaaaggcaccaaggactataaagtccactgccgatgtccccacatttaaaacaaaaggtcaatttctttaaaaaataattacatacttgctttatcttccactttcctttccctcaaaactaaaagtcttttagcacatgtaccacccctagaatttctggtaaacccgcaccagcctgaagatcatgttctcatcaaagggtggaaagaaaaaaactcgagccagcctgagaaggaccctaccttgtgctgctatccaccgagactgctgttcatacagcagaaaaggaatggactcatcacacccaagccaagaaagcaccaccccctccagagttgtgggccacagtcccaggagaaaaccctacaaaactaaagctaagaaaagtttaactccttcttctattctatcgctctttcttctttcttcactctatttctgaccatctagttattaacataaccaagtcaattttgcctcaaactattgcatttaatgcttgccttgttataccctgtggggacttgccaagtcaaagacagctctctacttcagaaaagtacctctgtccctcctgactctcctcagactgggcattaataaattgggaccatttaatccagggagattttgattaaaaaccccagtgtcaatcaggagtcttgccccccagtagagagtttttatgctgtagttggtccaatgttctgtggaccactaaagagcaaggatggactgccccaaccggtttttgtaatttcctaaaatcatacattcattttactagaggatcatagacgttaaagactgaaaacaaactttggcaattaagcaggatgccaagatgcaaatgcctggttgaaatggatcaaatattctgtccacacataaaacaaaagcaattgttatgcttgtgcacatggcagtccagaggcccagattgtcccctttccactggggtggtcctccagtcgaccaggcatgggctgcatggtagctcttttccaggattctacagcctggagtaatcagtcatgccaagctccctctgctatatcccaaagtccagcaccctgtgggtcagcccccaggggacatccagcttccatctcccaacactaagttcacttcttgtctctcacgacagggaggaaacttagccttctttggagacctgaagggatgcaatgagcttaagaattttcaagagcttatcaatcagtcagcccttgttcatccctgagcagatgtgtggtggtattgtggtggacctttactaggcactgtgcccaataactggagtggtacttgtactttagtccagttggctatccctttcaccctggcatttcatcaaccagagggaggaaaaataagatatcataaagcaagagaagccccttatgggtctttcaactctcacgtctatttagatgcaattgaagtcccatgaggaataccagatcaatttaaagcccaaaatcaaatagctgcaggatttgagtcaatatttcggtgggtgacagttaataaaaatgtagattggataaactacatctgttaaaaccaacagcaacaagcttttcatgagttaaaagaaaaactcatgtcggccccagccctggggctacatgacctgacaaaatctttaacactatatgtgtcagagagaaaaaaaagtggcagatggagttttgacccagactgtggggccctggctgaggcctgcctacctcgtcaaagatctagatggagtttctaagagttggcccctgtgcttaagagccttggcagcaacagctctgctagcacaagaggtggataagctaactcttgggcaaaacctaaacttaaaggccccccacgctatggtgactttcatgaatacatcattggctaacaaatgctagattaaccaagtaccaaagcttgctatgtgaaaatccccgcataaccattgagttttgcaacaccctaaaccctgccaccttgctcccagtatcagaaagcccagttgaacataactgtgtagaggtattggactccgtttattctagtgggaccaatctccaagaccacccttgaacagtagactgtgagcggtacatgaatgggagcagcttcgccaacccctgtaaagtgactctgaagaagacgagaagccctgctccagtcacacccagaagctaactggtccacgcatggctgaagcatgagaaaactcttcatgggactcattttccttaaaatttggacttgtatagtaagtacttcaactgaccttcctcagactgaggactgttcccagtgtatatatcaagtcacagaggtaggacaaaaagttgctacagtcttattttatgcttattgtaagtgtactgggactgtaaaaagaacttgtttgtataatgctattctatacaaggtatgtagcccaggaaatgaccaacctgatgtgtgttatgacccatctgagcctcccatgaccacagttttaaaaataagattaagtactgaggactggtgggggctcataaatgatatgagtaaagtgttagccaaaacagaaggaaagaaaagggattcccaaacaagtcaccttgaaatttgatgcctgtgctgtcattaatagtaataagttagaaacatgatgtggttctcttaattaggaaagaggctgtatggcagaaaataagtacatttgtcatgaattaggactgtgtggaaataaatgtagatactggtcttgtgtcatttaggctatgtggataaaaaataaaaagaatcctgtccaccttcagaaagggaaagtggcccttcctgtaccagtggtcagtgtaaccccttagaactagtaataaccaatccccttgatccttgctgaaaaaatggggagcatgtaaccctagaaattgatggggctggactggatcctcgagtaaatatcgtggtttgaggagaagtttataaatgctctcctgagccagtatttcaaatcttctatgatgaactaaatgtgccagtaccagaaattccaggaaaaacaagaaatttgtttttgcaataagccgagcatgtagcccagtctctcaatgtcacttcatgttatgtatgtggaggaactgtaatgggagatcaatggccatgggaagcccgagaattagtacctacagacccagttcctgataaattcccagctcaaaagactcaccctgataacttctaggtcctaaaagcctcaatcattagacaatactgtatagcaagagtggggaaggacttcacccttcctgtgggaagactcagctgccttgggcaaaaactgtataatagtactacaaaaacagccacctggtggagttcaaaccacactaagaaaaatccatttagttaattcccaaagttgcaaactgtgtggacccacccagagtcccaccaggactggacagcccccactggattatactggatatgtgtgcatagagcttacaccaaattacccggccagtgggcaggtagttgtgttattggcactattaaaccatctttcttcctactgcccataaagacaggtgaactcctgggcttccctgtctatgcttcctgcaaaaagagaagcatagctataggaaattggaaagatgatgaatggccccctgaaagaataatataatattatgggcctgctacttgggcacaagatggctcatagggattccagactcccatttacatactcaaccaaatcatatggttacaagctatcttagaaataatcactaataagactggcagagccttgactattctggcccagcaagaaactcagatgagaaatgctatctatcaaaatagattggctcttgacaacttgctagcagctgaaggaggggtctgtaggaaatttaaccttactaattgctgtctacacatagatgatcagggcaagcagttgaagacatagttagaaatataacaaaattggcacatgtgcccatgcaagtgtggcatggatttgatcctggggccatgtttgaaaaatggttcccagtgctaagaagatttaaaactcttataataggagttataatagtaatagaaacctgcttactgctcccttgtttgctacccatacttcttcaaatgataaaaagcttcatcactaccttagtttaccaaaatgcttcagcacaagtgtactatatgaatcactatcgatctgtcttacaagaagacatgggtagtgagaatgaaagtgagaactcccactaatgagtgagattctcaaagagggggaataagggaggagaccacccctcatattgtcttatgcccaatttctgcctccaaagaagaagaagtaaaaactaaaaggcagaaatgaaatccacaggcagatagcctggtgccgtgccctgggcctggttaaagatcaacccctgacctaatcagttacgttatctatagattccagacattgtatggaaaagcactgtgaaaatccctgtcctgttctgttccgttctgattactggtgcatgcagcccccagtcatgtaccgcctgcttgctcaatcaatcacgaccctttcatgtggacccccttagagctgtaagcccttaaaagggacaggaattgctcactcggggagctcagtttttggagacgtgagtctgctgatgctcccagtggagtaaagctcttccttctacaactcggtgtctgagtggttttgtctgcagctcatcctgctacaagacggtgtctcactctgttgcccaggctggagtgcagtggcacgatctcagctcactgcaatgtccgcctcccaggttcatgccattctcctgcctcagcctcctgagtagctgggactacagacacccgccaccatgctgagccaattatttttgtatttttagtagagacggggtttcaccgtgttagccaggatggtctcaatctcctgacctcgtgatctgcccaccttggcctcccaaagtgctgggactacaggcatgagccactgtgcccagcctaatttctagaattttatagtactctccaaaatatttttattacatttatatttgaattttcaaacttctcttttccttggagacagttctcttttccttggagacagtttttctgataaaactgaggaatattgcctgcattttctttcagttttctgtaaatacaaaaaataatatttatactgaccttattagctttgatgatacagagtttgggattattctgggcattaaaaattaatattaaggaagatagcattatgacatcttgtaacagtagaccaaaataaaacattttaagactctggccactactgaaaactagctctgtgacttgtcctatatatatttctgggtattatctgaagactcaaaagtgaggaacagagtgaggaatcccaggaactgaaagaaattaagtatggctggagttaggagaagggctaagacaggaagtgatgtgatgacagtgtcttatatgagcaattatgacagccaaactaaggtagtgacagtggaaaaggaggcatggatggactagagaagagctcagttattagattactgtaggggatgagggagaggaagcaccaagggtgacgtttgtgtctcaggcttaaacagttggatatccatcaagaaaagagcaaaagatgtcattggaatggtggttttgtttaaatacttctggctttccaccattgttcatattgaaagtactgcagatgctcgccagcctctgccttttttaagaataaactttttttaaactaaagaactaaagctgagattcttctgttctgttgttgaggggcttcctgtgtgggatttctgcatgcccgcccatttagtcacagcaatttgggaagttttctctttggtttctgacaatgagcatttggggggaaagccaggcataaattagttacagtagttggtgtttaatgtttctccagtgaaaatttggacttttattttttccttgtagaacgcataattaaaactcatagtattattttgaaatgaaatattaaatattttaaaaaaagagactcttttttttttttgagacagagtctcgctgtgtcccccaggttggagtgcagtggcgtgatctcagctcactgcaagctccgcctcctgggttcatgccattctcctccctcagcctcccgagtagctgggactacaggtgcctgccaccacgcctggctaattttttgtatttttagtagaaacggggtttcaccgtgttagccaagatggtctcgatctcctgacctcatgatcctcctgtctcagcctcacaaagtgctgggattacaggcgtgagccaccgcgcccggccaaaaaatagagactcttaatggaggagccataaactcacatacctatagaagccaaactggtaaaagcaagtagtggaaccacatggattaatgagatgataggaagtacaaaacagccatgtaagtcaaattaaaaagccagcttccactttctgctttaatcttttcaaagcaataactattacataaatcagtggatacaatatttcagcagtatttgaaatggtgttcatacccagcaattccgcttctagacataaatccaagagaattgaaaacatatgtgcacacaggcacttgtacatgaatattcatggaagcattatccacaacagccaaaaagtggaaacagtccaaatgtctatcgagatgaatgaataaataaaatgtagtgtatgcatgcagtgaaatattatttggccataaaaagaaatgaagcactgatgcaggctgcaacacggatgaacttgaaaactttatgttacgtgaaagaagccagtcataaaaggtcacacgctgttattcctattataggaaatatccagataggcacgtccatagagacagagaggagaggagacgttgccaggggctggacaaggagaatgagagtgagcgctaatggatgttgcatttctttgtgaggtggatagtggtgatcattgcacaactctgtgaatgtactaaaaattattgaattgtacactttgaaagaattaattatatagtatgcaattatatctcagttttaaaaaaaggaaaacagtaaccaaaatctcctatggaagcataaaattttctctgttaattatgccaaataaaactgaattcacagcaaaaaaaaaaaaagaagagaaaggattcctaaattatttaattactactaatatctgacctgaagttactttgaatgtcttgcttcttcatcagcactgaccatagttctagtcagattttcctatttttttaactcaaactgttgagagagagaaatggcgtatattagaaagatgcaatattgtttaaactttactactcttttgtttttacattgattttcatgtttatcttattctattttgactgtaatgtatacatttaactaaagattgtatttctcaattgtaatttttttctagtagaaaacattttaagatgcagagttcttttctttttctccaatccctttaatagtcacttaaacaattaagattgaagcgataataaaactgcatttcttacaagattttgtatgatatttgtagtatataccaattttctcataatctcttctgcaataacatttcattaatactctggtcctcaggttgtttcaacaaggtcagaaagataggcaagaagatggtaaaataaacttactcatgggtaaaaggaatcaaatatttactatgtacactattctaggttttacacactttacataaattaagtgtgacataagttctagttgtctgttaatagaaaagcatcactttgggaggctgacgcaggaggatcccttaagcccaggagttagagaccagcctgggcaagatggtgagacctcgtctctacacacacacacatacacacacacacacacacacacacacagagcccctatagtcctagctactcaggagcaggaggctgaggtggaaggatcccttgagcccaagtatttgacgtggcagtgagctatgattgtgccactgcactccagcctgggcaacaaagcaagacttcatctctaaataaaatgaaacaaaataaaataaataaaaaacataacagcaattccagggccagctaagtctatgttttacatgtgctttcactttaagtacaaattgtggaaacaaacaatgtatccttgcctaaagatacattgtcaacatggcactaatacatattttccacttccaaagttttttttgtaagtgtacaacgttagcacatggaaacattcaagctgtttatcattccactgaaatctgggttttgttatgttttgttttgtttttctgttctcacctgctgagcagcatttggccagcatcaccacagggacttggttctatcacccggtaaagttaagatgggaacagaaagtggcaattgtgtttctgggagagaatttaaaaaagagctgattttttttttttttttttttttgagacggagtctcgctctgtcgcccaggctggagtgcagtggcgtggtctcagctcactgcaagctccgcctcccgggttcacaccattctcctacctcagggacttggttctatcacccggtaaacttaagatgggaacagaaagtggcaattgtgtttctgggagagaatttaaaaaagagctgattttttttttttttttttttttttgaaacggagtctcgctctgtcgcccaggctggagtgcagtggcgtggtctcagctcactgcaagctccgcctcccgggttcacaccattctcctacctcagcctcctgagtagctgggaccacaggcgcccgccaccatgtccggctaatttttttgtatttttagtacagacggggtttcactgtgttagccaggatggcctggatctcctgaccttgtgatccgcctgcctcggcctcccaaagtgccaggattacaggcgtgagccaccgtgcccagccttttttctttaacttaacactgctagctttaaaaggtagtgtgtaattttaaagcactgaagttgtcatttaaataagaaaatgcacttggcttaatcaactgtgaaatgaagacgatatcactgccttttcaggcattagaccaaagccaattattttgagccaagtgataccaagtttatattgcactacagttttcaaggacatagtgtttctaccctctccgaacctaagttgccccctcactcctccagccaacccccctttctctgggcccgttctttcccagctgagctgtttgccccttgctccctttccctcctctatttgccctttgactgtccctctatctatatctgggctagtgcaaaaggtttcttcactgcctggtcagtcactgaccagtcaccactgcactggggtggatttgggatcctattagtaaaactgactatctggtatgtttgtgctggtcatctcccctgaaaatgatattgtgcctcatcatcaaaagtactgtttaagggataaggatggcaaacccacaaggtatctgagaaaatcctcaaatgtgtgagtcacctagtcaaatgttcacttatatatactacaggtaagttcagagatgaactgtgacttgcccgaggctgtgcagctgaccagagggagacactggaactgtatttctctttccactataccataaaaaaaaacaaggttaatgacacttaaaaagagtttgtaagtaaaccaaaatgaaatgcctagtacataggaaaagtctttgggatctccccacagatttttaggcagaatgaaagctatctgtacaatgagaaatgctgctcagttcgacagatgccaccaagtaccaacagatgccaccaagtaccaacagatgccaccaagtatccttactgtcgttctgaaactgagtctgtgactgcagataatatgtcactatttgagaataagaggtcccaccctctccattcttttcaggtcttcagtcacaaggtcacaccttactttcattgtttaacaggataaattaatcaggttgaagtaggacttaggaggtacattgaagataaaagcaaaacgcagcaaacatttttacaagtagatcatcgcggttaccttaaaagttaagtttcagattaatttacagagtagtgacagaatcataatttcagtgaaaatcaacaatagagttgtatcattgaaaaaagataaatttggaaatactaagtcaggcaagcacgcgaaattcagaatattaaaaaaggcaaggcctggttgccaacatacgttcctcagatgaaggtggatatgaagatactaaacagaaccaaatgaccgagaagctgaaagggacactttgcagatcagcaaatggactccgactccctcgttcaatacattgaggaaagtgagctcacaaagcttgattggggtatacataaatctaattcctggtgctgtttgcaactacttatattttaaatgcaaggagataattgcttagaacacattaagctcactgatttaaacaaaacatttcaagactgacacactggaaggtggtaatgttaacacagcacaacagcacacctcgcagatttatgtctaagagattaaatggaatcatcacctcaaaattttaatcctcagttttcacaaacacgatcaagtctctatcaaattttctgatttatagcataatgcactagccgtaaaaatgtgcattcttcagtttctcctacacttttctgcctatctttcaacactgagccctgggtgttttcaacataagcaaggccatatgcacattttaatctcatgttttagaaatgaacaaaatctgtgatatttcagtagctcatagtgtacttaaaaaatgaaaagatctctatcaaaatatgcttttcactgggaaaaataaatgaaccaaatggatttacacaaagtaaacattaactttggtagatttcaatgtagaatagttcataacaagcatatttgcccttctgctcaactaccaagttaagactttttcaagtattttaactgagattttattatgttgacatttgtttctcattccacatcgtctttggccaagcgccagcacttacaagtctctgattaactggtaggggctttgtcagaagcatctggatcactggtagtggaagagtttgttgtaacacttgcagtaaccactgtggctgtccacacacagcacttggatttgtcaggtggtctacacctttagctaggatctcttcaccaaagctatatctcttccaggaagaatttctggacagcttcagcatctttaaggtcagctaacttggaaagctcaactcactcctcggccagcttctgtttctttctttattctggacgcctattctttaagttggggtcacttcagtcttttgcggtcgaagtagatgcagtacccgatgaaaagggccccgaatactccagcggcgatggctccgttccgacccagcctcttccccagaacgctgagtgtggactgcggcggtgggggaaaggagcggttgcccacaaaccatccgagcacagggagccgctcagacccgacgccggcgggacaggcacttggaaagcaagatccagggttctgaagattaaaatcgttagttcatttactatatttgtgcaagtttgagagagagtcatgtgtataggattaccactgagtttatattattttctctatgcctggagagtgtttcttttgttttagtttatttgtttgttttgattttttgcttgtttgtttttgagacctattctcgttctgtcaccccaggttggagtgcagtggcgtgatctcaactcactgccacctgcgcctcccagactcaagccatcctttcgcctcagccttctgcgtagctgggattgcaggagcggccaccacgcccggcaattttttttttttttttttttttttttgagatggagttttgctctttgttgcccaggctggagtgaagtggcacgatcttggctcactgcaacctccatctcccaggttcaagcgattctcctgacccagccgcatgagtaactgggattacaggagcccaccaccacacccggctaatttttgtatttttagaagagacagggtttcactatgttggccaggctggtctcgaactcctgacctcgtgatctacccgcctctgcctcccaaagtgctgagattacaggcgtgagccaccgcaccccgccagtgtttcttaaagagttagcatatttaaagaattggatgttttgggcttaatttcttattttttccctgggattcttagagaccccctctactagatttatataaacacttagtaacatcttcaaactgatcaatataggaccatagaatttgagagacattaatatccttattttctaatatccactgaagatagtttatctttctgaggaaactatttcccttagttgtccttcacatatcactaccacttcacaagaacaaacagtttttgcaactctattacttcagcatcaaaaaggttggggtccctactaggggcatggaatcctctaagattcttcattccattttccagctccccagcatataggaacctcagtgcaccaggcattagttgtcctaaagcaaaacattccatcactttgatcagattaaaactctaaccagttctgcctttccattctggaatacgtgtttaagaaggatagaactatactccttctttttgtagtacaggatttgtcagccttgacactattgagatttgtggctggaaaattgtttgttgtggggggctatcctgtaccttctaggatgttcagcagtatccctggcctctatccaccaggtaccattaacacactcccctcaaggggtgacaaccggaaatatctccagatattatgtcccttggagggcaaaatccaccaccccctccactctattgagagccactggtctagtctaatgatgagcagattaattttaacaatgagcagacctattttaatgatccatataccagtgccatccaacagaaatataatgcaatacataaatgtgattttaatatagtaagcacatttttaaaaggtaaaaataaataagcagctttacttttaataaaatattttattcaactaaatatttccaaaatattatcattttgacacgtaatccatttaaaaatgattcatgtaatttttcattctttgtcatactaagtttttgaatcccagtgtctattttacacttacttgtcatctcaatttgcaccagccacatagcaagcactaattttctacacatggctaatgtgtgccatgggcactgcagtcatatacagtgacatcccgcaaaagccagaatagtcaacataaacaaattaagaaaacaaacaaatagcagtgagggcacagatcttggtttttgccattcttcagtaaaaggaaccagagcttcttggagaaatggctgattttagggctggggcagagaaaaaaaaatcacaagcattcctatacaccaacaacagacaagcacagagccaaatcatgagtgaactcccattcacaattgctacaaagagaataaaatacctaggaatacaacttacaagggacgtgaaggacctcttcaagaactacaaaccactgcttaaggaaataagagaggacacaaataaatggaaaaacattccaagctcatggataggaagaatcaatattgtgaaaatggccatactgcccaaagtaatttatagattcaatgctattcccatcaagctaccagtgactttctttgcagaattagaaaaaactactgtaaatttcatatggaaccaaaaaagagcccatatagccaagacaatcctaagcaaaaagaacaaagctggaggcatcacactacctaacttcaaactatactacaagcctacagtaaccaaaacagcatagcactggtaccaaaacagatacatcaaccaatgaaacagaacagagacctaagaaataacaccacacatctacaaccatctgatcttcgacaaaactgacaaaacaaacaatggggaaaggattccctgtttaataaatcatgctgggaaaactggctagccatatgcagaaaacagaaactgtactccttccttacacctatacaaaaattaactcaagatggattaaagacttaaatgtaaaactcaaaaccataaaaacgctaaaagaaaacctaggcaataccattcaggacataggcatgggcaaagacttcatgactaaaacaaaagcaattgcaacaaaagctaaaattgacaaatgggatctaatcaaactaaagagcttctgcacagcaaaataaactatcatcagggtgaacaggcaacctacagaatgggagaaaatttttgcaatctaccatctgacaaaggtctaatatccaggatctacaaggaacttaaacaaatttacaagagaaaaacaaacaaccctatcaaaaagtgggcaaaggatatgaacagacacttctcaaaagaagacatctatgaccaggtgtggtggcccacgcctgtaatcccagcattttgggatgccgaggtgggtggatcacttgaggtcaggagtttgagaccaccctggccaacacggtgaaaccccatctctacaaaaatacaaaaattagctgggcattgtggcaggtgcctataatcccagctactcgggaagctgagggaggagaattgcttgaagccaggaggcagaggttgcagtaagccgagatcgtgccactgcactccagcctgggagacagagtgagactgtatttaaaaaaaaaaaaaaaaagacatttatgcaccgaacaaacatgaaaaaaagcttaccatcacaggtcattagagaaaagcaaatcaaaaccacaatgagatagcatctcacaccagttagaatgacgattattaaaaagtcagaaaacaacagatgctggagaggatgtggagaaataggaacacttttacattgttggtgggagtgtaaattaattcaaccattgtggaagacagtgtggcaattcctcaaggatctaacaccagaaataccatttaaccaagcaatcccattactgggtatatacccaaaggattataaatcattctactataaagacacatgcacacatatgtttactgcagcactatttacaatagcaaagacttggaaccaacccaaatgcccatcaatgatagactggataaagaaaatgtggcacgtacacactatgcagccataaaaaagaatgagttcatgtcctttgcaaagacgtggatgaagctggaagccatgattctcagcaaactaacacagaaacagaaaaccaaacaccacatgttctcacttatgagtgggagttgaacaataagaacacacggacacacaaaggggaacatcacacactggggcctgtcagagggtaggggggcaaggagagggagagcattaggacaaatacttaatgcatgcacggcttaaaatctagatgacaggttgatgggtgcagcaaactaccatggcacatgtatacctatgtaacaaacctgcacgttctgcacatgtatcccagaacttaaagcaaaataaaataaataaaaaagaaagagcttccaatggctaatactagaacaatttgaggaactaaataatgtaatattgaaatataacccaaaatattaaataaatacctataagttcattcatacaagtaaaagattgaatgaatgagtaaatggagaaaagacaagtctcctatacagaagaattccaaataacttatgtataatagctacatcctctctccccacatcaaggaagtggcacttcaatccccaccctttgagtgtgaactgcacttatgacacctgagggaggaaaagtaaatacggtggatcaacctggcaaacactttctgactcatacagtcaaggttaatatccacatgataagacatgtcgatcgcatacacccctgatatgatatgatgacaattacagttcatccctgtggtcttcctcttgaaaatcttgagtatgaaaaataaaatcctaagccccccaaccactgaacagaccctctcttggccaaggggaccccagaaaaaccttaaaagttgaatttgcaagcataatggaatggcaggtcagccgcacctcattataaccgctctcttttgcagtttagacacaacaactgaccagcactcaggttaaaataaacatcataagaccgatggaacagtctcttcgtggcaataagataccaagttgtaaataggacctaaagccttgacaggcaagaattgagtcacgcgtccctacacttaaagaataaactatgttctaatagccacaagctttttcttttcttctatcagctaaacaaacactggcctggagataagcaatattaaaacaactgcagcgcatccactgccagacatgaaccaactgaccacctgctccaccagccctaactacagctttgactggacaagagactgattttagtaactttcttctgataacaagaccaccaaccatggactgcttctggctggtttcgattctgagcacttgagtgccttcttctcctgaaaagacttttgatgtgtaaggtctaattgtaatagatataaaagttaaaacatatagggtctaattgtaataattataaagtttagtctctactggctgggcacgatggctcatgcctgtaatcccaacactttgggaggccaagacggatggatcacctgaggtcaggagttcaagaccagcctggccaacatggcaaaacccgtactctattaaaaacacaaaaattagacagggttggtgatgcacgcctgtagtcccagctactcgggaggttgaggcaggagaatttgcttgaacccaggaggcagcagttgcagtgagccgagatcataccactgcactccagcctgggcgacagagcaaaactcggtctcaaaaaaaaaaaagttgtctctactaaaaagtgaccatgggacactacacacaataagcatgtttactctccatgcacatgcacaaccccctctcaggagtattcatatctcctcctataacctgctgaatatatatactgcccaagccattcagcacaaatccctgttccatcctcccttctctcaaagtgctgcctttctgtctaagcttccccccaatcaggatggccagcctgcaagttgtaacactttataataaataaaatatcttttctaaacttataaattgtgtgatttttaagttgacaacctataactccagcctaactatgagaaaaacatcagacaaacccaaaagggacattctacaaagtgcctgaacagggcttctcaaaactatccaggtcttcaaaaataaagtctgaaaaattatcacagatccaaggaagctaaggagacataactactaaatgtcatatggcatcctggatgggatcctggaacagacaagcagagtaggagaaaactgggaaatccagataaattgcggagtttagttcacagcaatgtactatggttgtgaaaagtgaaccacagtaatgtggtaatgaaagagggaactgagtgaagggtacacaggaactttctgtactatctttgcaacttttctgtaagtctatgaatattttaaaataaaaagttaacttaaattttaaaagcattttgttttattttaccatggctgggtggattttcagatctttaatagagtaagtcccagctagctaaagccagattgcagagataggcaggcaccatcaaaacccaattgagcctggcacagtggctcatgcctacaattccagcaattggggaggctgaggcaggaggatcacttcagcccaggagttcagggatatggtgaactatgatcactccagcttgagctacataattgtttttacaaaaatatttttaaattatccaggcatgatggcaggcaactgggtcctagctactcaggaagctgaggtgagaggattgcttgagctcaggaagttgaggctacagtgagtcatgatggtgccactgtactccagcctgggtgacagagcaagactctgtctcaagaaaatgaaaaatgacccgagtcggttttctttagctaaaaaaggtagaaaatggacacaggaaagggaacatcacacacaccggggcctgttgtggggtgaggggagagggagggatagcattaggagatatacctaatgttaaatgacgagttgatgggtgcagcacaccagcatggcacatgtatacatatgtaacaaacctgcacgttgtgcacatgtaccctacaacttaaagtataataaaaaaaaggtagaaaaaattaccccattgtgctctcctaaacacagtttgttgtcacagataattttaccacttaattttcaagggacaaggtgacttagcagagaaaattaaacccagattaaataatacttagagacataaggtccaactgcttacctgatgaaattcctcagaaactgactttcacaaatgtagagaattctgtgtgcctcacagtgaaacacattcctgatcttctccatgatcttcatggccatgatggtctttcctaagccaggtaagccatggacaaacaattctctgttcttgtggaagcttctggagaatatctcatactgctgggctgtgagcagatttaaaacctcatagctgcacaggtcactcaagagagacctgaagccgagcaagacaatcacgagggactgcagcagggcttccaatgtgctgggtgcctgcaaaactataggacgcagggtaatccatcggagacactgcagcctccaaagcctctgcgctgctctcaggactcaggcagaggaccttggccctgacacacacctccccagtgtagccccccatgttcaccagcttctgcttcaaagtaagggcagtgcaagtgcagtagtcctggccctgccagggctgttctatgctatcagcagagcatcacagatgactcctggcttctcctgcaaattcaggtccacagcctagcttctagagaggatcacaattccccaggagaaaggttgggtttgcttatttattaactcctctaatccttcattctgtgaggacagctccttccagagggattccagagtacatcgcaaatatcctggtagcactagatgtgaaaagaatgagaaattaggggaaggagaagaatcatactgattatgacaattagttataattaactgattaatatatttgattattaattacagatatttcaaatattcttctataaacattatattacaattataaaggaaaagaagctttgaaatatctggtaaatctcatctaaacccatgtgtttattatgcctttgacctaacctctctgagactttgctctctcatttgtaaaacaaaactaagaatagcacatttcctatggagaggaataaatgaagtaacataaagagtctggctcattgcagctgcttgaaaaagatgagtcctattccccatcccactctcaaagtgcatgaatctcaaaatgtccctgaacagtccccactaatgggggtagcaggagccttcccaggaagaaggtactcattagcacaatatttgcggagaagaggaagttacgtaaaagcttttattggcagttaattttcttcagtcctcaactaggagacccttgaagctatctctcctgaagcagaattgttgcatcacatacagatcaatctgaggctcccccccattacaaaagtcttctctttgtcacaggcaaacaaggaacaattacgtgacatgagaatatacttgtgctacagagttataaacttattttaggctgggtgcggtggctcactcctgtaatcctagcactttgggaggccgagatgggtgatcacttgagcccaggagtgcgagaccagcctgggcataatggtgaaaccctgtttctacaaaaaatataaaaatgatctaggcataatggtgcatgcctgtagtcccatctcctcaggaggctgaggtgggaggattgcttgagcccaggaggcggaggttgcagtgagctgagattgtgccactgcactccagcctaggtgactgagtcagaacttgtcttaaaaaaaaaaaaatttcaaagatcatggggtccaaagggagaaaaacaagaatgtttttgccctattgtggcagtggcagaatacaaaccagaatcaagatttgtaagtggtaatttgaaattgaaattacccaaactttactggtaattgtttattgttcattgttgcttgtgctttctcattcataccaggtgttcacacaacttgattatgcctgcaacgtggatgttagtgagtaggagatggcatctattatgacatacatctagattttagagatgttaagaagttgggggagataaataaaacccccatctccctgggacagagcacctgggggaaggggcggctgtgggtgcagtgtcagcagactttagtgtacctgcctgacagctctaaagagagcagcagatctcctagcacagcgttcgagcttgctaagggtcagatggcctcctcaagtgggtccctggcccatgtgtatcccaattgggagacacctcccagcaggggccaacaaacacctcatacaagagagctctggctggcatctggtgggtgcccctctggcacgaagcttccaaaggaaagaacaggcagcaatctttgctgttctgcagcccacactggtgatacccaggcaaacggggtctgcagtggacctccagcaaactccagcagacctgcagcagaggggcctgactgttagaaggaaaactaacaaacagaaaggactagcacatccactcagagaccccatctgaaggtcaccaacatcaaagacaaaaggtagataaatccatgaagatggggagaaaccagctcaaaaaggctgaaaattccaaaaaccagaatacctcttctcctccaaaggatcacaactccttgccagcaagggaacaaaactggacggagaatgagtttgacaaattgacagacgtaggcttcataaggtgggtaataacaaactcctctgagctaaaggagcatgttttaacccaacacagggaagctaagaaccttgaaaaaaggttagacaaattgctaactagaataaccagtttagagaagaatataaatgacctgatggagctgaaaaacacagcacgagaacttcgtgaaacatacacaagtatcagtagccaaattgatcaagcagaagaaaggatatcagagactgaagatcaacttaatgaaataaagcaagaagacaagaatagagaaaaaagaatgaaaaggaatgaacaaagcctccaagaaatatgggactatgtgaaaagaccacatctacgtttgattggtgtacatgaaagtgatgaggagaatggaaccaatttggaaaacactcttcaggatattatccaagagaacttccccaacctaacaagacaggccaacattcaaatttaggaaatacagagaacaccacaaagatattcctcgagaagagcaaccctaagacacataatcgtcagattcaccaaggttgaaatgaaggaaaaaaatgttaagggcagccagagagaaaggttgggttacccacaaacggaagcccatcagactaacagcagatctctctgcagaaatcctacaagccagaagagagtgggggccaatattcaacattcttaaagaaaagaatcgtcaacccagaatttcatatccagccaaacaaagtttcacaagtgaaggagaaataaaatcctttacagacaagaacatgctgagagattttgtcaccaccaggcctgccttacaagagctcctgaaggaagcactaaacatggaaaggaacaactggtaccagccacttcaaaaacataccaaattgtaaagaccatcgacactatgaagaaaccatcaactatgggcaaaataaccagctagcatcatagtaacaggatcaaattcacacataacaatattaaccttaaatgtaaatgggctaaatgccccaattaaaagacacagactggcaaattggataaaagagtcaagacccatcagtgtgctgtattcaggagacccacctcacgtgcaaagacacacataggctcaaaataaagggatggaggaatatttaccaagcaaaggaaagcaaagaaaagcaggggtttcaatcttagtctctgataaaacagactttaaaccaacagagatcaaaaaagacaaagaagggcattacataatggtaaagggatcaatgcaacaaaaagagctaactatcctaaatatatatgtacccaatacaggaacacccagattcataaagcaaattcttagagacctaccaagagacttagactcccacacagtaatagtgggagactttaacactctacagtcaatattagacagatcaacgagacagaaaattaacaaggatattcaggacttcaactccgctctgaaccaagcggatctaatagacatctacagacctttccactgcaaatcagcagaatatacattcttctcagcacctcatggcacttattctaaaattgaccacataattagaagtaaaacactcctcagcaaatgcaaaataacagaaatcataacaaaaatcctctcagtccacagtgcaatcaaattagaactcaggattaagaaactcactcaaaaccacataactacatggaaactgaacaacctgctcctgaatgactaccaggtaaataacgaaatgaaggcagaaataaagacgttcttcataaccaatgagaacaaagacacaacgtgccggaatctctgggacacatttaaagcagtgtgtagagggaaatttatatcactaaatgcccacaagaaaaagcaggaaagatctaaaatcgacaccctaacatcacaattaaaagaactagagaagcgacagcaaacaaattcaaaagctagcagaagacaagaaataactaagatcagagcataaatgaaggacatagagacacaaaaaccccttcaaaaattcaatgaatctaggagctggttttttgaaaagatccacaagatagatagactactaccgagactaataaagaagaaaagagagaagaatcaaatagatgcaataaaaaaatcataaaggggatatcaccacgaatcccacagaaatgcaaaccaccatcagagaatactgtaaacacctctatgcaaataaactagaaaatctagaagaaatggataaattcctggacgcataggccctcccaagtctaaaccaggaagaagtcgaatccctgaatagaccaataacagcttctgaaattgaggcagtaattaataccctaccaaccagaaaaactccaggaccagacagattcacagctgaattctaccagaggtatgaagaggagctggtaccattccttctgaagttattctaaacaatagaaaaagagggaatcctccctaactcattttatgaggccagcatcatcctgataccaaaacctggtagagatacaacaaaaaaaagaaaattttttttgatgaacatcaatgcaaaaaatcctcaaaaaaatactggcaaaccgaatccagcagcacatcaaaaagcttatccaccacagtcaagtcagcttcatccctgggatgcaaggctggttgaacatacgcaaatcaataaacgtaatccatcacataaacagaacgaatgacaaaagccacatgattatctcaatagatgcagaaaaggccttcaacaaaattcaacacccctccatgctaaaaattctcaataaactaggtatcgatggaacgtacctcaaaataataagagctatttatcacaaacccacagccagtatcatactgaatgggcagaagctggatacattccctttgaaaaccagcacaagacaaggatgccccctctcaccactcctagtcaacatagtattggaagttctggccagggaaatgaggcaagagaaagaaataaagggtattcaagtaggaaaagaggaagttgaattgtctctgtttgcagatgacatgattgtatatttagaaaaccccacagtctcagcccaaaaatctccttaagcttataagcaacttcagcaaagtctcaggatacaaaatcaatgtgctaaaatcacaagcattcctatgcaccgataacagacagacagccaaatcatgagtgaactcccattcacaattgctacaaagagaataaaatacctaggaatacaacttacaagggatgtgaaggacctcttcaaggagaactacaaaccactgctcaaggaaataagagaggacacaaataaatggaaaaacattccatgctcatggataggaagaatcaatattgtgaaaatggccatactgcccaaagtaatttacagattcaatgctatccccatcaagctaccagtgactttattcacagaactggaaaaaactactttaaacttcatatagaaccaagcctgcatagccaagacaatcctaagcaaaaagaacaaagctggaggcatcaagctaccctacttcaaactatattacaaggctacaataaccaaaacagcatggtgctggtaccaaaacagacatatagaccaatggaacagaacagaggcctcagaaataacaccacacatccacaaccatttgatctgacaaacctaacaaaaacaagcaatggggaaaggattccctattcaataaatggtgttgggaaaactggctagccacatgcagaaaactgaaagtggaccccttccttatgccttatacaaaaattaactcaagatggattaaagacttaaatgtaagacctaaaaccataaaaatcctagaaggaaacctaggcaataacatccaggacataggcattggcaaagacttcatgactaaaacaccaaaagcaatggcaacaaaagccaaaactgacaaatgggatctaattaaactaaagagcttctgcacagcaaaagaaactaacatcagagtgaacaggcaatctacagcatgggaaaaaatttttgcaatctatccatgtgacaaagggctaatatccagaatctacaaggaacttaaacaaattcacaagaaaaaaacaaacaaccccatcaaaaagtgggcaaaggatatgaacagacagttctcaaaaagaagacatttatgcacccaacaaacatatgaaaaaaagctcatcatcactggtcattagagaaaagcaaatcaaaaccacaatgagataccatctcatgccagttagaatggcgatcattaaaaagtcaggaaacaacagatgctggagaggatgtggagaaataggaatgcttttacactgttgatgggagtgtaaattagttccaccattgtggaagacagtgtggcaattcctcaaggatctggaaccagaaataccatttgacccagcaatcccattactgggtatatacccaaaggattataaattattctgctataaagacacatacacacatatgtttattgtggcactattcacaatagcaaagacttggaaccaacccaaatgtccatcaatgatagactggataaagaaaatgtggcacatatacaccatggaatactatgcagccattaaaaaggatgagtgcattgctttgcagggacatggatgaagctggaaaccatcattctcagcaaactaacacaagaacagaaaaccaaataccacatgttctctctcataagtgggagttgaacaatgagaacacacggacacataaaggggaacatcacacactggggcatatctgggggtggggggctaggggagggacaacattaggagaaatacctaatgtgggtgacgggttggtgggtgcagcaaaccaccatggcatgtgaatacctatgtaacaaacctgcacattctgcacatgtaccccagaacttaaagtataataagaaaagaacttgtccatataacaaaataccacctgttcccctaaaactattgaaataataaaaataataatagtaaataaaaaataaaatagattagaaaagaaaaaagttgaagagatggaagctcagaaacattaattaactttctcaaagtcactcaaacccatactgaaagagaaacccatactcttccgactaacattataacctcataaacgtcatctgtcacgtcttttggtaccctggctagcctcctgggtgactgctttgtcttttttttttttttttttttgagatcgagaccatcctggccaacatggtgaaaccccgtctctacgaaaaatacaaaaaattagtcaggcgtggtggcaggcacctgtagtcctagctactcgggaggctgaggcaggagaatcacttgaacccgggaggcggaggttgcagtgagccaagattgtgccactgcactccagtctggtgacagagtgagactctgtcagaaaaaaaaagagaaagaaaggaaggaaggaaggaaggaaggaaggaaggaaggaaggaaggaaggaaggaaggaaggaaggaagggaagggaagggaagaaagaaagaaagaaagaaagaaagaaagaaagaaagaaagaaagaaagaaagaaagaaagaaagaaagaaaagaaaagaaaagaaaagaaaagaaaagaaagaaagaaagaaagagaaagggagagaagttaaacttttggactatacattcttatgtagatagtgggggaaatgaagatggccaagggacgtggtaaatctgacaaatggagtaaaaggaacatcaatgattcttagtcttttttatttcaaagaacttgtatttgggagtggttgtgcaaatcaataaaacttaactgtgctatggtgagaagggggctcctaagactctcagaattgtgccacaacctgcacaatcacttttttcttttgcttgactatgcattcgtgcatgccgtgaaaacatttcgttatttgattcagtagcgcaggaaacattcaatgaaagctcacactaaacacagtcctgtcagagatactaagaatctgtctgctggggacatatggtttaggtcacaacaaattgccataacgtggcttaaacatatgtgaagaaaaatccatagccccaaatgcctatattggttaaagagaaagataaaagtagagtgaatttacagaacttagaaaaagaactagatcacaaaggaacacaaaataaagggaataataaatgtaagggcaggaggaaattgaaaaattaaaaaacaatttatttgattaattaacaagattaaaagttttgtttttccttgttttgcttttttgtctggttttccatctttttagacaacccactagcacttttatttttttcactagcatctttattattttaaagaaatgaacaaataaaatggtggttgatgcaggtgtgaaaaggaaatagacttctgagcaggaaattatgtagaaggccagatctttcatgatcttactcatatgtctgatacgtgccttgtaataaagcttacaactgtcttcttctgtattttatgaccattaaaacaaccttgtcagattatttatacaaagtgccatttgtgacatacaagctttaaagttttaatgtttattcctatggacatgttctttcaagtatagcatgccattggtttccatggataaaattttcatattggcaactctcttcttttattatatttacttatttatttatttatttttgagatggagtttcactcttgttgcccaggctggagtgcagtggcgcgatctcggttcactgcaacctccatctcgcaggttcaagtgagtctcctgcctcagcctcccaagtagctggaattacaggttcctgccaccacgcctggctaactttttaaattttttttatttttatttttttaatagagatggggtttcatcgtgttggccaggatggtcgtgaaatcctgacctcaggtgatccacccacctcggcctcccaaagtgctgggattataggtgtgagccacccagcccggcctgacaactctcttctacatctaaaagtgcaaattattttgtatgaaatagaaacctcaagaactgctaatcttttcttctccctttaagacccaaagaaaaaaatcaatacacagaaaactctagtagatttcttcctctaaaatcatacctgagaaagatttggttccatcaaaatatgtattaagaaatttgaaaacataaatgaatggtttttaaaaataggcacaggccgcgcacagtggctcacgcctgtaatcctttgggaggccgaggcgagtggatcacctgaggtcaggagtttgagaccagcctggccaacatagcgaaaccccgactctactaaaaatacaaaaattagctgggcgtggtggcacatgcctcttatgccagctacttgggaggctgaggaaggagaattgcttggacctgggagttggaggttgcagtgagccgagattgcaccactgcactccagcctgtgcaaaagggagtgagactccatctcaaaaaaaaaaaaaaaggcacaaaagcaaagcttgtttaataaaaaattgatagtgcagataaatcaataacagaataaaaagcctgagggacgttatcaagaaaaattttataaagtacctggctccgttgggattactggaaaactttttttaaaacttcaaaatcaggccaggcaccgtggctctcacctataatccttacactttgggaggccaaggcaggcatatcacttgaggccaggagttcaagaccagcctggctaacacagtgaaatcctcacccctactgaaaatacaaaaattagccaggcatgatggcaggtgcctgtaatcccagctactcaggaggctgaggcaggagaatcactagaacccaggaggcagaggttgcagtgaacaaaaatcattccactgcactccagcctggtgagaccctgtctcaaaaacaaaaacaaaccaaaagacaaaaacaaaaaaacttcaaaatcatataattatcacattattaaatatatattgtttgacacacaaaaaatggcaggctacaacattcagttttatatactttataaacaatattatggtgatcaataatattttcagccttatctcttatcatcttaataatattacattgttttacaatttgtaaacatcaaataaacagaattttatattctgcttttatcacataacacctctacaaccctttcaagttgttatgcttttagttatatgttacatttcatcaagaagatgcttaacacaatgttgtatgtagaaactatttttaaaagatgcatattaatgaactaggtacttctcaattgttgaaattgctctcaattcatacttaaccataaataatagtcataaatcatttactcaacaaatatttattggaaatctattatttgcctagcactgtgctaaatccagaaaagacagtggtgaacaaaacaaacctggtccctgttcttgaggaggttgacagtaaacaagtgactcctatggacaaaagtttagaatgtcaggggagcttagaatggaaacactgccctcacctggcagttggagagggaatgggttcagagaaggatttccagaaaaagtaacatttgagttaagatctgaagaatgcaaatgaggtgaagagttaatttggtgaagaagggggggaagaattttctagacagaagtaagaaggagtatgtcaagttcaaaagactgacagcacagagctggaaggatagaggcaggagatgaggttggaaccatgctcaggtgtccagctgtgcattgtctggtaagccactttaagggttcctggctttaccctaagagtaatgggaagctggccagacaccatagctcacgcctgtaatcccagcactttgggaggccgaggcgggcagatcacctgaggtcaggagttcgagaccagcctggccaacatagtgaaacctcatctctactaaaaatacaaaaattaaccaggctgcacctgtagtcccagctacttgggaggctgaggcacgagaattgctttaacctgggaggcaaagtttgcagtgagtcaaaatcatgccactgcactccaggctgggcaacagaaggagactctgtctcaaaagaaaggcctgggcacggtgtctcatgcctgtgatcccagcactttgggaggccctggtgggcagatcatgaggtcaagagatggagaccatcctggctaacacggtgaaaccccatctctactaaaaatacaaaaaattagccgggcatggtggcacatgcctgcagtcccagctactcgggaggctgaggcaggagaatctcttgaacccgggaagcggaggttgcagtgagctgagatcgtcccactgcactccagcctggcaacagagcaagactccgtctcaaaaaaaacaaaaagtaatgggaagccattggaggttgttaagcaggaagacacagcatcagatgaacatttttcaaagtcctttctagctgaagcaggttagagcagtcatggaaaagacctttcaggatatggtttcagcagcccaaatgagaacagatggtgatgtggactaaggtggggacagtggagaagtaggcagagttgagagagatttagaattaagccggcagagttgagagagatttagaagtaagccgagggacctggcaattgatgggaattcatgtctattatttcaattgctcctcttccatctcaatccaatggataagaaccagaatgggcccagtcactggcgggagctgtttatgagatactgcttctcaccccagattaaaaaccatagcttagccaaacattgaaagggagaaaggatccaaatgtggagagagaacctggatatatgccaaagcttaagcagccaaaagcagaaatctctatcaaggcctgggatcaagagttctgatacaggaagagctaatcaatcaagagcaaataaaaacaaagggcatagtaggaaggttaatgcttgtggtgctcctcatgagctgaaagagctaacatttattgagccaggaactgtaccaaaaactttacatacattatctcattgctttctcacaacaaatactattatctttattttaccaatgaggaaactgaggttgggggacatattcagagtcatatgggtgaggctcaaatccaggagtatttgattccaaatgctagtgtttctaatcaaaacctagactctctctttctccttttttttttttttttttagatggagtttcactcttgttgcccaggctggagtgcaatggcgtgatctcggctcaccacaacctccacctcccaggttcaagcaattctcctgcctcagcctccctagtagctgggattacagacatgtgccaccttgcctagctaatttttttttttttatttttagtagtgacggggtttctccacgttgttcaggctggtcttgaactcccgacctcaggtgatccgcccacctcaggctcccaaagtgctgggattacagcaccgcacccagcctttttttttttttaaagcaacagggtcttgctctgtcatccaggctggagtgcagtggtgcagtcatagctcactgcagccttcaccacccgaactcaagcagtcctcccacctcagcctcccaagtagctgggactacaggtgtacgccaccatgcctggctagctttttttgtttttgtttttgagatggattcttgctctgccgccaaggctcgaaggcagtggcaggatctcagctaaccgcaccctccacctcctgggttcaagtgatctttccacctcagcctcctgagtagctggaatgacaggcacgcaccaccactcccaggtaatttttgtatttttagtagagacagggttttaccatgttggccaggctggtcttgaactcctgacctcaaatgatccaccttcctcggcctcccaaagtgctgggattacaggcgtgagccaccacacccggccctggctagtttgtttgtttgtttgtttgtttgtttgtttgttttgtagagatggggtcttgctatgttatccaggctgttctcaaacttctgggctcaagcgatcttcccaccttggtctcccaaagtgctgggattacaggcatgagcaaccacatccggccaaaaatctagactcttaatcattgtgcaaactggtctcccaaattattaggcctcttggaagacaagagagttttcattactctggtaagaataaccattctggaataatctccctggtatttgtgatagcatttattttataaaacacatttgataacaagaaaaacataggtctatttctgttaaacacaggcaagcaaaagtcacatgtaaaaacacagctagacagaacatctagggccttcacaagtatctgctttaattaatgttggtaaacaaaaagacccaatgcagtgacacatttgcaaacattatatctaaatccaactagatcacagtttcccagtcaatatagcttaagtttctctgaaaacaaaatagtttatatattacgaaaaacaaaaaaacacagttgggctcagtggctcatgcatgtaatcccagcactttgggaggctaaggtgggcagattgcttgagcccaggagtttgagaccagtctgagcaaggaaatccagtctctacaaaatataaaaaaattagctgggtgtggtggtgcatggtctatagtcccagctcctcgagagtctgagacgggaggatcacttgagcctagggaggttgagactgcagtgagccacgattgcatcactgcactccagcctgggtgacagagtgagagcctgtctcaaaaaaaaaaaaataagaaaaataagaaaccccttttcatagtgatgaagcaatcagctaactgctaaagaatcttcacaggcgaggctgggtacggtggctaatgtctataatcccagcacattgggaggccaaggtgggacgattacttgaggtcaggagtttgaaaccagcctggtcaatctagcaagacttcctctctacagaaacgaaaaaaattagccaggcaccctcacgctcagtgcctgtagtccccgcactttcaaaggctgaagcaggaggatcctttgagccctggaaggtcgaagctgcagtgagttgtgatcgcaccactgcacgacagcctgggcgaaagagtgagaacctgtctcaaaaaaaaaagagaatcttcacaggcatcccttcctcccaagtctcctcacttgtcttatctgaaggtttgttccccagaactatgagaaccctctacatctctttctctcagcccagccaggttcctctgggcttgagtcctacatccctggcctcagctacaaggtgagtacagtctaaggaccagctcctctcattgtctatttcacttatttattaaaagtgtagacctaaagtgtctacttcatcctctcttgcctaaagtgggtatatctggaaaagtctgtagccacagaggagattttcatcttagagttatgaggtctctttgagagactctccattccattgaataagcatggcttagatctctctggacaatctgtacttaccttgggagttaaaagattccacagggttgagatgctgaaaagatgagaaagttccaggagctctgatctacttaggagtccctgcagtttggctgaggacagtggtaatcctcaaaggctagaaatggctttcaaatctgagcgctctgcagaacaagtccaggaaaaatgctgctttggtatttctgagaatgaaactagaaggttgccgcctttttaaagtttccatttctcagaattctcctactcattttaggcctgccattctagcctcaaggggggaatatgtgctatttcctgtttatcaatagactaagtgggccaaagactagttctggctaaagactaaagaaactttatcagaagaaatgcttcaaacactttggagaataatgctacaaaaaagcttttttggatacacaccaaactgttattaaggattactttctcagaagtagaactggagaggaagaagatggaaagggaggagagaattgttactttgtacagtaggcctgagttactcaacaaatattttttattggcaaggaaaagggaaaaaacaaaacaaaaagaaacagtgaaagagccagaaaggaaattaaacagtgcatctcactgactttctcattcaatttttatagtagcctccataatcctaatagttgttgtaattagagccgagatggattcactgctattaatttagctgctaatactgttgctattgttctgatcaagtttctgctactttttgacctgctgtctccctcaacagctgtaggagtcacaattcccttgagctcttgttggtttcttgttccattttttttgggtttctatccttatacattgaaaaaattattacagtgtggatttagcaatcatttttagctataagaaaaggtgctgtgcactagagggaattgaattagagatgtcattcgttaatcagataattagttcccaatcttggctgcttgttcaaatcttttggcatgctttttaaaaattcagatgctaaggtccttccccagacattctgaattatactgtcaagtagtggtgcaatatcaggaggtagagacatatcacatatacacaacacacacatataggcataaacataaagacagacacaaatagatcttataattttcatttaaaatcttagccatgattaggtatacataaacacaaaatttaataattttgataaaaattgattctcatctttgcctattaatattttctttcgatctcatctttccatagacatttgtttaggatgacagctttcttttaaaaaaaaatccttttagatataaaagttcaaatcttcaaaggtatacctgtcttaattgtgactcaaaaccagtaagtttttatggcttaaaacctataagccttttatcacttaaccatggatgtaagagacatccccaaggaggatgcaaaccatgcagcccttttgccgggcgcggtggctcacacctataatctcagtattttgggaggctgcggcgggcagattacttgaggttaggagttcaagaccagcctggctaatatggtgaaaccctgtctctacaaaaaatacaaaaattagccaggcctggtggtgcatgtcagaaatttcaggtactcgcgagactgaggcgggagaatcacttgagcccgggaggcggaggttacagtgaccaagatcacgccactgcactccaacgtgggcgacagaatgaaaccctgtactcaaaaaaaaagaaagaaagaaagaaagaaagaaagaaagaaagaaagaaagaaagaaagaaagaaagaaagaaaagaaaaatgaaggttcaggtgacaaacgcctcttatggactgggaccttttattaagacaaacttctctgagagctggcacaggcggacgaaaatgctgcttatcttagattttgggttccaggctggtggcctgatgcaaaccagcaacacttgcgccctctggcggcgaggaccagagagactattttaaagccaagctctcgggacataaaacgaaggaagaatcgaatctcatgattttcttccttatgacaaacaacacaaacgacagagacaaggactttttattattccttggaggctgtggatcatacccagaccaaatttataaaagttacaattcaaagaactcattcttacaaatgtttttctcctgccaatctgaatttggaaaggaagagacaaggaaaatttacgttctcctctctacagggcactgcagatagatatgtcgggggactgactttggtaagaattcttaccttctgcaggttctgtcagctcttccgggatcctacccacaggctctgaagtgagtggcgcatcccaaccttctagggtcccattttcattgccagaaaccacaagggaggcaaaattttacctctgttctcttagggattttggctaggcctgagaattaacttgacctatgacagattaacaagagaaaaacatacagatttttacatataggagcccctatagaaaattcaagacctaaagaagtgccgaaacctaaatgcttgtatagtagggtgagcaaagagtacaactgcagaaaagtaattacattaaagtatgtgtgaaggcaaagtaagataagggttattttagcaaggtctgtttgtacagaattatcctgggtatgacccccgtcaaagaatgttttttattctcctggtacagggagggcatctttcacgtgggacttttatctcctgttttaaggaagaaaaaaagattaagattcactttttgcatctgctattttctttttctttttattattatttcaacagttttggggggaacaggtggtgtttggttacatggataaattcttcagcagtaatttctgagattttggtgcacccatcacccgagcagtgtacactgcacccagcgtgtagccttttatccctcatcctcctcccacccttcccccaagtcctcagagtctattatttttatgcctttgggtcctcatatgcatctgctattttcaagtgcctttagctccaaataatccttatgccaaaatggcatatttgggggcaacacattctgccacccttcagtacctttggccaaacagaggtttgctttccagacctcctgggttctgtgactggcaactgcacaagcagggcacgctcacatgccatcttcccacagtgacccgtggggaagtgacgaaagaaggctgcttctgtcctaattgtgttgctctgttgtacagttccctaaaatgtctgcccccaccccaccccaccctaccccatattttatggaattaggtgaagagctttttcctcctttacttgcccatcatcctcttcttccctgtaggcatgagttcctgctgttcatgaaaccaattggaaagtaaggggcactactgcactgataatcttggctccttgctcaaaggcacggagaaccacctctccctaacctgcaatgtgggaaatgtctcacatactatatgggagactgcagagaagaaaggggtcaccagaacaataaacccaaacaggatatacaatggaatgtacgctatgattacaactctgctaaaatatatctgccagtggactagcccaggaaacgaacaagcaaaagtgaaagcaactgcatgattcagcggtaataatagggattgaattttcttttgtggttctctattttctaatctttctataatgtaattatatagaacttgtaatgacaggtatatcttttatgtttcttggtatacaaaatgctctcctctgaacgtttcttattatgtaagtcatttaagtaatcatattgattttgtagaaaaattttagaggctaaaaataccatcagtattctaagtgtatttgatccaagcctcagcataaaatcaaatgaattactgtcaacacagaaggagacttacgtctttaactttgatgtacaaacagaagaacatagaagctaacatggactttggagtcagacagacatgagttcagatctcagattcagaacttactagttctgtgatcttgggtaaggtattattattcatttgcttatttatttacttatttatttatttttagagatagagtcttgtggtgttatccaggctggagtgtagtggtatgatcatggctcactgtaaccttgaactcctgggcctaggcaatctttccaccttagtctcccaagtagctggactacaagtgtgtgccaccacgctctgctaatttagaaaaaaaaattatagagacagagtctctctatattgcccaggctgatctcaaactcctggcttcaagcagtccttcagctttggcctcctaaggtgctgggatcgcaggcatgagccatcgaaactggccctaagtatttatcttttaagtcatagcctcctcagctgtaaattggaactagtaagatctaaaatttattgagagctttccacatattatgctttatttaaatgtcttatttatttatttgtttgtttatttattttttgagacagattctcactctatcatccaggctggagtgcagtggcgcgatcttggctcactgcaacctctgcctcccgggctcaagtgattcctctgcctcagcctcccaagtagctgggattacaggtgtgtgccaccacacccagctaattgttttgtatttttagtagacacagagtttcaccatgttggccaggctggtcttgaactcccaacctcaagtgatctgcccgccttggcctcccaaagtgctggaatttcaggcgtgaaccaccgtgcctgggcaatgtcatatttatttattatttttagttttttagacagtatcatgccctgttccccaagctgcagtgtagtggccccatcatggctttctgtagcctcgaccccctgggttcaattgatcctcccacctcagcccccaaagtagctgggactagtggcacgcaccaccatgcctgactaatttttggggtttgttttgtggagatggggtttcaccatgttacccaggctggtctcaaactcttgggctcaagtgatccaactacctcaacttctcaaaatgctgggtttacagctgtgagccacagtggtcggcctaaatgtagtattaactttcaatcttcatctttacctgaagacgtaggtatgaattttacctctattttatagatgagaaaactgaatcttgaagaggtaaagtaacttgctcaaggtcatccagccaattaaggaatagagttggaattcaaggccagagtcaatccgacccctggactcaagctcttaacactgccttatcgtaccttactgctatacataattcaaagactggttgggggttaaaagatatattttaaaaacaatttgcaccatgtctactacatactaagcacttaatatatgtttgttgtaactgtatatatcagaggagacatcaatgggactgtaaaggtattttgatgtattagctgttgactggtggggtctgtcatatttggctggctaggaaggaagcacctgcttccttcattgtttccccctctaccacatgcctctttcaagctgtacaactgggcaaagacagccttccctgattaaagcagggataagggactttatctgcaattggcccaagagaactctgaagtagtaaacaataacaagaggaaatacattaaaaaattaaaaggtcctgttcatggtcagaggcatcttttcttttctctttgtaccttatgtcagttttaagtgaccacagattttttttaatacagtgtcgaggttatataattcatgtttctacccatagttctccaagttaagatcttctctgcagctccaggttagggtggtgagccttagtttcactctctgtgctcccttgcagcccttttagagtcacctgtttccaagatatcattgcctcttttttgtcatcagaacctgatatcagcattttgttctcttagttaatgcaacaaaatttatacgttatcagatgcagtgactggggttttctattcacttcccatcagaactaatctgaataaagtgattctttcatccaagtcaccttttcatccagtaagcccatctccaggcatttataaatataccagaaaaagaaaaggttgtatgcctgagtatgtgcctggcttaattaaattggtgtaaaattgctagtgacacgaatgacaggggaatgatcgctgaaatttcatatgatctggctaggatgcagtgcacccattaaaaatgattatattgaagactgtgctaccacatgaggaaatgcctgcattagtcagctaaagctacaaaacaaacaaccttgaaatctcagtcattaaataataagcttttatttctcattcatgcactttcagatcagctggattttggctaagctagttaggactggtggaacttggctccaggccatgagttgagttcaagttggattcacatatctcagtggctggtgggccacccagggtacattctttgtatggaaacagcagaaacccgagagagtaaacccaatgctgaaagtccatgtacagcctctgtgcacatcagaactactaacattccaagtcacatgaccaaggccacattacaggggtggaaaatatctctacctctaatgttagtaactacaaagggtatagatatagagaggtaggaaatattgggaacaataatgtagtctatagcaatatctcacaaaacaattaaatggaaaaagcacacatatacgttataaagttgatggcacaacttgatcataactgtgtgaaaatatttttccatatcaacaaagaatagaaataaataagcaaaaatgaaaaaatgttacacccagataacaagatgatttaagaactttttttttttttttttgagacagagtttcactcttgttgcccaggctgaagtgcagtggcgcaatctcagctcactgcaacctccacctcccaggttcaagcaattctcctgcctcagcctcccaagtagctgggattacaggcatgcgccaccatgcccagctaattttgtatttttagtggagacagggtttctccatgttggtcaggctggtcttgaactcctgacctcaggtgattcacccacctcagcctcccaaagtgctaggattaccagcatgagcccctgcgcccagcctgatttaagaacttttaattttgcctttctccatttccgaagcttccatgataatattatattacccttctttttaaaagtaagttttagaagcttctcacagtttctaaagcttctcttttatcttagttatttcatttagttaattgctttatccatcatattaagactttgtagaaaacattgagaattctaaaacaaccaagttagtccattattcttagtccccaccagttcctaatcttacatttgaatctaatgaactatcatcatagatccttaatttgacctgttgcctaaaaacaattgagttgcctttattgttcccttattcttcattattacagtgttaaagattattctccacactgacttctttgaaatctctaacattagaaattcatactatcgaattgaatcattgtagattctagttttctaaaagctacaagtacaattcagcaaatatttactgagcacctgccctgtgtgaggcactgtactagttgctctaggggaaataaggatgtgtaagtgactcatcctcttactctcaaggagctcacagtcttaataggaagagaaatgtgcacacattttttgaggacagaaagaacagactaggagaagggttcaatggttctcaacccttgtgacatattagaatcatttggattttttttaagagatagagtcttgctctgtaacccaggctggagtgcagtggagtaatcataggtcactgtagcctcaaactcctgggctcaagtgatcctcccaccttggcctctggagtagctaggattaaaagcatgcaccaccatgcccaactaagtttttaaaaaaattttttttgtagagatggggtcttgttatgttgcccaggctggtctccaactcctggcttcaagtgattcccccagacctcagcctctcaaagttctggtattacaggcaccagccactgcaccctgcctggacaacatttaataaataccgatgcccgagcctgtgttcagacacactgaggttaattagtctggtgtctggcctgatcactgattttttttaagtcgcccaggaaattataatgagcatccagggttgagaatcactgagttagttattctactttcatcctgattgaattgtttcactagactaagaactgacaaagactctcaaattcaatatttaaaacaattctttacaaatcaattcttttattaaaaattatatgatgcatgcatatattttaaaaagtcaaatggtactaaggcttatgactaaaatatagcaattccttgtcccactcatactccttcatactctgttgactttgactgtttaaattatttttatagaattcatacatctccctacatcagaatgtcaatgcactggcatcttttgcaaaaccgattgctgaacttcatttcctcctatccaaaactaccctaaagcccccaaggaaaggtaaaaaggaagaaacaccaggtaattagagcagtaggaagcaagggagaggtttttcttttcaacccgtgcctaggtacagactagcccttctaatgggcctaagcaattcagaaaggcagctaagagagcttctcgaaaccctgcctgctcttccacctcttggaaggctgaggggctttatctaaaatcataaccaaaatttccacatgtctcctggattcaagcctccccagagtcaatcaagttatcctaaacttttctagaagttaaaaacagtttggaaatatgaatacttccaaagcaatttaaaaatccttgcaaaagcaagagtaatttgaagagtacagaattggctcagccatttggggaactgactagaaaaggggaactttgatttcatttctaatatgtatcatatacattggaaagtttcacttagggagataataaaagtttaattgaggtagtaggcatttgaaaaaggatgtgattgccaagtaaggatttcaaaggtggaggggacagaaaagggtttaaagactgagaaaatggcacaggcacagaccaggagtcggggatgtgtgtgggtggtgttggtggtaaagttgccaccaaggatccccataaactctgagagttggatttaaaaattagcaccaagtcataatggaagaaatcagagatgtgcaaaggccccttgtaggaagactactttccaggccagcggcagagtataaggcatttctagcctacatgaatgtattcacatacatagaggataaatgtaggcaaaatttgtatatgttgggggcagtaaggagagggttggtggtgaacctggaaattttagaaaccaagacagagaaaaaaaaattcatctgagggcaaagaataatgaaaaactagtcatccttagcattctaaatttgctttagcttgtaaactgtaaactaatttgtctagtccttgtgatagaaatatctttattttagaaattattgcaatcttattttatattaagttggtgcaaaagtaattgtggcttttgcacttttgcaccaacctaatagatattgcaatagtctaatataatctgaagatttttaagatttgaatcaaattaccagcttcccttactgtaaggctatgttcatataatttggcttcctatattactgttgagggcactgattagcaaaagcatttgacccacttatgactatggtcctcactataaattaacagagtaacattttgatgtatgcattggtcctttgtgagcttgattagcataaagcatccccaagagactgatctagacttggtacaaaaaggcaatcaagttctggacctggaaagcttgagacccatagccagtatgaggtgccagtcaattggctacttttgagacctatgcagtcaaagtaaccagcctggagggcaccataccaccacccaaaaattatgccaggtgggctggggtgcatgagaaacatggggagatggagatacaataaaggatgtggttgggagagcaagtcagggcatattaatgaaagccttgaaaattggttaggtttgaaggctgtggggactcattgaagatatgttagcaaggtattacataaaatcagttctctatttgaggaaaaattctctgatggatgacagctggattgagtgggaaagctggagacaggggactaatgaagtctattgtaattgtataggtaggaggtgaaggaaattgtgaaaaggccagtggcattgaaatagagtggaaggctcagctccaagagacatttctgtggctccaggccatactgatgtgccttgatttcctcacttgtaatattaaaatggagtcactgctacctgtctaggagaaaggactctgctcttcctgtcttcctctattatttgtaataattttcagtaggctgccctcttttcataaagcaggtagaggtgtttaatggctcttgaagcaaagcagagcttatgaaattcctctgactggtcacattctggactaagcccaaacacgacagtcctctccaggcctgaaaattgctgaatactgtctaaaacaatgtgacttccccaaacaccggtggccgggctaaacacaacctctgatggtctgtgggtctcaattaattccattgctttgagtagtgcaagcctatagcgtcctctgtcctcccctctcctgcacagaattgctatatctttgggcagatagccacactggaacaggctgtgacattttcttgccacatagttagctatttgttctgttgtcagattagtctttgtctcacacaccccaggcagagcctgggcacacgttgcttcctcataggcagtctcgctgaacaatgctaatgtgtctggagacatgttggagggaggattttctttgatcctcttcatttcttctttcataaccttcgctatttccagagcacagtggatcccactggtgattgtttttcgaggaaactgagcagatggagggggaaggccattgacatctgcgtgatggatttgaaaagggtcaagaaaaagccagagaatcccatggtgaaggttttcacttccagtccccttcgcctttggatgggtgatgttcttagccttcatgtaccaattgccatatttgctgcagaaattctcagtctcatccatcactatgtgtttaatctttagaaactccccttgcatgaaagttttcctggtcacagcttggcaggtggtttgttggctgtaaggacggaaaaaacagggcttgaggcatatcaacaaagagaacaccagcagtcattactctctggaatggaatcagaggctgattctcatctgcaggctgagtcattgattcagtagtgtgaataccacaaaactgttctaattacaagttacctgacagacagaatgcataattttacaccttgctctttggggttatccagttaaacctgcatgtgaaacttctgaaatgaacccaggtaacagattgtattatgtctattagtaatccattcctactgtttggcaatcctgaagacaagttcattacatctaaaggaaatctcaaagttaacttacacttcttactaccatttctttactttctatcctctttagagctggaaaacagtttcctcgatgcatatcataatttttatgtgcaaaaaaagcacggactagttcaaattcctctaaagcttctttagattttggtaagagaaacatcaagaggatgctgagttccacgacacatcaagtagggtaccaaatctatggggctatgcctctttggagctacctcatttacttagctcaattttcctttatagtacgctttagcatatatgtattttttctgaacgaatttggttgttttttgcctcctttaatttggatccaagtaacatcactcatccctacagattccatgattttacatatgcagttcctagggcctttactccctatgccttgaatcataactatgttcttctcttctggtttggactgtgtggactcaaataaaagtactgattcttagccatctttgtatccctctcacattaagggtttcatagatatttgttgagttagccttttgactggagtattttcaaacttagctatgaaacttaataaagaacgtagtcctcagcacagtctacaggatccctgataatctggcgtctacctccttttcaacatcaccacctgctgtatacccacagtctgcacagctctagtcagacctaccattctggttctctggtgtctccatgtctttgaacttgctgtgccctttgcctggaaagccctcccctatttgattcacttctcctgctgacttcttaacagtgtgcccaatggtctccttcactggggaatatttaccaaccaacctctagcctgttaaaatgggcatgaggccaggtgcagtggctcacgcctgtaatcccagcactttgcgagaaggaggtgggcggatcacctgaggtcaggagttcaagaccagcctggccaacatggtgaaaccccgtctctactaaaaatacaaaaattagctaggcgtggtgatgcacacttgtaatcccagctactcgggaggctgaggcaagagaatcacttgaacccaggagacagagtttgcagtgagctgagatcgtgccactgcactccagcctggttgacacagcaagactccgtctcaaaaataaattaattaattagttaattaaaatgagcatgtctttattattatacaatactcacattgttttttttatggcaaggtcttcaatatgttttctcctctaacactaaatgtagcacagtagataccacatcaacagtgctcaaaaagatttattgaataacaaaaccaagccaaaaatcataatgattttgccctcttttgctgaattctataatgaccaattcattttactaaattaaaagttagagatttaaatcagaagtgaatttgcatattttctaaaattactgatgcagaacaagtcaaaaatgaaaatattttatgaacaaaatcaaactgtatttaaattcaagtttcactaggtacaatgtctaattagcagaaataccctatgactttaaaacattacatatcaaacagaaagtatacttaaagcagaatgggttcatttctacttctcttaaatgtaaggccatggattgtgagaaaaaaaaaagtttctggttctgtaaatgtaagttatgcacatgtgggttatttataatgagatgtttaaggttgaacattataaattacctgtttacagctcaattccatgattatttggaaatgtgtatatagtttgggctcttgcacttatgcaactaaggcactgcaaaaacttaaactaaaaacacaaatcacttttgtgacactcttgaaaagactgactaaatatatttttgtgtgtgtgtgcaaccaactcccagcacatcaggtgggtaactcttcccacacgaatagtctgcctaccctcaggaatattttttgtctgtggtacctcagcctatcgttgtttgaatggctcttcagaatctatatgcttcctctcattcttagcgccccctatgaccatctacactgaacaagatttatacaatcatgtcgtacctaagccccgcaacaaaagggtacccattcttccttttgttatcggagcaggagtgctaggtggagtaggtactggcactggcggtatcacaacctctattcagttctactacaaactatctcaagaactaaatggtgacatggaacgggtctctgactccctggtcaccttgcaagatcaacttaactccctagcagcagtagtcgttcaaaatagaagagctttagacttgctagccgccgaaagagggggaacctgtttatttttaggggaagaatgctgttattatgttaatcaatccggaatcgtcaccaaaaagttaaagaaattcgagatcgaatacaacgtagagcagaggagcttcaaaacactggcccctggggcctcctcagccaatggatgccccggattctccccttcttaggacctctagcagctataatattgttactcctctttggaccctgtatctttaacctccttgttaattggaccctgtatctttaacctccttgttaagtttgtctcttccagaatcgaagctgcaaagctacaaatggttcttcaaatggagccccagatgcaatccatgagtaaaatctaccacggacccctggaccggcctgctagcccatgctccaatgttaatgacatcaaaggcacccctcccgaggaaatctcaactgcagaacccctactacgccccaattcagcaggaagcagttagagcggtggtcggccaacttccccaatagcacttgggttttcctgttgaggggggcactgagagacaggactagctggatttcctaggctgactaaaaatccctaagcctagctgggaaggtgaccacttccacctttaaacatggggcttgcaacttagctcacacccgaccaatcagataagaaagagagctcactaaaatgctaattaggcaaaaacaagaggtaaagaaatagccaatcatctattgcctgagagcacagcaggagggacaatgatcgggatataaacccaggcattcaagctggcaacggctaccctctttgggtcccctccctttgtatgggagctctgttttcactctattaaatcttgcaactgcaaaaagaatatatatatatgtgtatatatatacacatatatatacatatatatatacacatatatatacacatatatatacacatatatatatacacatacatatttttgtgtgtgtgtagttggtaaaactcttacgtcacaaaatcctttagggagtcgctttcacaaacatagaggatctcttttggtttgcagtgaaacaagtccttaattttctccatgatctttatggctagggctgtcttcctgactcctggaaagcagtagatgaataattcacgtgtcttctgaagactctcagaaagcaactggctctgctccattatgagcaagttgaaaaattcacagcccatctggtcactcagaagagatctggaggacagggagaccaccaccagagcctgcagcaagtcttccatttcctcctcatcagcaagcctgtaggacctggggtaacgcagggggatctcaccaggtctactctgtgtgctgctcaggtgtatcagccttggaatgatgcacactttccctgtgtaaccaccaacagtttgcagtttctgctttaactgatgagctgtgtttcgggcatattcaagtcctccaggccaattggggtctattaagattgtatagagtaccacggggctgttaactgctatcaggagagcatcacacaggacattctgttctttcctgaagccaacatcaccagcccagcttctagaaaatatcacaatcccctgagaacaaggatgtatcagggtcttcattaaaccctccagttctttatgatctgagaacagcttcttacagagggattctggtttaaattgtacctcttcctgtgtcactgaaaattcaaggaatagatgttaccaaaacttacaaaagcatgtggtaagtattcctgcaacgttgcagaaaaaaatgatacctggtgcatttgggaaaataagagctttcctttagaattgtgattcttaatcaggagcagttttactccccaactctcccccatccccacggacatttggcaatgtctggaaaattttttctttttttgtgagacggagtctcgctgtcacccagactggagtgcagtggtgtgatcttggctcactgcagcctctgcctccctggttccagtgattcttctgcctcagcctctggagtagctgagattacagtcacatgccaccacacctggctaatttttgtatttttagtagagacagcgtttcaccatgttggctaggctggtctcaaactcctgacctcagttgaggtcacccgccttggcctcccaaagtgctgggattacaggcatgagccaccatgcccggcctgagaattttttattgtcacaattggaggggagctactggtatgtagtaggtaccagataggaatgctgctaagtattctacaattcacagggctctccctcccccagcaaagagttatctgactcaaatgacaatagtgctaaggttgagaaaccctgctttagaagaagttcagataacccaatggctccttctgcattggaaagctaggggcagttttttgatggttgagacctgagaaattccctgcactctcaaatttggaaaacaaaagccatatgttatgagaagttggaaggcacacagaaatagtaatagtgggaatcagatgactggaaacaagggtcagatatatagatatataaatattatatataattatatataataattatataataaattaataataaatattaataattattttaaataagtatatatatgacccttgttttcagtcatatatatattatatatataatatatatatttcaaatttcaggatcattatgtcgctaagtccttcatttgaccttccctaaggagaaacacctgaactcattactactaacacctcccaactcaattttagaaaacaaatagtcccctaagttgaaatcaagagggaatacctggaaacaaatgtcgttgcagagcctccttaaatttgtggacttttatgggatatccgggactttttcgtgcagatgaagctgatgaaatcaggcaagagttgtagtctgtgaccaaactgggaggagctagacaattacatggaaagttgtttcagacaaaaaataaaaagttaaaaaaaaaaaaaaaaaagcctctttttttggctcttcttactggagacctgtgatgtgcatgggtgcctgagcagtcgtacttactatgcgtcagacagctcacgtatgtcaggaaaggaagtctggggattcctacaggggacatatcacacatattctaagtcactgtgtgactcggcttgagcaagtcatttcacctctctctcacgctggagtgaagtaataatccctaagcttcctttcaattataatattctgactccaggttatctctaagaagaaaaggcatctagtggggatcagcaaggattaaagcacagtattttaaaaatggtgttggccagatgtgatggctcacacctgtaatcccagcactttgggaggccgaggcaggcggatcacgaggtcaggagatcaagaccatcctggctaacacggtgaaaccccgtctctactaaaaacaaaaaaaattagccaggcatggtggccggcgcctgtagtcccacctattcgggaggctgaggcaggagaatggggtgaacccaggagacggagcttgcagtgagccgagatagcgccactgcactccagcctgggtgacagagcgagactccgtctcaaaaaaaaaaaaaaatacaaaaaaatacaaaaattagctgggcgtggtggtgtgcctgtaatcccagctgctcgggaggctgaggtgggagaattgcttgaacctgggaggcggaggctgcagtgagctgagatcgtgccgctgcactccagcctaggcgacaaagcaagaccctgtctcaaaaaaaaaaaaaaatgttgttacagttgtttatgtccccatctaaggttagatggaatcaaaagtggcaggatctttaggggagaggagaagagaagtgaactcaaacaaattaagagaaagaatgacccaataaaattctccaatcactcaagttttgatgaaatctggaacatactggccgtgaaggcaagcagataggcgtagttcggcctatagtcctttatggattgattaggaatcaccaaggctgattccaatcaaaactgaaaggtaagtgagaacaccaggggtcctgctccccccagcacccccttgccctagcatctccttttgcatcattttcccccacttggtggtgccctaagcccagtggcttaaggttattagctcctaatgttactgaaacaattcaaatttgtcaacaatgttttgcttgaaagaattagtggagtagtggagtcatttatttttatttttttatttttatttatttatttttttgagacggggtctcgctctgttgcttaggctggagtgcagtggagtgatcttggctgactacaacctccacctcccaggctcaagcaatcctcccacctcagcctcccatgtagctgggactacaggcatacaccaccacgcctggctaatttttatatttgggggagagatagggcttcgctattttggccaggctggtctcaaactcctgggcttaggcaatctgcccaccttggcctcccaaagtgctaggactgcgcccagcctcagagttattcttaaacagtgtttctctagaatatcatctctaaaatgaggctattccaattttgactgggatgatcagcctgcacaattttttcaacaggtttatagacaataaaaggagacctttcctaactcattgctgatggcatactgtaactttcctttaaaagttgcttaggctggccaggagtggtggctcacacctgtaatcccagcagtttgggaggtggaggtgagttgatcacttgaggttagaagttcaagaccagcctgggcaacatggcaaaaccccatctctattaaaaatacaaaaattagccgacatggtggtgtgtgcctgtaatcccagctacttgggaggctgaagcacgagaatcacttgcacctgggaggtggagtttgcagtgagccgaggtcacaccactgcactccagcctgggtgacagagtctaaagaaaaaaaagttgtttaggccatagaatccaaacatttcttgacctcagtttatattctgagtctttggaactaaaaatgttagataaggaacactgtaatgggagaacacttataagaaaaataaatttctattttttaactaacatatgtgatcaaatacccacaaaaggcagagaaaggggttcctccctgctgatggggacaatgacttcacttccctttacctgactgagtatccagcatcatgaccacccactgctcagctgtcagccgtgtgacagaattgtctttcatgatccaggaatctggggcctctgcaaacaccacgcaacagaagggctccacttgaatcacacagacataaccatccaggacatctttttggtacacattcaggatttttgtagtgaaatttacctttggcttctcacagcagaagtggaatgtaggcaatttttctatgcagttttcgatttctttttttagtaagtcaggattcactttttcccacttacatccaaccacttctttgctcttatcatccaccccaatgaggacatatcccccttgagtgttggcaaatgcagaaacataatgaggcagcatttccttaatccgaggtatgacttttttggtggtgaaccttttaaattcaacatgtgttgactcagtaaagttgagtttctccttatacatgagtttgtcctttttaaaaaattctgaggccaatatcctcatatcttcctcttcctgaatgcatctattgagaacctgctgaggatgcaacttcttcacccttggtcttcctctttgggctctaaaccccttctctctgagaagctccagggcactgctagcactcaagttgatagcagaagtcacatctctccgatacaaattggagcgcaagctgcaaatccttagtggaaggctgaaaacatctgggctccatgacttcacaaaaatcaggagattgtgcccctgctgcatgtagtcaaggtatttctgtgaacctgaaggaaggagcttttgaaaagaagtttccaaatcctgtcccagcccatggcattggtaactataggttttatcatcaatctctgctttgatcacaccacctccagaatttaacagtgcacatatagcccggataattctagaattctcagatcttttcaaacagctgttggtcatcttcttcctgttttcttctccaaaaatcactctgcccacatctactattacctcaggatacggcatttcagtatcagtcttgagactctccatttcagcagcccctctgtgctccaaacaataaaagaaaggagttcctataatcaggacagaaatattgtttctatattaataagaattccaaagattacaatattttcttcaaaactatcaattactggagatatattttaatgttggaagtcatctctctctatatgtatatttgttgttgttgtttgttttgggttttttagttttgtttgtttgtttttgagatagaatcttgctctgttatgcaggttggagtgcagtggcacaataatagttctctgcaacctcaacctcccagttcaagtgattctccaacttcagtctccctagtagatgagactacagacacgtgccaccaagcctggctaattttttttttcttttttgttcttgctattttttttttttaagagatggagtcttgctacgttgcaatcctcctgcctgggcctccctcccaaagtgctgggattacagatgtgagccaccgcacccaactggaaattatctttgatactgctgttttctaatcactttgccaaatatccttagccttgccagaataagtaggcatggataaaggtgaatgcctaatatttgtcataatggaaaaattaaattgctaacattttcagccattttgcatttcaaatcaggaaacgccaacactgagcccagatataaagggcatgggttggcacaggagcccaggaaggtattggagaatatgcagaaatagaagttgaagtgagaagatgctcttatttataattcaaaaggggaagaaaggaaggcactagagaactaaggaagtataattttacagtatatgtactgtagaagatcttgctataaacacaaacataggctgggtgtggtagctcacatgtgtaatctcagcactttgggaggtggatgtgagaggattgctttcgatcaggagttgagaccagcgtggacaacatagcaagaccccatctcgacaaaagataaaaaaaaaaaaaatgttaaacattaggcaggtatggtggtgcgcacctgcagtcccagctacctaggaggctgaggtgggaggatctcttgagcccaggagtttgaggctgcagtgaaccatgatcgcaccactgcactccagcctgggcagcagagtgggaacctgtctaaaaaaataaaaataaaagtaaataaataaaattctatatttttatgtattatttcatacactttgaaaagctttattttactcctgaaagaatgtcagttgataccaaatgcagaaaccttttcaactcttcacatgttctaaatctcaaaagtacattgcctcatatacagtgtgatgtgacagcagcattttccttcccttctaatagttctgccctgtgctgtggaaacccctaagacttggaaaagaacatgagcttttggggcatggtaactaaaccattgtcacccttcttttgcttcctagaccagaaaacagccacctaaactgaaatttgagctctgaaacaaatatttcagaaaagatctgcttacctttagtcaattgcaaaacaaaatatttgctaactcaaccaaaattcttcctctaggagaagagaacccatctttctgtgtgatctttgcaaagcaggggccctgtgggcattgtatatactcaccaagaggaagaaagcaggcatccggcaagacatgtgcactcccctgatatcaatttgttcttggttgccttctcacttccttcaggaaaaccagaatcaacctggggaattctttttagaatgtgagcctcttctataggtacatgtaaatgtagtattttatggctccttagggaaatttcccataacattctatttatatcatagaatcacagaagtgttggaaaggactttaaagatcctccagtccaacaatctataggattctaaaatctcctctataatattgccaactcccaacaagttgcaaacctccagcaatgagcaactcactacctatcaaatagtccctctagtcccttctaatttctgacgtctgtgttagaaatggtctccttactttaagctgcaatttgtctccccataacttccactgatgggacccacaaaacaaatctaattgattttgaatagcaaaccctatggtctcgtgactcgtaagtctcatcaatgttatttgaatgctgataacaattatgataaatacaacatttactgagattctagctcgagatgaatatcctttccacatttcccaggacttttttttctttttttgagacagagttttgctctgtgcccaggctggagtgcagtggcacgatctcttggctcatggcaacctccgtcccccaggttcaagtgactctcctgcctcagcctccagagtagctgggactgcaggcaagagccaccactctcgatacatttttgtatttttagtagagatggggtttcaccatgttggccaggctggtctcgaactgttgacctcaggtgatccacctacctgagcctcccaaagtgctgggattatagggacgggccaccacgccaggccttcccagaattttttattcattttcctttacaaattttccctaaatactattttactaatccctcatgccctcagatgtagactgcacctaaaattagataaatgagatatttttaagaatttttttttttttttttacctatgctcctgtgtttcctcttgctgcttcagtttcacatctggctgtagtctgaatgtttgcttctgtcacagccccttttgccctttgatattagcctgggaggagcagacttcccacttcttcataacactgacatactgaggaaggccgataaggactcatgaagagcctgtgacagggcagattagcaggccagggtctgacctcagggagtgaatgaggtcgtaatgagaaaatgcaggggtgaatggaaaaagttaaacttagcacttctaagagactgagcttcatttccacatatcatacatgtaccttcagcgctggaaaattgtgtgtgcaaagctctgtttttattttaaattaggcttcctgtacatattcattgtgggcaatattaacctatttcattacctcctaaatggcttgttcttttctatttatttttattctttttcctacttttcatctttgttaaacacaagacccagcctagaaaaatcctcatagattaggagctggcaatccctgggtaggaggattaaaggtaattttttaattaatttatttttcttccctttattatctttaactgatctgtatttttaatggtttacaatgagtataaattgtttttcataattaaaaaacaaatggtaaaaaccaacagatgggctgggtgtggtggctcatgcctataatcccagcactttgggaggcctaggtgggtggatcatctgaggtcaggagttcgagaccagcctgaccaatatggtgaaaccctgtctctactaaaaatacaaaaattagcctggtgtggtggtgtgtgcctgtaatcccaactactggggaggctgagacaggagaattgcttgaacctgggaggcagaggttgcagtaagccgagatcatgccattccattctagcctgggcaacagagggagactccatctcaaaaaaaaaaaaaaaaaaaaaaaaaaaaaaagaaagaaagaaagaaagaaagaaaaagaaaacccaacagatgctgggggcagtggctcatgcctgtaatcccagcattttgggaggctgaggcaggcagatcacctgaggtcaggagttcaagaccagcctggccaacatggtgaaaaccccgtctctactagaaatacaaaaattagctgggcatggtggtggacacctgtcatcccagctcctggggaggctgggacaggagaattgcttgaacctgggaggcaaaggttgcagtgagccgagatcatgccactgcattccagcctgggtgacaaagtgagactccatctcaaaaaaaaaaaaaaaaacagataccgggcgcagtggctcatgcctgtaatcccagcattttgggaggccgaggccggtggatcacggggtcaggagttcaagactagcctggccaacatggtgaaaccccgtctctactaaaaatacaaaaattagccaggcatgatggcagacacctgtaataccagctactcaggtggctgaggtaggagaatcacttgaatctgggaggtggaggttgcagtgagccgagattgcgccactgcactccagcctccagcctgggagacaaagcgagactccatctcaaaaaaagaaaaaacaaccaacagatgggaggcagtgagttatcttatttgaggatggtggctaaactgggtcaagctttgatacacacaaaaggggaggaggcaatgtgatcacagaagcagagatggagtgatgcagctataagcaaaggaatgccagcagctaccagaagctggaagagtctcccctggagcttctggagacagcaggtccatggcaacactttttttttttttttttttgacagagtcttgctctgttgcttaggctggagtgcagtggtgcgatctcggcttactgcaacctctgcctcccaggttcaagcaattctcccacctcagcctccagcatagctaggattacaggtgcgcaccaccatgcctggctaatttacatatttttaatagaggtggggtttcgccatgttggccaggatggtctcgaacccctgacctcatgtgatctgcctgcctcagtctcccaaagtgctgggattacaggcgtgagccaccgtgcccagcccatgccaacactttgacttcaactcagtgaaactgatgttgaacttctagctgtaaaaaaaataaaaaatttaaaaaaaaaacgcaaaaacaaaaataaccaaatgaatggagctggaggccattatccttagcaaactaatacaggaacagaaaactaaatactgcatgttctcacttataagtggaagctcaatgatgagaacacatggacacaaagaggggaacaacagacactgggacccacctgaggtgggaggagggagaggagcagaagaaataactattgtgtagcaggcttaatacctgggtaatgaaatgatctatacaacaaacccccgtgacatgagtttacccatataataaacctgcacatgtacttctgaacctaaaataagttttcataaaagaatatgtttctgggccgggtgcagtgactcacgcctgtaatcccagcagtttgggaggccgaggggggcggatcacgaggtcaggagatcgagaccatgctggctaacgcagtgaaaccctgtctctactaaaaatacaaaaaattagccaggcgtagtggcgggcgcctgtagtcccagctactcgggagtctgaggcaggagaatggcgtaaacccgggaggcagagcttgcagtgagccgagccgagattgcactactgcactccagcctgggtgacagagtgagactccatctcaaaaaaaaaaaaaaaaaagtttctgttgttttaagccaccaaatttgtggtgatttgttgcagcagccacagaatactaatacacctctctccctctaaatcaaaccagcaaagtactctgtatctctacttcaattcgtttatgatgaaacgacattcttaaataagtctctggacatccctatttttgtcgttgttgttagctgacgccactgcccaacgaagttctgctctgctggcatcactctttgtacatgtttggcttaaaaggagtttccaggaaaggaggcagaatgggtactatgatatataattcacacagcaacataataagctccaaaggcctgctctcagctttaactcatttttcattcgtgtcacttctgaatccagtctcacttttagttctcctgtctaccttaattctcggcctcactttcatattgaaatccctctgatattacttatgtttcaaaggctaaaaatgaccaccatttactaaaaatgtgcttaccagatgcaagggaccatgctgggagcactacacatcacacaaaaactgagactatacggccagagagtggaagagtgacgatcccaaactaggtctgtctaattcaaagacttgtactctttcactctttcaagtttgggattctggattgcttgaaagccctcaaaatcagaagtctaagtacctccccattttcttcccaatcaagaggaataacatcatttggtcaggagaactagaaactagattgctgttttcttcttcttcttctacagggtagtactgggaatcaaatcaagagaagcggggaataacgtggaaaatgagcaatgagaacttcttttccttcttcaaagcgttttagtcaagtcccttggatatgaatagttaggttgtcaggccagggaggacttcacatcttggctttgatagctcccaagcaaatgttcctgatacaaaacaacttgaaatcagtaacttagattatgctttttcctgtctcaggaaaattcatctggccatgctattgatgattgctaagaacaagaaccccgaatttattttagatgtgtttattcactaagcatttctgtttatccacagttgtacttatgttcaccagacgcaagcctgcatgttcaccagacataaactgtcaaatagcaactaaaggggaaaagttggtctctttacccccagatgcctccatctcacccccaattctttcatagagatgatccaaagagtgtaaatagaatagtgaccaagggctccattatgccactacctgactccgtgtaagtttcctcactttcattcattctttcattcgatcagctattttggggatcctaaggtgttcagatctcagctctgccacattctagctatgaaaactttgttaaactaacctaagcctccaatttcttctgtgtaaactggagataataacagagcctcctccacagagtatttgccagaatgaagtgaaatgatacacataaagagtaaatgtgtgttaacatgtgctctttgccgcatatggtgcccggcatgtaatgccattttcattcaataatcaattgtcggctaagcgcagtggctcacgcctgtaatcccaccactttgggaggccaaggcaggcggatcacttgaggtcaggagttcaagaccagcctaaccaacatggcgaaacctcatctctattaaaaatacaaacattagctgggcatggtggcatgcgcctgtaatcccagctacttgggaggctgaggcatgagaatcacttgaacccaggaggcagaggttgcagtgagccgagatcgcaccactgcattctagcctgggtgacagagcgagactctgtctcaaataataataatgataatcaattgttgagcgcttacaatgttttaaacatggtgctacaatctggggctacccatcaaaataaaagctcttatttagtaactgccttccttgagccaaatatgcaactttccttctcaaatataatcctcagaataacttgcaagaagtgttattttcacattacataaatgaaaaaaactgagttcattgaggtaaagcacaaagttacacatctagcaagtggcagagctgagagctgaacactgacctatctgaatccaaagcccagttactctcatcctgccagaaagccttactattagctggaagaataagacacacgtccctgctgggctcggtggctcacgactgtaatcccagcactttcggaggccaaggtgggtgggtggatcacttgaggtcaagagttcgagaccagcctggccaacatggcgaaaccccatctctactaaaaataaaagaatcagccgggtgtggtagtgcatgcctgtaatcccacctatttgggaggctgagccaggagaattgcttgagcccaggaggcaggggttgcagtgagctgagatcattcacaatctaaagagggaaaacatgtactaaacaactcataacaatacaacatacacaataacatcaactgagcactctatgtattaggcattgttgtcattgatcttgtaacagttctattaggtagatgctattattagcctcctttttacaaatagtgatactgaagaacaaagaattcaagttacttgccaaaatagtccacatacatgaccactacgctctagtaccactctaaagagtttgcaatgtatgagcagtgttctctaggtgttctgaggagtgacaataactatgagtgagcatcagaaaagatttcctagatgagatgatttgtgagctggaacctgtaagtaagaaagcaacaggtttccccctctcttcctttctccgccatcgtggtatgtgcttgactctgcttcttgccatgtcttctcacaagacgtttaggattaagcaattcctggccaagaaacaaaagcaaaatcgtcccattccccagtggattcagataaaaattggtaataaaatcaggtacaactccaaaaggagacattggagaagaaccaagctgggtctataaggaattgcacatgagatggcacacgtatttatgatgtctgaaggtcacaatcacattatcatatcaacctgaaaatgtcaccactatctggagagttggacatgttttattggggacatattttttctctctgaatctgttatgaacgctttggttggctgagttcagtaataaatatgtgagacctttcatttcaaaaaaaaaaaagaaagcaagcaagcaacaggttgagagaaagggagatggatgggagaaagataaaccaggtagaggaaatagcacgcgcaaaggcacattgtcttcactgtctaatctctccaatccttaacgaacgaaagaggccttgagtgggtctggtacagaagactctccattttacttcttcatgtccttttacccattcctgtctaacattcatcacaatcctcattcgcctttcatatgccactcctctatttccactgccaatctaatttaagctcctattagctctcacctggaccattgcaatagctttccctcctttcgctctctgccccccaccaatctaaacacagttgaggccgggcacggtggctcacgcctgtaatcccagcactgtgggaggccgaggcggtaggatcacctgaggtcaggagttcaagaccagcctggccaacacgttgaaaccccgtctctacaaaagtacaaaaattagcccggcatgatgatgggtgtctgtaatacagctactcgggaggctgaggcacgagaaccgcttgaacctgggaggcggaggttgcagtgagccgagatcgcgccactacactgcagcctgggcgacagagcgaaactccatctcaggaaaataaataaataaataaataaataaataaataaataaataaaatcagccgggcgtggtgacgcctgcctgtaatccaagctgctcagaaggccgaagcaggagaatagcctgagcctgggaggcggaagtggcagtgagccgagatcgcgccactgcactccagcctgggcgacttgagtgagaccctgtcacaaaaaaaaaaaaaaaaaaaacccaaaaccatttcttcccgcaatcccagggcacacacactataatcctgcctcaaatgctcattcccagttatgaaacagggtacaggcaaaaccactctgcctaacagtcaccccgacggccgacggcgaggaattgtggagggggcgggggagaattgctcagaacttggaaagcgactggtctctcaggatagagaccgcgacgcaaagaagtgacggaaaagatgcgtccgccatcccttttgctccacccctgacgttggcctcggccttcgattggctgctcctcccaccagccccgcctcaggggcgcccacgtgacccgatggccgccgtgggattggttgttcggcgagagccgcgctaggctgtaagacctgagccgggcggagaagcaaaggagagggaagctggaagcacctttggcccgggacagaaatctggagagcttggctacctccatcctcctcaggccggagcaggcttcctgagagagtccaggtcgtaggagttttacgacttagaaaagcgggctgcagattccttcctgggtgtttggttcaagccttggctccagcctcactctcagtcttcccgggagttcgtgggatttggaccttagattattagtattattttgagggcctcctgtgtgtaagcactggttgtgcgcagatggctgtgcagagggccatgaggtagaggctggggaaatgagggcttggaggtgcttgaggtatggtctttacctacgtgaaatgttggaggtaagtcggatttataacttgtgttgatgcttttataatctaggagcttagggtttagtaggaagagtcgctcattcaatgaattaaacgctcattcctatgtactaggcaccattccgagtgcagtggctacaaagactagtagaacatagtcctggttctttaggaactctgtgattgggcaagtgggagagagggcggaaaacgtgaactggtgagtagttggcgtgtgatgcgtgccgtagtggaagaaagtgctgtgagagttagaagagggggatgattgaaggaattaaggacatttaacagaaagtgatatttgagtaaagtttatttttgttttgttttttttttttttttgagacgggagtctcgctctgcctcccaggttggagtccagtggcgctatctcggctcactgcaaccgccgcctcccgggttcaagcagttctcagcctcagcctcccaagtagctgggattacaggcgcacaccaccacgcccggctaatttttgcgtttttagtagagatggggtttcaccatgttggccaggctggtcttgaactcctgacctcgtgatccacccgcctcggcctcccaaagtgctgggattacaggccaaagccaccgctcccggccttgagtaaagtttaaaaagtatacttagggtgggtatttatccctccatgaaagcgccttttactcagccagcacagagccatccctttgcccttccagatgcctgactgggaccttgcttatggatgtgtgagcttttaatctctggctgtaatcttacccacttcaacctaaacttggaatgattactcttgaccctttttttgagtgataaggcaaatctccccacacctgggcattttaaagttatatactgtatgtttaaatatcccccttaaaaagcctgagctatataacaatctagatgtgtctatcttactcttttcccacaaactaagaatccaaataatgttaaaaatctttaaaaaaaaaaaaaaaagtatactcaggttttctccccatcgaaaggggtggagaaagcactccaggaactaggaaaatgtacctgccgcatgtggctggagcacatgggaggtttgcccagctgatgatgaagcagatagggagttcaacttgtaaagatcttgaattacatggtagtctggctgtctggatcttaaaatacaaagtgaaataggtaccacaaaacaggtattaaggtgctttcataattcagaaggaggacagatacttcctgttggattgatgaaaaaaggcttcatgcaaaagatggcattttgaagggttgcaaactgcagggataggattttgaagtacaggaaggatttctacacagggggaaagactttctagatggagggcataaggtcaaatagagccaatatgaggactaaggaataatctgggttgattagactgtaagatatgtttgggggcccggcacggtggctcacacctataatcccagcacctgggaggccaaggcaggtggatcacttgaggtcaggagtttaagaccagtctggccaacatggcgaaaccctgtctctactaaaaatacaaaaattagttgggcatggtggctcatgcctgtaatcccacctacttgggaagctgaggcaggagaatcgcttgaacccaggaggctgagtttgcagtgagctgagattgcaccactgcactgcagcctgggcgacagagcgagactctatctcaaacaaacaaacaaacaaaagacatgtttgggttatttatggtgtatttaaggataaatattggtctgttttgaaacatcttgattgctaaacaaagtcgttaggactttatttcctagactatggggagcaactgaatgcttgtgagtaatcacacctccatatataagggttagtatgtgtgtaagattcaaagtacattggatgggagagaaactggaggcaggaggcccattgagatagcagtattgtctgccagaaggaacgtgggttttagagccaagcactcattggttcagagcttggctttgctcacaagtttcattatttttggcagatttatttaagttattaagctctgatctctgtctcaaaagagggaaagtaactgatgaagtgcctgttacacaatggttatgcttgaatgcttaaacagaggctgaggcctctgttttctttttctttctttctttctctttctttctttctttctttctttctttctttctttctctttctttttttccttctttccttctttccttctttccttccttccttctttccttccttccttctttccttctttctttctttctttttctttctttctttcttttttttttttttttttgagacaggatctcactcttgtcgcccaggctggagtgcagtggtgcaatctcagctcactgcaacctccgcctcccaggttcaagctgttgtcctgcctcagcctcttgagtagctggcattacaggcgcctgccatcatgcccggctaatttttgtacttttaatagagacggggtttcgccacgttggccaggctggtctggaactcctggcctcaggggacctgcctgcctcggcctcccaaagtgctgggattagaggtgcgaaccactgcgcctgacctagttttcctctttatggagcttagttgctgaatagtgaacacagaccaatagctgtcagttttaactagggaatatcagtctattgatgtttatagatggctgaaggcagtatatggtggccccagaattttagatactgacaatatcattttgaaagtctggagaggccaggtgcggtggctcatgcctgtaatcccagcactttcagaggccgaggtgggcagatcacttgaagtcaggagttcaagaccagcctggccaacatggcaaaaccccatttctactgaaaatgcaaaaattagctaggcctggttgtgcatgcctgtaatcccagctacctgggaggctgaggtgggaggactgcttgaacccaggaggcagaggctaaagtgagctgagatagtgccactgcattccagcctgggtgacagagtgagaatctgtctcaaaaaataaagaggccaggcgcggtggctcacgcccataatcccagcactttgggaggttgaggtgggtggatcacaaggtcaagagttcaagaccagcctggccaatatggtgaaagcccatctctactaaaaagtgcaaaaattagctgggtgtggtggtgcacgcctgtagtctcagctactcgggaggctgaggcaggagaatcacttgaacccgggaggtagaggttgcagtgagccgagattgtgccaccgcactctagcctgggtgacagagtgagggagtggagtggagtggaggtcaggtttctcattcacaaattgatttttcagattgtgaattacccatgctttgccctgctttatcttccatgtccttcctcattagtaaatctaaaggtagtaccctagagaaaaatgaaattgaaccttttatttagttgctactgaaaaaatataaatctggtaatcatacctcaagttctctttccagctctgcagttaatttcctatggatcttcggcaaatcatagcctctctgggttcttggactcttcagataaaagattctagtttaaaaacttttatgactataattttaatctttgttggcagaagaattataaatcaaattgcatattaaatgaactggagtttataaagaaatttagtagaaaatcttttctaggcccggtgtggtggctcacgcctgtaatcccagcactttgggaggccaaggctggcagatcacttgaggtcaggagttcaagaccagcctggccaacatggtgaaaccccatctctactaaaaatacaaaaattagctgggcgtggtggcacatgcctgtagtcccagctatttgggaggctgaggctgcagtgagccgagattgcgccactgcactccagcctgggcgacacagtgagactccatttcaaaaaaaaaaatattttctaggccaggtacagtagctcacacctgtaatccagcactttggaaggccaaagagggaagatcacttgagcccagcagtttgagaccaccctgggcaacatggcaagactctgggcgtggtggtgctcacctgagatgtcagctactcagaaggctggggtgggaggattgcttgagcccagcagtttgaggccacagtgagccatgatcgtgccactgcactccaggctaggtgacagggcaagaccctgtctccagaaaaaataaagaaatttttaaaaagaaaatatattttctaaagcttttgcttttgaactaggctaagggcaggcttatgggctcaagcctgtgatcccagggttttgggaggccaaggcaggaggatcacttgaagccaggagtttgagaccagcctgggaaacataccgagactcttgtctctacaaaaatttaaaaagaattagccagggatggtggacatgcacctgtagtcctagctacctggttggatcacctgagcccaggagtttgaggctacagtgagccatgatcacaccactgcactccagcctggttgacaagagtgaaaccttgtctcaaaataaaaatatatatatatattaattgaaaacaggccaggcatggtggctcacgcctgtaatccgcgcactttgggaggctggagaaggtggattgcttgagtccaggagtttgagaacagcctggacaacatggtaaaaccctgtctctacaaaaagtacaaaaattagccagatatggtggcctgtgactgtagtcccagctacttgggaggctgaggtgggatgatcgtctgagcctggggaggttgagactgcagtgagccatgatcaggccattgcactccagcctgggtgacagagtaagaccctgtcttaaaaaaaaaaagaaagaaagaaatattaattagaaacccatggttgaaacttacctgaatagaaggctttattttttttcataggtaagcctatgttttcttggatgtgaaactagggcactgggttgctcttaggtaatacaaggagatgaaatgcagcgatgcgatgatgagtgaagtagagcctgacctggtattgccattgcttcactgttggctttgaccagggtatgatctcttaatcttctctctgagctgattctgattgtggtttttccacacaggtgtgttgtatcctgtttggacactggttttattatgtttaagatgtttcttttattttcttttgaattactgatattctcatgttttcctccttaggttgagatgaaaactcttgctttgaattcttcatggaggactacatcatttcaatcctgaatctggctcaattctattattcacttattactgtattaaaaacgtttaattggccaggcacagtggttcacgcctgtaatcccagcactttgggaggccaaggcaggcggatcacttgaggtcaggagttcgacaccagcctggccaacatggcaaaaccccgcctctactaaaaatacaaaaattagccaggcgtggtggcacgcacctgtaatcacagctacttaggaggctgaggtggcagaattgtttgaacccaggaggtggaggttgcagtgagccgagatcacaccactgcactcaagccttggcatcagagtgagactctgtctcagtaaaaaaaaaataaataaataaaaatgtttaattaaccatgatatttgctttggtaaaacctttgaggtttaatgagaattttaaaattcattatacttttcttatggcatataaaagttttaattttttttattgtctcaactaacatcataaatgtcttaatgttaaaatccatgggatattctatttaaaattttagctttatcacctttgtgctatcagagaatgtgctttgaactggtaaaatgagttaaagtattggaaaacacttatgtcagcagaggctcttaaaaatcattttcatccttcctcttctagtgatgatttttttttaacccatgttttcaccagtctaccaatccaatggcataaatgctcctacataggcaacttaagtgtttcttaagttgatgcaaggtattttgcatgaggctgaattcttgttgtcggagcagaggatttttgttccaactactgaattggcaaaatgttaaatataaaaacacctcaaaaagtcaaaggtagtctgaatgaaaaatttattttaaacacctcaagtaatctttacatttctacaaaatcataacatagttcttttccagaaacatttattcttaaaatctacttaagtgtttcatagaaactttagtaataaccagaataattcatgacactttagcaaactcttagcagcaagcagaaagaacttattaaaatatcctttctttacacaattagattagtattttgcttcatgtcttcattgcttgttagctttgcttttacacaggaatcttcagactactctctgtaacactcaacccctattccttttttaaccagtttctcaagaaggatatggagagctcataaaggaatatcctcaaatatcctaaatatccaacttttaaaataccttttttatccttaaaagctgataaacaatagatgtcacttaacaaatgtctcacagtatatggaaggagcttttttcccccccagagtgtttctaagcatttctatcaagagcaagtctgcatttcttatcgtttgcaaactgatgaaatttccaccttacagacaggcaggtaaatgctttcttttctaaaaagaagtcttgctaccacctcactgttcactttattttttatgcggtctaacctgggtttttcgtaagagctcctttatttcttatattttaaggaaagggataggcaaaaacttgtgtactcattattctgtttaatctctacactggccctcatatcccctgccagtcctgatccttctactttaagcagcttggtcaactgtaagtagggttctagagagcaggctaaaaggttaggatcaaatgggcatatccttttaaagaaatccatataatcatttaaagttcatatagttatgaattgaggctgagaagtgtcaactcaataccatgctgaaaccagctctgtgacattacagcgcaatacttttgttgtgaggataagacatgattccctttcagttctcaggggagtagagtttaatcagatgttgtacttctgttggataacctgtgatgggacaagcttggtgactcctcacataatgaaacacacagcggtaacaaaacacatagccagaggtggcaagaacagtatcattcacccgggttttacgacacagtgggcacacagtcttcattttgggtaagaggggagaatcagagttatagtctaggtgtacaggtggtggtggagtaggcagggcagtcaatgacttgatggtttcttgattttcagatgagtaccaccagtcaaggaactgcaagaagaatacacccacagaaaggccagtagacagggataaggcaacacccccaacagctttcttcagagctgagtttatcttctcactaacactgttgggagaaaagaacaaggaggcaaagagagaaactttatttaggtatcattacaaagtgactaatataaatgcaattcttacatttttcatcagaatcactgggggactgaatggttggtagactggtactatctccttaaggatctattctaagtgattctaacttacaatattttaggagcataggagctaagctttgtttttagtaacatgattagggtttggttttgtgttttgaaagataaatcagagaatttgattatatagacctccctttttttagtggaagatagtgatccagaaaaaaaaaaaaaaacccaattcacttaataaaaaacttagcagtattgaggaatgtatatatttgaacttgtaggagaacacaaatatgaactagaaggagcacagcatcatgattaagagcacagtcttaggctgggtgcagtggctcacagagcacagtctttagaattgtattggtttggtttgaatcccagctctgccaccttctatgtacctacgtgactttggcaaggtacttaactgcttgggtttagtttcctcaactgtgagctaatacatttacttcattgggttgtgttgaggattgagataatgtacgtaaagcaagcacctagcacagggcctgggacatagcaagtatgcactaaagtatacctagaatgatgaaggttaccaggatgacagtccttgttttatggacacaaggaatagcttttctatgactctatgaaatgccacaaagttaacagggaggtgaattttacaaaactgggatacgattttcgaatttactaactaaagatcttttggaaatgttaaggccttacctcctggctggttgctgcatcatgctggccttagctggtttgtgctccagagcttgtatatcctgaactgtcagtcgacctagctgaactccagccagcctcagcagtggtgagtgatgctgagcttttcctaggatgtatcgaagttgttgtacaagaaaccatccttcccaggccatgttcacaaatgggtaggctgccaggaaagctctgtaaaatcgtttccagcgggaagaagggggatgaatagaatattcatcctcttctctcaggctagaaaccagcttctccagcttcactttcagatagggaagaagaaccaggaacataatagatttccaaagctgctgctttgggagaccagcactagccaatctctgagacttgtgagtgtcccccattacaattctctttaagccgtaaaagttttcagaaaatgaggcactggttctagacagataatgttgctggagcagaagatctagcagagtaaagatttcatcaaaccacctccacaagaagccatagtgggtgggatttgattctgcaagaacctaaagcaaaataaagcaataagtgaaattcattccattacacaagttctacacctatttacattcccccttttcctctaaagtctacacaatttgttttaaataagtcactgttggaccctgaaatgctgggtattcagtacaggtctctacacataacagagactcagtaactcttaagtcatgggatacaagttatttgcaaattggctatttcaaacgctaggctaccaaataagcacaaattattcgtttgttttttacccagttgtccctaaaacctttccaagaattaataccttaccttgaccacatgctgaagagcgggtctcactgctgtcattaaactgtcctgtgctaccacctcaaagatggatggctggtcatcggccacagaagcagctgtgaagtgagccccgtgctcagccatagtttcctgcgtgtactggctttcacttttcccacaaactctctcgtgagcatgaactttttcgggaggaagagtatcagatgggtgctcagtcttaaaggtaaactttctgcatgatatctgaaactcgaaactcaatcttatgggcaaaaatgaactgggaaaaaaagacctggaggccgagggtagtctcaagaaggttaagaacaaagttaactcggacgtgggtggaagtagtatgtggcgagggggtaacttgtcaaatgctgcacgtcagggcagagcgtgactgtgggggacaggtatgggggaaggaacgcaatcctctggagctgcgaaccagaaacgccccctcctccccaatcgtgagagctcaaaagccagccgactctgaggattcagtcgtgccactgtgagcccgggacacaagggctgactccagctgttggctttgagtatccccgcccgcgcccgtccttgctcgctgaccccaggcgaggcgcaaacaacccacgacgccacgtttgaagggaggtctccgctttatgacagaagccgcacccggaaatgaaaccaccaggacctctgggatgcctggcggaagagaggcgctctagttccgaatgcggtccggaaaccagaactagagaactctatgacccacctgagcttccgctcccgccccgctgaaacagaagagggcccttgtgggctggttttggctagtttggtttacttttcgtagctgggtctgcatggtagcctcgctggaaagctacagctctgaacctctctctgcgaggtctttttgacaagctgtttggggcaccgcgcagacgtctggcgccgggagccagagctcgggcccgttgctgagccctgtgttcctgcaggcgatgaagctaggggcggtgggaggaagggaatctggaggtggaaaggactttgctgtacgcgtgcggcagggatggtggttaatttatatgtcttagccttccagaaatgatttaaagcgacatagcaggagataggagccttagatttattgccgccaattataaggaaagatgattggattgagaaaggttcatgcttgttcctcagtacttgagacggttaattttcatccaagctggtagtttaacgtcttccaggttttggctatattcaagcataactgcatgcacttgctatactggatgaaaatggtctccatccttgaacacagttgtatatgtcaccaccagcgatatgaatacagtactaacgcagagggagctttatgaattgtaactagcatgcactggggacacttgacagaaagtttcctttcatgccgtttttataccaaaatgaatgtgatttaccttaaggtttgtaaagtgcttttatgttatgtacagctttgtctcgctgaagttggctgacacagccttattgaatttggatgagagttccacctctcctcccttcctctgggaagtgccacctctgggctaaatagctgggaatagaaggtattgtttactgccctagaggcccttatgttataaaaataattggtttgcataatgagaaccctcaaaaacaaggtttggatttagttattccaataggagagaaaaccttacaaattgtccttaattatagttataaaaagtgttttttactctaccaaaagacattatattgatatatgatttttaccttacagagttttaagactagacatagtttatccatatgaagcacctggatacatattaggtgcttgtttaatagtaactgttatgtacaagcttttcttaagtgaatagcaaaaatacaaagttgagaggtagcatcaactaaatcaagcaggaaattaaacatttttgtcacttagggatctttggttacaagcaacagaaacaaacaggctaatttaaactaaaacggaatttattagaagtgtatggagtagctcacaaaataagtaaagccagccctgaaagaacaggaacttaacaatactattgggactgcctaacaggaattagaagttcttatccaggcaacgttgttgcagtgaacgagcttccaccaatttctgtttgtgactctgctcgtgatacaaattttgactgacctctcttggttcaagttccctctccaccctgtctttcactcttagccaggggaaggcaggatgtcttgattgatagtcccatggaagtactccaaaagttaactaaacgtatggcataagaacgcctataatcccagcactttgggaggccgaggcgggtggatcacctgaggtcaagaggtcatgaccagcctgaccaacatggagaaacccagtctgtactagaaatacaaaaaattagctgggtgtggtggcacatacctgtaatcccagctactcgggaggctgaggcaggagaatcgcttgaaccctggaagcggaggttgtggtgagccgagattgcaccattgcactccagcctgggtaactgagcgagactccatctccagaaaaaagaaaagaaaaaggaaaggtagggcctggtatggtggctcatacctgtaatcccagcactttgggaggctgagacgggtggatcacgaagtcaggagtttgagaccggcccagccgacatggtgaaaacccatctctactaaaaatacaaaaattagcttggaatgatggtgcatggtggtggatgtctgttatcccagctactctggaggctgaggcaggagaatcacttgaacccgggaggtggaggttgcagtgagccgaggtcacaccactgcactccagcctgggggacagagtgagactctgtctcaaaaaaaaaaagaaaacagaaatttgcaactcgaataagaggtctgggaggcccaaatcttttagacgtgataatcggaatgcccttctgaggacataacaaaggcctaaattatgaggagccagccatatgaggagttggggaaaagaatattaggcagaaggaagagtattgtgaagaccctaaggtgggaaagagcttggtgtgtttgagggctattataactggcaaaaggtgaaatgatgaggaaatgagcagtaactgaaaagcacaaaatgatgttagagaggtagacaggccaaaccatgcagggactcacaggccatgggaacaaccctggattttagcccaagtgcaatgggaagccaatgaaggattcacacaccagagatgtgtgatcaggtatatatataaacaaatatatatatatatatatatatatatatatatatatatatatacaaatatatatataatatatacaaatatatataatatatatacaaatatatataaaatatatatacaaatatatataaaaatatatatacaaatatataatatatacaaatatatataatatataataaataaaatatataaatatataatatatatttatatatttgtatatattatatatttgtatatatatttgtgtatatatacatatattaaaaaatatatatatatatatttttttttttttgaaacagagttttactcttgttgcccaggctggagtgcaatggcatgatgactcactgcaaccgccgcctcctgtgttcaagcgattctcctgccacggcctcccaagtagctgggattacaggcgcccgccaacatgcccggctaatttttgtatttttagtagagatggggtttcaccatgttggccaggctggtcttgaactcctggccttgtgatctgcccaccttggcctcccaaagtgctaggattacaggcgtgagccaccgtgcctggccaggtttatatttttttaaagatgtctctgatggttttgtgggtatgcagtatttatatcaagctttacatttatgatatatgcacatttttgtttttgtttttgttttcttgagatagagtctggctctgtagcccaggctggagtgcagtggcacagtctcggctcactgcaacctccacctcccgggttcaagtgattctcccacctcagaccccccggagtagctgggactacatgcatgtgccaccacacccggctaatttttgtatttttagtagagacagggttttgccatgttggccaggctggtctcaaactcctggcctcaagtgatccccctgcctcagcctcccaaagtgctgggattacgggtgtgagccaccacatcaggccagatatgcacatttttaaatgtatgttatacatccaaaaaagttaaacaacctggccactacgtggagaatggtagagagaagacttatagccttctaatagtctaggcaaaaggtgatggtggatttatgagattgaatagagggagttggatggcttggagttgttgttttttttttttttttttttttttttgagacagtcttgctctgttgcccaggatggagtgcagtggcgcaatctcggctcactgcaacctctgcctcccgggttcaagcagttctgtacctcagcctcccgagtagctgagattacaggcgcccaccacaacgcctggctaattttagtagagacggggtttcatcatcttggccaggctggtcacgaactcctgactttgtgatccacctgccttggcctcccaaagtgctgggattacaggtgtgagccacagcgcccagctacggctttgagattttaaaggtagaattgacaactggagatggattggatgtggcagttgaaggaaagggaaatcaggaatgacccctaggtttctggcttgagcagctcagtgcaatttattaaaataatcacaattacaggaaatagttccatagtccatgctatatgccagccatagttctaagtgctttacatttaatttatttcattgttcaatattatgattagatgttactatcttcctccattttatagatgagaaaaccaaagaaagcacatagatggaggaaactgggggaagaatagctttcaaacatgttaggcaatgagaagttgatgaaagtttttgaacagcagagaggtatgaatcaaagctcttaaatatttttctttttctttttttttccttttcctttttttttttttttttttttttttttttttttttttttttgagatggagtcttactttattgcccaggctgcagtgtagtggtgtgatttcggctcactgcaacctcctcctctcaggttcaagtaattctcctgcctcagcctccctagtacctgagactacaggcatgtgccaccatgcctggctaatttttgtatttttagtagagtcagggttttaccatgttggccaggctgggctcaaagtcctgacctcaggtgatccacctgccttggcctcccaaagtgctgtgatcacaggcgtgagccaccacggccagcctcttgaagatttttctaatgacatctttacgaaatctacctctgtctgctagcagttgtaccttgaacgagttttttctctctctctctctctctctctctctctctctctctctctttctttttagagacggtctcactctgtcacccaggctggagtgcagtggcatgatcatggctcactacagcctcaaactcttgggctcaagtgatcctcccacctcagcctcccaaagtgctgggatcataggtgtaaactgctgtgcccaactctgtaaccaggtttttctaacctcctccattccttatgatttaacccagcagtatagttatcgatttggtgatgaaatttggggaataggtctaggctagagataagagattttggagccatatatgtaagaaagataattaaaaccatggtatgctaaagggttagtgtagagaaaatgtatgagtatagaactaaacttgaaaaaattggctgagtttggtggctcatgcctataatcccagcatttggggaggccaaggcaggaggatcacttgagcccaggagttgcagaccagcctgggcaacatggcaagaccccctctctacaaaaaaagaaaattagctaggcgtggtgacacatgcctgtagtcgcagctacttgggaggctaggtaggaggattgcttgagcctgggaggtcaaggctgcagtgaattgtaatggcaccactgcactccagcctgggcaacagtgcaacaccctgcctcaagaaagaaaaaatccttgccactgttttcctcagataccatttctgctttctttggtcatactttcttatgagttatctgcaactcctgtttttatttcctcatttctaatccatcctcaaacatctgcagtatgacttttgccttcatatctctactgatttctcagcaataacatcaaatacctccatgttactaaatcctgtagacactttttagcccttctcctgtctatggcaactaatattgttgatcacttatttatgcgtttagtcaacatatattaatttgtgtgtgtgtgtgtgatggggctagcctcatgtgtgcaagagtgaacagattggtatagtccctactttcatgaaactctgaaaacatcctaaaatatactattctgcttttcctcctacctctctgactactccttctcagtcctctttgcattcttgggtttatctgtttctaccccaagcactcactctccacattcttcatgaataatgttcatgcccacagattgaattatcatctgtatgctcacagttcacaaatttaactccagatcattccttatcttcagacacatataatcaagtacctcttgggtagagatcttcactctaacctaacgtataaaatgaactcatcacctccctattcttccccaaacttctgccatttcttatattttcctattttcagtgactagtaccaccgttcctcccttgccctaacctaaaacataagccttatcagccctagtgtcagacttcctgggttcaaatcttaattctacctttgtgtgtgtgtatgtgtgtgtgcgtgtctgtgtgtgtgactgcaagctccgccttccaggttcatgccattctcctgcctcagcctcctgaatagctgggactataggcgcccgccaccacgccctgctactttttttttgtatttttagtagagatgaggtttcaccatgttagccaggatggtctcgatctcctgacctcgtgatctgcccgcctcagcctcccaaagtgttgggattacaggcgtgagccaccgcgcccagccatcttaattctaccttttaacttctctgtatctcttaaaatagaggaagtaatagtacctacttggttatcaggtggtgcggatgtaaaaatgtacttagcagagtaactgacataaaatcataataaatatcaacagttatttgtttaaaccaccatcatcgtgtggctggatcatgtcaacagtttcctgagtggtctcccattagattatgagcccgtgatggtcccaaaaggtgaaaagaagggagattggtccatactttcacccaaaagtggaagagaatgaagttggaaaagctttcggattgatgctatattttgaaaatagtattggttcatttttccttaaaatatatgcatttttcagagaaaggaatggaaaataaaacaaatataaagaagataacatttgtaatcagcacccagagggaaccactaataggtatatatactcctctggatttagagttttgtatctttttttttttcttatttcaaagcatttttctgtatcatatttttcaacaatatgatttaaaaggcacatcccaacatagaaataaatacatgttcattgtagaacactttgaaaaatacagaaaaatattaggaagaaaaataaaactctcactatcctgcaataaccacttttaacgttctgctgaatatccaagctttttttttttttttttcttttgagatgagtctggctttgttactcaggctggagtgcagtggcgagatctgggctcattgcaacctctacctcctgggatcaagccattctcctgcctcagccgcctgagtagccgggattataggcgtgtgccaccacccccagctaatttttgttttttcagtagagacagggtttcaccacattggccaggctggtctcaaactcccgacatcaggtgatccacccacctcagcctcctaaagggctgggattgcaggtgtaagccaccacgcctggcctatcctagccttttttttctatacatatatagtcatactgtatactgtattgtttggtgtcctttttttgcttaacactttatgaattttctgtcataaaatattctataacattatgcagctatctgatttaccataactgtttgcattctctcaccttatacctggctttctaatttcccctattcccctattttaataacagaggaaataataatacatgagtatgttatacaaaattttaatgtacttctgatcacttttttaagaatgaagttttaaaatactgaaacactttttgactcacagagttcataggcaaaatgtgagaaaaatcatcactttgctctccatccttccttacaccctgaaattaaccttagggacagctagttcatttaacatcatcaatcttgttctccagttccaggtcctggaatctagctcttagtgtccgaaagaaacttacttttgtgtaagcacacctattatatactaggcactttacctaatttatctggtttaaacttcacatgcccgagagagatactatcattgtcttcatttcacagataagaaggttgatgagacattaactgtctcagtcacattcagggtagggattcaaactcacatccaatgcctcctcaacctcttttacgtgcagcactatcctctagccccactgcccgtatataggcctgggctatatcaccattgtccgcccttgagcctggaaggaaaatgagctgaggggttttgttttttcagaaaggaacaggatatttcatcatctctatgtttacgtttttcagagaatttctgtgcgaggaaacaaatccattgtcagctttttaaaatatatccctttggagtagccacttaacatcctctgaggcccagatgggctagcttgccgggaccaaaggaaatctttgggtctggaaggcgacaagagatcacaggctttctaggtctaccgcgcaccccgatgacgtcacgcggcgacgttctctgacgtcagagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgagttcagggcggttgcctttagggtgtgtccctaattgacggggtcggggacggagagaagggtaacaccaggctgggtcggagaccggcggaggcgaggaaatcctaagagcgtgaccgttgatgatgcagggaaccgtcgggtgtgaccattgagagggaaaaggttggagaaagggtctctaccatgatgcctgtggtgcggtgagggaatcctcgggtgtggcagcaggtagttgggggcaggaggggaagatgtgtttcggaattgagggtttagggggaccagaggccaggggtgtggctgatagagcctggaggccgtggggggaaccgtctttcttccccgctcggcgtcgttcactgagaggctgagacgtgtccagcaagccaaagggaaaagggattccctcaaaggtttgctcattgatgggcgaacgtcgtctctcgggtaacttgagggtaagagacaacctcttccctgctccgtaatggaggagcatatcgctagaatcttgaccacctggggaaagaagaggcattccttactcttggaggaaggaaagagtaacctccagaattgacccgatgtaagagagggggaagcaaatgggggcaaatcttaacccagcatcttttttttttttttctttttctgggctctgcagtaatggtctggtttgggaaaggctgtagattaagctgaaagtaaagaaactggaacgtcctgttatttccttatcatttgaatccaaatcatttgttcatgctgcttgttttcaagagtagtcttctattggaggggtggggtggggggggacaggcctttattgaactcacgcggatgcttcattaaacttttgacttttattttattttatttttgtatttttagtgacagggtcttactgtgtagcccagtctggtctcgaactcctgggcccaagcgatcctcccgcttcggcctcctaaagttttgtgattacaggcgtgagccagcgcgcccagccaaacttgacttttgagaagaaaaaatgttttgaaaactgccaaagacttatcataaccattgtggtttaaaagaaagtaaatgcattaagcttagaaaggcagaatgactaagaaagaaggtggtctcaatgagaatcaatttaaatgattagttaccttccttgtatacttcaattgcttagcctcagggtacacttacaaagtagtaatagaaagcagcagatgaaggaggtgcagctctataagaaaacgtgttaagacattccagtgatgactaagcgtgctggtaaggtgagaactgtttgcagtatcttagccgttgaaactttcaaggaagcagaaaggatgatgtataatgcaaacatcctcactaaaagctgggtggtaaaatcaatataaatctaatattctgactgtgtatgaagaaactcaaggaagtccagttctttcattctttctttccttaaaagatccatattttgaaatactaactttttaggcacaggtttgaacgaagctgagcaaggaatatattaaatagggcacgttctcctttctcttgtcctttctttccttctagccttaggttttccagagtttaatgttattttggttaagaattagatgtaaaacttttgaactcctttgcttcgttataatattaagaagctactttgtagtctgttatgtttaaatagaaatcacaggtgattttagcttttgtgtctcataatttcttatgagcaaggtaatacctgatgatgctattgtctttgcattattactgaatatttgattagaaatgaatttggcacctctcacctttataataaaagattactggaatgacatttctgctttataatttggttaactttggccagtttttcactatgagcactgagctttgtaaagtcccactttgtgaaaagaagggtttagtgactttacaaactaatttagcttcccagagagccatttgaattaagaccctattaatttttttctgaccttattctacccaaggtattaatcttattttgctgctcagtttctcttttggggaactggagggagatataggagaggagggactttgacaacctatatttggtagaaactaggttatgttaaatctggatatatagtcctgtgcagggaggccttctccgaaatgcagtgacatcacactctggtcgagggcaagtaagagtgattatgtgctttgactctggcagctttgttgtttaacagtggccttaggccataccgtaaatcctcagaacagccgttacttgtctggtttgatctggtagaaaggtagtgtgagttcaaattccatcatggctttgcttatttctctggctcttctgaaggaacattttctccccccataggagcagcttgatttttgaggcacttcagcaaatattagattttttttttctttagctctattttgtttactttttctgtaacttctttttttttttttttttttgagacggagtctcactctttcgcccaggctggagtgcagtggcgcgatctcggctcactgcaagctctgcctcctgggttcacaccattctcctgtctcagcttcccgagtagctgggactacaggcgcccgccacacgcctggctaattttttgtatttttagtagagacagggtttcaccgtgttagccaggatggtctcgatctcctgaccttgtgatccgcccgcctcccaaagtgctgggattacaggcgtgagccaccgcgaccggctgtaacttctaatgaagacgtcagtttttgccatcctgtattttggagactctggctatgtccatatctagcatgtgattaagtgtatctctcattatatgaggtgagaactcattatatgagagatacactgaatcatatatatatgtgatttttttttgaggtgaaattcacgtaccataaaattaaccaggttaaggcatacagttcagtggcatttagtacactgacagtgttgtgcaacaatcatgtcttctgatttgtttttatttacactattttcatttttcttggagtttcttttggcttaaggcaagaaccagcttggcaccatgtttctctgccaatatggttagggaatattttgttactattgtttacaatatggttactagagtgatatcccttctctttagagcagcagggactcttaatttagaatctatcttataggcttctaaagatacttgaccctcctctcttccctgaaattttgtgggtgggtgcattattttctagttaagacaagaacacttaatgctcacagtgaacaggatagtaatatattccttgacattgaaattgttaggggagataatgaaatatgtgagctactgataaaggtatgacttaagacttaggttaatttattgtttaatagaatgtagtgaaaatgcctgttaagaatttactcatgcctgtaatcccagcactttgggaggccgaggtggatggataacttgatgtcaggagttccagaccagcctggctaacaaggaaaaaccctgtctctactaaaatacaaaaattagctgggcgtggtagtgggtgcctgtagtcccagctactctgaaggctaaggcaggagaatcacttgaacctgggaggcaaaggttggagtgagcccaaattgaaccactgcactggagcctgggccacagtgagattttgtctcaaaaaaaaaaaaaaaaaaaaaagaatttaatgggctgggcacggtgatcccaacatgtagtcccagctactcgggaggctgaggcaggaggattgcttgagcccagaaggcagatgttgcagtgagtcccagctgggactacaggcatgtgctaccatgcccggctaatttttgtatttttattagagacggagtttcgccacgttccccagactggtctcgatctcctgagctcaagccatccgcacgcctcgtcctcccaaagtgttgggattacaggcgtgagccaccgtgcctggccaaaaaaaatttaatatgtgtatgtataagaggcttttcagagaaattgggtgacaaattctaaggaggttttgttttaaaatcttaaacaagttttaaaggacatagcatagcatagtaaatatcctagacagattgtaatggatttgagctatagtccttctttgaggctcaagtaatcgtttctgtttactggtttttctgtttgtatatatacattcataaataacttcagatttattccaggtcttttatgtgaagaattcctttcttcatttgcccacttcacatttagtttacattatgaatggactaaatgattataacattctttgaatttttgctagaaacacattgtaaaaacattgcataaggcaagcttcagtataatttttaattataacaagtattaaaggagaaatttctatattctgtaatgatatttgtgagtcctagctcacttcttttaacaagatcattctgtgaatttctggtacaatctaaagagctattaggatcaagactataaatagtaattagctggttggaaagatagcaaatgagtctaatttccattaaactgtacaagtagcacgttttagagatcagatttgaaccagaagtttttcattattttatgtttatctggctcttttttcttttctttaattacattgatttgtttggtgcttaggtcttttctcctagatccatatttactattgtttgccaaatacattatgtcatattgacctgataataatgagcaggtgccagcatgtcttgtcctgaagttggtgataagtattattagtgatggtgataaggaaaaagatactcattttgagtacagaaggaatattattaaaaaatatatgtatatttatatatttttttccccttgagacaaggtctctgtcgctgaggctggagtgcagtggtgagatcatagctccctgtagccttgatctcctaagctcaagcgatccacacacctcagcctcccaagtagctgagactacaggtacatgccaccatgcctgagccaccgcgcctggcccaaattcctatttatttatttatttatttgagatggacttttgctctgttgcccaggctggagtgcagtggcgtgatctcggcttactgcagcttccgcctcccaggtccaagcgattctcctgcctcagcctcccaagtagctgggattaaaggcacgtgccaccatgcccagctaaattttgtatttttagcagagacaggatttcaccatgttggcgaggctggtcttgaactcctgacctcaagtgatccacccggcagcctcacaaagtgctgggattacaggcgtgagctactgtgcctggccccaaaattttaatatatttaaagaagtctggtacattggacaaagtcttatagtttctcaaatcagaaaaagtagtcttattatttagtaaaaatgtgaccagactgtgccgtttttgttagtagagccatttgtcatctggattacttcttctggaaattgggatggaagagttaaggttgaggttgagatccacgttcttttgtttcaacaccagtttgattctcgtgtctgaacggatgtctcagtcttttgccttgtttttaactataaactggcattatttgggaatactcttgggctaaatctggattgttggaagtaagaaagccacatttttttttaaatccaaaaatatagttagatacaatgaataagatctagtatttgatagcacaaaagggtgactgcggtcaacaataatttactgtacatttaaaaataactaaaagaatgtaattgaattgtttataatacaaagaaaggataaatgcttgaggtgatggatatcccatttacactaatgtaattattatgcattgtctgcctgttatcaaaatatctcatgtacctatacgcacctactaaatacccacaaaactaaaaattaaaaaaattccatgcataagtcatggttgcctctctagatgtttgttgtgaaagaatattgtcctactaattttgaattttttttttctgaaagagattctttttattgaaagtttcatgtcatagatcggcaaaattgttttttcttttgaccttacactgcttcagaatatatgttttggagtgattccagcttgaggcaaggaagttaccagattttcctgaatggaaagtaattgcagatatatttataaaaaggtccagctttagctcttgaaagctttgaggagttactgtggataaaatcacaaagccataataggttcatacttttacccagttgcatttggcctttagatttttgccccattagcttgaggagttacattcttagtttttcttgaaccatcaacggtggtgataaaggaagatgatactcatttttagaaattcttaaatataagtgttcctaaaattaattggatgttcttaaaattaattggatgccttgttggatatctataacctgaatgaaggaattc

SEQ ID NO: 149 - protein, 881 aa, Homo sapiens
MAAPGAPAEYGYIRTVLGQQILGQLDSSSLALPSEAKLKLAGSSGRGGQTVKSLRIQEQVQQTLARKGRSSVGNGNLHRTSSVPEYVYNLHLVENDFVGGRSPVPKTYDMLKAGTTATYEGRWGRGTAQYSSQKSVEERSLRHPLRRLEISPDSSPERAHYTHSDYQYSQRSQAGHTLHHQESRRAALLVPPRYARSEIVGVSRAGTTSRQRHFDTYHRQYQHGSVSDTVFDSIPANPALLTYPRPGTSRSMGNLLEKENYLTAGLTVGQVRPLVPLQPVTQNRASRSSWHQSSFHSTRTLREAGPSVAVDSSGRRAHLTVGQAAAGGSGNLLTERSTFTDSQLGNADMEMTLERAVSMLEADHMPPSRISAAATFIQHECFQKSEARKRVNQLRGILKLLQLLKVQNEDVQRAVCGALRNLVFEDNDNKLEVAELNGVPRLLQVLKQTRDLETKKQITDHTVNLRSRNGWPGAVAHACNPSTLGGQGGRITRSGVRDQPDQHGLLWNLSSNDKLKNLMITEALLTLTENIIIPFSGWPEGDYPKANGLLDFDIFYNVTGCLRNMSSAGADGRKAMRRCDGLIDSLVHYVRGTIADYQPDDKATENCVCILHNLSYQLEAELPEKYSQNIYIQNRNIQTDNNKSIGCFGSRSRKVKEQYQDVPMPEEKSNPKGVEWLWHSIVIRMYLSLIAKSVRNYTQEASLGALQNLTAGSGPMPTSVAQTVVQKESGLQHTRKMLHVGDPSVKKTAISLLRNLSRNLSLQNEIAKETLPDLVSIIPDTVPSTDLLIETTASACYTLNNIIQNSYQNARDLLNTGGIQKIMAISAGDAYASNKASKAASVLLYSLWAHTELHHAYKKAQFKKTDFVNSRTAKAYHSLKD

SEQ ID NO: 150 - DNA, 1231 bp, Homo sapiens
gggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaagagggaggaaaaaaaagaacctacttaagatagaacatggttttggctatggcttgactcatgggctttcagtgcttttttccatttgttgaaagtaacatttctctctctctctctttttttttttttttttttaaagcaaaccattgtatgtgtaagtgtttaagttacctttttgtctattggtctctttgccagccctcccctttcccaatgaaagccatgtcaaattaatcactgaaaaaaaaaaaaaaaaaa

SEQ ID NO: 151 - DNA, 2334 bp, Homo sapiens
ctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagcttcaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggaggccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccataacaaatacagataaaaacacccagctgggtgcagtggctcgcacctgtaatcccagcactttgggaggctgaggcaggtggatcacctgaggtcgggagtttgagaccagcctggccaacatggtgaaatcccatctctactgaaaatacagaattggccgggtgtggtgtcacgcgcctgtggtcccagttacttgaacctgggaggcggaggttgcagtgagccgagattgcaacactgccactccagcctgggtgacagagcaagagaccctgtctcaaaaaaaaaaaaaaaaaaattaaatgggtagtgacgttaagagatatatatcagcttctagtaaaagtttttttttttaaacctgctagctacatttacattatgtaaaaataaatggaataatcactgagaataaagcagttgagtatttataacaataatattttatggggcgcttataatgtttataatattgtaaaccactgtgtactctattcatttaatgctaaatgacttgaccattcttgtgggataagagatcattaaaaaaatgctagggccgggcaccatggctcacgcctgtaatcccaggactttaggaggccaaggcaggtggatgacttgagctcaggagtttgagaccagcctgggcaacatgatgaaaactccgtctctaccaaaaatcaaaaaaattagccaggtgtgatgttgtgcgcctgtagtcccagctacttgtgaggctgaggtgggaggatggtttgggccccggaggtagaggttgcagtgagctgagattgtgccactgtattccatcctgggcaacagagccagaccctgcctcaaaaaaaaaaaaaaaaaaaaaaaggcctggcacagtggctcacgcctgtaatcccagcactttgggaggctgaggcgggcaaaacacttgaggtcagacgtttgagaccagcctggccaacatggtgaaaccccgtctctaccaaaaataaaaataaaaattatccaggcgtggtggcatgtgcctatagccccagctactcaggaagctagagcacgagaattatgtgcatcctggaggtgaaggttgcagtgagccaagatcacaccactccactccagtctggacaacagagtgagaccctgtgtc

SEQ ID NO: 152 - DNA, 4150 bp, Homo sapiens
gggggcagaaagttgccggaggtctccgggtggtatcgccctttcctctttgccagcccgctggcgagccgagccggggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggcaaaaaaagcgcgtggtcttctgccaaagtgaaggtgaccgacacagactttgatggtgtggaagtcagagtgtttgaaggccctccgaagcccgaagagccactgaaacgcagcgtcgtttatatccacggaggaggctgggccttggcaagtgcaaaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgccaggattgtccaggagcttcctcagttgctggatgcccgctccgccccactcattgcagaccaggcagtgctgcagctcctcccaaagacctacattatgacgtgtgagcatgatgtcctcagagacgatggcatcatgtatgccaagcgtttggagagtgccggtgtggaggtgaccctggatcactttgaggatggctttcacggatgtatgattttcactagctggcccaccaacttctcagtgggaatccggactaggaatagttacatcaagtggctagatcaaaacctgtaaaggagcaaaacttccagaagcctcgagcccctcttgacctcctacacctgctttggaaagacatgcactttttagttgactaattcttcctcccattcccctctacttgcgagttatggaatttctattccataactgaagtctttatgataacctaatttttaaaaatgaatttgactaacttaagtgcaaaacatgtaaatttggttcccagagtgggccaatctctctgttcttgttatcttagccaactatactgatacctacagctacagaaagcaggactaggaactggaaataactttgggtcctgccttcattaggacgttctttttagaagcagttcttccagctctggatcatagagtgacctttaataagttaaaaaaacgaggactccttaattctgctagagttaaccttgagttcagagcagtattaaatgcgtgcactttcaggtcagtactggggaccaagtaccctctggtcttttgtgaatggatggttttgtttcctatgggaattttggcaaaggttttctggaaagaacaagtttctcaaaggactttcttcctctagaatgttcattttatgagatcgctatctgtaagtccagttggattacaggaatacttgaaagttactttctaccactattagaaaatatgaagtcgcatgcactggatatctatatatcattaggtttttgttgtgtttttggttatgctgtcccccttctccttggggagatatttgggagcaaacttatttagatttagagtaaacttttcattatagagcaagtaaaaacagacaaatgaaacaacctagtgtttcacataaaaatacttctgacataaagtaccaagagcagtgtgaatatacttggcatagtcaaaaaagaaaatacatttaatattagttcaaaattgttaaaaatacctttagaaggtctagtctattattgaaaactcaattttttcacttatatggctttaaaatggagctattttgctacaatataatgtattgtttatttttttaagttatttaatgttaatatacatagctagacttaaggtttttcagaaagatgtccataataaatattaaaaacaatggtattttttaaaaaactgccttagggttttaaaaccttccctacagttataaccacgtgtaattttgtggaaatgatataacagctattaatactactataacataggcataaatattttcgtgtttatatgcatatacaagttaaaataattagaaactatgactgcgcctagtaaagtcatctaggtttatagttcagtagcttaggcaaggcacacactgctcatctccgctttttagggtcagaggaacacaagctcatgttctgagtgaagggcgtatactggcacctggtgttgcctagatcccccatctcctccttccagccaggtctggaagtttcaacagcccaagcttaacttcatgtaaagtcttcactgccagtggtaacatctttgacacaacaagacactccaattgtgatttgagttgaggatctctgcctgccttcctgccgtccttccttcttccccgatccatgctacttttaggggctgcggagagcagcagcagagctgagtaatgatacagggcaccacggagagaaagtagaaccatttcactcctgggaagatggggtatttcccacttccagcaacgaaataacaaatgaaaagttgcatacttattgatgtattgtatgagccagtagcattttatgtacaaaacagaagtcaatgcaacagtatgtatgtgtgcctgtgtgtgtataaaaataaccattgaagctaacttgctaatgtacttaggcaagccacttcccatctctgggcctcgtctttcctccctctaaaatcaaagagctgaattatgtgatccttgaggtctcttccacttataataccaactgtcttgtcagactggcaaattatattggcctctccttatgtggtggtttttttggtaggtcatagttccttatacacagacacctgcatcatcgaaggtctttttttcctaaaaaaaaaaaatgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttcccaagaattgtgagccaaagcctatagtaattgcagacagcaaatgattccggatctctaaaaggctctctcagatgaaaagggagtaaaggaagaaagaggtcaaccactgtttctgataatgtacttgagtttcattgttcttttagtttgtattcttataaaaaatgtttacactctgcagattgattttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggggaaggtagattttatgaatgattttaatagcaaatatattttataaagtgaaaatccagtgtggaggtagcaaagcatctatctattctgaatcatgtttggaaataaaattgctccatctgggaatgtgcaaaaaaaaaaaaaaa

SEQ ID NO: 153 - protein, 462 aa, Homo sapiens
MASPALAAALAVAAAAGPNASGAGERGSGGVANASGASWGPPRGQYSAGAVAGLAAVVGFLIVFTVVGNVLVVIAVLTSRALRAPQNLFLVSLASADILVATLVMPFSLANELMAYWYFGQVWCGVYLALDVLFCTSSIVHLCAISLDRYWSVTQAVEYNLKRTPRRVKATIVAVWLISAVISFPPLVSLYRQPDGAAYPQCGLNDETWYILSSCIGSFFAPCLIMGLVYARIYRVAKLRTRTLSEKRAPVGPDGASPTTENGLGAAAGAGENGHCAPPPADVEPDESSAAAERRRRRGALRRGGRRRAGAEGGAGGADGQGAGPGAAESGALTASRSPGPGGRLSRASSRSVEFFLSRRRRARSSVCRRKVAQAREKRFTFVLAVVMGVFVLCWFPFFFSYSLYGICREACQVPGPLFKFFFWIGYCNSSLNPVIYTVFNQDFRRSFKHILFRRRRRGFRQ

SEQ ID NO: 154 - protein, 836 aa, Homo sapiens
MARGERRRRAVPAEGVRTAERAARGGPGRRDGRGGGPRSTAGGVALAVVVLSLALGMSGRWVLAWYRARRAVTLHSAPPVLPADSSSPAVAPDLFWGTYRPHVYFGMKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSQLGNFRFTLLPPTSPGDTAPKYGSYNVFWTSNPGLPLLTEMVKSRLNSWFQHRPPGASPERYLGLPGSLKWEDRGPSGQGQGQFLIQQVTLKIPFSIEFVFESGSAQAGGNQALPRLAGSLLTQALESHAEGFRERFEKTFQLKEKGLSSGEQALGQAALSGLLGGIGYFYGQGLVLPDIGVEGSEQKVDPALFPPVPLFTAVPSRSFFPRGFLWDEGFHQLVVQRWDPSLTREALGHWLGLLNADGWIGREQILGDEARARVPPEFLVQRAVHANPPTLLLPVAHMLEVGDPDDLAFLRKALPRLHAWFSWLHQSQAGPLPLSYRWRGRDPALPTLLNPKTLPSGLDDYPRASHPSVTERHLDLRCWVGLGARVLTRLAEHLGEAEVAAELGPLAASLEAAESLDELHWAPELGVFADFGNHTKAVQLKPRPPQGLVRVVGRPQPQLQYVDALGYVSLFPLLLRLLDPTSSRLGPLLDILADSRHLWSPFGLRSLAASSSFYGQRNSEHDPPYWRGAVWLNVNYLALGALHHYGHLEGPHQARAAKLHGELRANVVGNVWRQYQATGFLWEQYSDRDGRGMCRPFHGWTSLVLLAMAEDY

SEQ ID NO: 155 - DNA, 2064 bp, Rattus norvegicus
ctttttgtcattaaaggacgttggaagaggcttgcaccaaggctgtttgcttgtccagccctagctcttttcttctgcgcatgggcctcttcgatgcttgaagcttagcgtccccccatgagtacgcgcttcctgctttcccgtgcttgcttgcctgtgctctctggggcagctttatgacaaccgtcccgcgtgtcaggcgttcccgatttccccgtggtggttgtcgtccgttgccggtaggagtcgttggtgccgagtgcgactggaagggttttcccgtttggtgctagtgaccccctggcgtgctcctctgcggccgaccggtttttttatttgtttttttttttttgttttttttgtttttttttttttgttttttggaaggagttcccgaacctccgctgcttggtggtgtgtccctttctttcctgctgtgtgcctcccgagttgcaccttttctccttcgaaggggattttatttttttatttttattttttttttatttttattttttttgaaggagttcccgaacctccgctgcccgttgagtcccgttcttccacgccacgtgcctcccgagtgcaacgcttccttttttttctcgccctcgagaagggtaaattttttttttgtgtgtgtggcagtgttagcgacttcttcccgtgctctctctcgctcttctcgctcgtattcccgtccagtgcgtgttagaaagctctcacgcccgttgttcccgatgcatggcgtgtctcgctcccgttggatcgatgtggtgctgccgcgttctcttcgggccggggcctaagccgcgccaggcgagggacggacattcatggcgaatggtcattcagcgcgaatggcgaccgctcttctcgttctgccagcgggcccctcgtctctcctccccattcctttgcagggtggtgtgtggaagtcaggggtgcggctgtccggcacgagcgctgacccgcgcacacttgctgctgtggttcgcggtgtccctgtggacgtgtcgggggcgcttgcccccacgccgttcactgcttcgcggccctcttcccccgtgccgggggaaggtggtagacccgctgcggtgcatacccttcccgaatggtccccccggtccgcgaatgctcaagaagaccccggagaaagagacctttgccgataccgcagaccccccaccagctggcgcgtggtccttcccgttctgtcccgcgcctgttgctcgtttcccgttgcgtgcacggagcccttggctgctcgtcggtgttgggttcgtcccgccctcacgtttgctctctcgcctaccgcgacccgcgcctccccgctctgagtacgaggagggatcacgcgggacggggctctgtcgacctgccgctgtgcggagcttgtgggggagattgggtttctggtggcagcgttcccacggccggtggagatcgcgggagccgtcctacccccccttccccctccgcggggctctcgagggtccgtgaaccgcggggttggcctcgctctcgggggcggacttcttatttgggggaaccggcggtcggccgcgtccggcgcgtcgtcggacgttgggacccgctgccacgcgggggtcttcgtcggttggtggagcgatttgtctggttaattccgataacgaacgagactctggcatgctaactagttacgcgacccccgagcggtcggcgtcccccaacttcttagagggacaagtggcgttcagccacccgagattgagcaataacaggtctgtgatgcccttagatgtccggggctgcacgcgcgctacactgactggctcagcgtgtgcctaccctacgccggcaggcgcgggtaacccgttgaaccccattcgtgatggggatcggggattgcaattattccccatgaacgaggaattcccagtaagtgcgggtcataagcttgcgttgattaagtccctgccctttgtacacaccgcccgtcgctactaccgattggatggtttagtgaggccctcggatcggccccgccggggtcggcccacggccctggcggagcgctga

SEQ ID NO: 156 - protein, 1000 aa, Homo sapiens
MVPAARAHPTRAPPHALPTPRAPPRAPPPSPRSARRRPFPAALPGAASARSPREALLSLRERLLLFLQLFPASSRFSSSSSTVACPGRGRARPVCWKRSEMATCAVEVFGLLEDEENSRIVRVRVIAGIGLAKKDILGASDPYVRVTLYDPMNGVLTSVQTKTIKKSLNPKWNEEILFRVHPQQHRLLFEVFDENRLTRDDFLGQVDVPLYPLPTENPRLERPYTFKDFVLHPRSHKSRVKGYLRLKMTYLPKTSGSEDDNAEQAEELEPGWVVLDQPDAACHLQQQQEPSPLPPGWEERQDILGRTYYVNHESRRTQWKRPTPQDNLTDAENGNIQLQAQRAFTTRRQISEETESVDNQESSENWEIIREDEATMYSSQAFPSPPPSSNLDVPTHLAEELNARLTIFGNSAVSQPASSSNHSSRRGSLQAYTFEEQPTLPVLLPTSSGLPPGWEEKQDERGRSYYVDHNSRTTTWTKPTVQATVETSQLTSSQSSAGPQSQASTSDSGQQVTQPSEIEQGFLPKGWEVRHAPNGRPFFIDHNTKTTTWEDPRLKIPAHLRGKTSLDTSNDLGPLPPGWEERTHTDGRIFYINHNIKRTQWEDPRLENVAITGPAVPYSRDYKRKYEFFRRKLKKQNDIPNKFEMKLRRATVLEDSYRRIMGVKRADFLKARLWIEFDGEKGLDYGGVAREWFFLISKEMFNPYYGLFEYSATDNYTLQINPNSGLCNEDHLSYFKFIGRVAGMAVYHGKLLDGFFIRPFYKMMLHKPITLHDMESVDSEYYNSLRWILENDPTELDLRFIIDEELFGQTHQHELKNGGSEIVVTNKNKKEYIYLVIQWRFVNRIQKQMAAFKEGFFELIPQDLIKIFDENELELLMCGLGDVDVNDWREHTKYKNGYSANHQVIQWFWKAVLMMDSEKRIRLLQFVTGTSRVPMNGFAELYGSNGPQSFTVEQWGTPEKLPRAHTCFNRLDLPPYESFEELWDKLQMAIENTQGFDGVD

SEQ ID NO: 157 - DNA, 1820 bp, Homo sapiens
cagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataatatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattaatacagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttggacaaaaaaaaaaaaaaaaaaaaaaaaaaaaaaa

SEQ ID NO: 158 - protein, 617 aa, Homo sapiens [sequence omitted]

SEQ ID NO: 159 - DNA, 6255 bp, Homo sapiens
ggcgcggaggaggaggcggcggcgtcggtggcggcggcgacggcggcgcggaggcgaaggcagcggcgggcagccgaagcagtggctctcggagggggaacaaagagcagcgactaaggcggcagaggagcggcggcggtggcggcgctgcagcagcgggcgggactggtatggtggttccacagggcagaccccgctgcactcacagggaggaggaggcggcagcggcggaggaaggcggcgcaccccgagagcactaatcgctattttctttggaaacttcctttgattctttacctccttcaccttccccgaagagcctgctaaccaacacctgtggccttctgtttttaactgttgttgccattgacagcgttgtgaatggtcatctcgctcgagctctttggatttgttgttactgtgcatgcccaaagaaaaatacgagccccctgaccctcggaggatgtatacaattatgtcttctgaggaagcagcaaatggaaagaaatcccactgggcagagcttgaaataagtggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcagggagctccatttaaataacaacctgttacgagttctaccttttgagctgggaaaactgtttcagttgcagactttaggcctgaaaggaaatccccttacccaggatatattgaacctttatcaggaaccagatggaacaagacggctgctgaactatttgcttgataatttgtcaggtactgcaaaaagaattacaacagaacaaccacctccaaggtcttggattatgttacaagaaccagataggacaaggccaactgccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaaatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtctggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggtagtcaagcaccttcagaggacagccttgattcacttgtaaacttgtgaaaatctgaacataggggagtgaggtatggccactgaggatttttgcttgcttaagaatgatttggactttcaatctgattatttgataaggatatagtatgaaagccaggtgctagcaacagacaaattctgagcccaatatgctttatactgctagacagggattggtgtgtttgcacctgtctttcatttgtcataagagattttcctatttcttctacccaatagaatattttcatgcctggaaataggaaaatgtgtgaacagcgtattctcttcacacagaaatctgtagcactgcttttttgaggccagtagcaacatccagagatcattcttccatactttactccctcctttttcagacttgtttgtaaagtacagaatctgaatttagcctttatgattgtatatgatccacagaagacctgatttatgaaattttgtactaaaatcatttggaaatgattgtattgtaaactgaggctaaatttttttttaaacctgtttcatgtgttataaaggccagcttgtaaaagaagctgcaacagactttctctgctcatgatttgcactcttagggttttgttagcccttttgtactactttctttttaaattgagaacatggttctttacatataaatctgcttcaaccttaggatgttttcagaccagaggcaacttattcatgaatttttatgaaaactatctactaggacagataagctgaacagtgatgatctgtagacatttatggactgaatgtaatggttgatatatgtacattctgatatttttaaatctttaactttttaaagttaaaaacctacagctgcttaggtccagcttcttaactctttttgagacacttcctgtcctatctccactgtgcctgcctaaatttgttctcaccaagcactgcctgtgcatgcagagaaaatctgtgcatcctcttttatatttttaaaatactgtttaacatttgtgagaattttatgaaaatgcttttgtatgagctgtggctttttcccattgtgaagcattgaatatcacattttggaacatgttatagggtgagtccctggatctttgctcaccagatccaagcactgcttctcggtgtcattgcagtgtgctgcttgtcacccagaatactactatcatgtgaattctttttgtcgtcagtgtcttttccttagtctttttgttgttgttgttgttgttgttttaatcattccttttttaagaagaagtaattttccatttatgaagcagtatgaattagatgtattttcaaaacaggtccctaagacaattcttcagatcatttttaaaatgactaagtcattttagtatgtcaagcaagataaaaattacatcataccgtctattttgcccatagtgccatttagagatgaaaaccagctttaactttgcaaagtgaacatgtacatggtctgctctcatttattcattcttctctcaaaagtcaaatgaatgcagagggagcttggtcaaactgcttttgtttcaactgcaggcaggggagcaaaaggacgccatgtgagcattaggaaaaaaaatactcactcttactaacaatttttatacagaaaatgagtcattttggaaatgattcttatgttttttttttttctccttttagaaaattctccaaaaggttttgatgttgaatcttggtcttggacctgttttttcctttgagggttttttgttttttgttttttctaggatttcattgtgatgttttggttttgttttttgctttttgtttaagttgtgctgacaccaaacacatccagtttataatcagtacattggaaagctggtattgatgtagaaccagtgcataactttttatggggttttgttattggtttttttttgtaaagtgtgaataaaaggtatgtttactcatttttcctgaacactgtgttggtaatgtgcatcatgacaatttccagtgaaggtgagctggagctggttggactaatgagactgaggaagcagcttttcctacgatctgcattatgtaatcacaggtccagagagctttatggaagcgggagaggaggagcacttactcatgttgtatttgttaatggaggatgtcatcttttcatagatgctggaactagagtgcacttgttagatgctaaaggtttgagctttacacaaaatgtcttcatctgtatttgttattgtctacaatatatttgaatttggggcagcatattaagatgtaatggcctgttatgtcttgaaaatacttgttttgcctcttccaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaataaaaactagtatgttttcacggtgtatattttttttcaaaaattctgtaacaaatatatttaatgtgttgccataatgtcatttcagtatttttgctggataaatccattttagaaatgtcttacaaaaagtttagggcatgttttctgttttaaagaccagaagtttgaaggcacccaaatccttgtcgccaatctcctgaagtacagctttaccatattagtggtcattatttatgctttgagagtttcaatattgttcgtcaagttaacttatggcataatttaagctaaagttgtagaaatgaattgttgagtgcaactttcatagtcccaaagataggcagagaacatctccagaaatgtgtgtgtgtgtgtgtgtgtgtgtgtgtgtgtgtgtgtgtttaatatgatttagtgacaaccaggaaaacttacttgggattattagcactttcaaacttagggacattattaaattggatggaatgcacttctaaatgtttaaattaaaatttcaaagctctttcgagattcaggttctcaataataatattcaagttttagagtttcactttgtactatttaaatttatggaactagtttccatactgacttgtaaggttttggggtcatatataaggactaaagccaagctaggcaaaacaatgacagcaccgttttttcagtgaagctctcagaatgtccagtacagatgttgcagataattccaagaactccttcagcaggtgttcttcaccattcgtaaacagtattttaagatgttcactttgctcttctttttggttacatacattttaataactggtatgttgaagtagtgtctaaaagtatctagtctttattcacagtacattatattgtgtgatgcactggactaactcttgtttaccattcatgtaacaaaacccagcacattatctgcactataagctcaaagaatgtcacatccgcccagacagctctttgatgagggtgatgggaactgaataaaccatacggactggcagtaacaagggcttttactgttctgttcagtggaaccttcttggtcaaattgtaattagctagcattatatttatatacagggtcttttttctttaccgatgtattttcctactcatagccaaccaataaattcagtatctgtttcaaatattttagaagtgtagtttgtatagctgtagtactgaggtttgaggaaaaataaatgttgatcagcagaccacgtatttaaaattctgaatcttctgggacagggttgtaactcagccttccaaagggaagagtgcagggggacggggccatgatatggggaaatggtgtaaactaatgtatttctttattggctgttattctgtataacactcatatctttgccaaagttcaattttatatttaggcaactgatggtccttttgcatttaggattttcgttgttgttaccttatacctcatgatataaggaatgggctcatgtgtcttccgtcttttggaaggaggttgacatattttaaataaatgcttttaaatac

SEQ ID NO: 160 - protein, 197 aa, Homo sapiens
MPIPASPLHPPLPSLLLYLLLELAGVTHVFHVQQTEMSQTVSTGESIILSCSVPNTLPNGPVLWFKGTGPNRKLIYNFKQGNFPRVKEIGDTTKPGNTDFSTRIREISLADAGTYYCVKFIKGRAIKEYQSGRGTQVFVTEQNPRPPKNRPAGRAGSRAHHDAHTCLSALPERNSTNYFVQPCCCLRLLGLTGLLSK

SEQ ID NO: 161 - DNA, 2239 bp, Homo sapiens
agagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaataataacatagatgccgcaatagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacagagatgtggtgcaattgctgaacaaaccccgattttgttgttgttcctccttaggaattctaggaaacaaggaaaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttaaaaaaaaaaaaaaaaaaaaaa

SEQ ID NO: 162 - protein, 584 aa, Homo sapiens
MFAKAFRVKSNTAIKGSDRRKLRADVTTAFPTLGTDQVSELVPGKEELNIVKLYAHKGDAVTVYVNGGNPILFELEKNLYPTVYTLWSYPDLLPTFTTWPLVLEKLVGGADLMLPGLVMPPAGLPQVQKGDLCAISLVGNRAPVAIGVAAMSTAEMLTSGLKGRGFSVLHTYQDHLWRSGNKSSPPSIAPLALDSADLSEEKGSVQMDSTLQGDMRHMTLEGEEENGEVHQAREDKSLSEAPEDTSTRGLNQDSTDSKTLQEQMDELLQQCFLHALKCRVKKADLPLLTSTFLGSHMFSCCPEGRQLDIKKSSYKKLSKFLQQMQQEQIIQVKELSKGVESIVAVDWKHPRITSFVIPEPSPTSQTIQEGSREQPYHPPDIKPLYCVPASMTLLFQESGHKKGSFLEGSEVRTIVINYAKKNDLVDADNKNLVRLDPILCDCILEKNEQHTVMKLPWDSLLTRCLEKLQPAYQVTLPGQEPIVKKGRICPIDITLAQRASNKKVTVVRNLEAYGLDPYSVAAILQQRCQASTTVNPAPGAKDSLQVQIQGNQVHHLGWLLLEEYQLPRKHIQGLEKALKPGKKK

SEQ ID NO: 163 - DNA, 28519 bp, Homo sapiens
cttactgggcaggacgccctccacagtgtcactggcctcggagcccacagtctcggcgggaccctcctcccggcgcttcttccgcaggcgactctggatccctttcaggggcctctcagtgggctcctgttcccgcttcctgcgaaggcgattctgaagctctttcaaggtcaggccatcgctgtcactatcggaggtgtcatcgtggtcatcccctcctttcaccttttcagaagaggctggtcgttccttcacagctgtggaagcagactgggggccgcttctggtctcagaagcgctttccacgctgccctcggaggctgtctcggcgtctgtggcggggcaggacgtgggctcaccagaatcctccagggagacaggcatgctcctcctgccgcggcgccgcgcaatggtcaggaactgctccacgcgctcagtgcgcttgggctgcctcccactgcgccgcagggacaggcccagctgctgctgtgggggtggcggctccagtgggtcagcctccgcgtcccctgcgccctctcgcttggcgatagtggtccttcgaaaaccccatgttttcctgaactctttgctggtgggtttgatggccttaggtgcctcctcattgctcgggtcgcctttgtcgtccatacctagcggtaaagtgtaagcacatagtgaccaactgaccacagaacaaaaggtgacattgccgccaaacacgcgcagcaggggccacctccctacaaacagtggagctctacataaagcaagtccttctgaccagtgtttcctaatgtgtgctatgtgagatgattcaagatgatttgtaaagataattttaatatagttaaacaactaacgtttagacaaaaatacagctaacaaatcaaatgtacaatttcatcatttaactgctcaggacaaggcttcacaagccagacagtagggacaaataggaaatattggacagtatagcagggtaaggatgtgagtaaggacgtgagcaaggacgcgagcagctcggaggtggcacgagctccccagcacctccgcaggcagatgggctgctctgaccacaagcacagtgaacaagacgctgtgccagtttgggtgtggcctgcaaagggacccaagtctgttctggacttttgcaagtatgggctggccaccaccatgctgaaaagaggatatgaagaagctgagtcccgactttcagctccccaaccaggggctggggccaggaaggatgctatcactatctgggaccctccataccagccctgctgccaagtgaatgaccctcacgggcacaatgtgagagaactgcctaactcctgacccaacagattgtgtggtatgaaataaaccttgttttagtctactgagctttggagatattgttagcagcaagacaactgggacacttagaaaacatggtcaaggcgatcactttaaggtatatttctttttttttttttttgagacggagtcttgctctgtccccaggctggagttagccactgtgccaggccagtatatttttttttctgtattatttttcactttcattctaatacattactaaagaatcttatttatgaaacttttactcttgttgaaatgacaaaaatctgaaaaagacagtagatactttgagaattcttttccaagctgtccaagctttaattacatttcaatgctaatgatgactctgattttatgccatgttccatcctgggggaaggactggcataaaatgaaagccttaaaaaatatacaaaatggggccgggcctggtggctcaagcccataatcccagcacttcgggaggccgaggcaggcagaccacttgaggttaggagttcgagaccagcctggccaacatggtgaaaccccatctctattaaaaatacaaaaattagctgggcatggtggcaggcgcctgtaatcccagatacttgggaggctgaggcaggagaattgcttgaatccaggaggtggaggttgcagtaagccgagatcgcaccactgcactccagcctgggcgagcaagactcagtctcaaaaaaaagaaaaagaacgaaaatacaaaatggaaaattacttgcaacctgtaacctgtgttgttctttttgcttccctctaaatgctgtcacttctcattttcctgtccagctaaagatgctgcctggccgtggcctccacgctctgtaaacatgacccacaccccccagggcactccacggaagccttggagataagggacacatcacttctatgctcacctgaagtgaccccattgttaaaggacacagctcaactcaatcagggcaccagcagcgactccaagtcagggtgcaaactctggaggctgctgtgtgaggggggcactagagatggtggtaaacagaaaggggggcttccttcaccagccaggtgaccccaggcaagtcacaaggaaccgctctgatccaggaggcaatgctgacctcaaagattaagggcaaagcagagaatgctgcttacaaatatatatggtagagcaattattaaaccacatcagttaaaatggtttattcgttctcattggaaattttacatttagaagaagttttctgcttgtgcaagccaaaatatttgcaagaaatatgactgtcatctcaaaagagggtcaagctctcgttttcatgcaacacttggagtttctagtaaagatgtagtctgaggggctcgcactagcctttgcccagaagggcacaaagttgcagtcgcctctgcctctgggggcctatgaagctccaacccagctgaaaagggctgctgcatccatgctggtagctttctacaggaagagctctagtttataaaactgggttctcattaaagagagaacaggctatttgcacatgacctatgcaaaacctctcaaatatttagatcatctctagattacatcatagaaacagttgctgtactacactgttttataacatttttattattttttattgtcagattattatttattgtttgtcccccaaatatttccaatctgcagctggttgaatccacagatgcagaatctgctgctatagagactgctgatacaaatggctgaatgtatttcaaatgaatacgaatactacattctactatcagtttctttacaaatgccactttataaatagcaaatacagacttattaagttaaaattttgttgctactaacagtgttgataccttacctgctccaacactgaaagcttggacacttttccctgaaatcctaaatacaaccaaaaaccctggcagacgaaacctctgggtccaagcagacagccaggctcacaacaacactgttgtcagccactgttcacgagtaacaggcttcgtattttcaacaactcagattatctagaggctgttcccgtggagtaagctcctaaaagaaaataagaaaatattttacatatcttaagtaaactacgtatcgacaacaattaaaagggagtaccgaacttctcaagtaacctattatttgagtgatactgtgtgacccacaaagacagcttgggggttgaaaaccagcacgcaagcagtgtccttaaggacctctacccaggacagcagatgctaccaacccccaagagaaaggggccggggcagcgcaggaaggagtggagtcccaggcttgccccagggaggcaggcagaggcccagccagaccagggccagagaggagtcgccaagcatcagcttcttttccatttggagcctatgtccgagatggaccccactcaataaaatccaccacaaaacagaggaacaagaacaaaaagtgaaaaggctgaacatcgaaattatataagaatgtaataattgaaaattcttaataatgtatctgaattattttaattaaaaacaagaaaaattttagaatactaatgtttgtgacgtactaaaatcaacacgatacagttcaccacgtgtgtttaagaaacaattctcttgtatcctctctcaaccagtcacatcacaacactcaaaggttccaggtgccgagtttctagctaggtccttgccccaaagccgacacttccaaactgagccccagctctcacctcttcctcagcctcaagaccaactgccttccctctgtggtctccctggcaacctcagaacaaagggacaaacattccaactcccctccttttaaagggacagtgacaactgggcatagtgtttcgcatctgtgatcccagctgcttgggaggactgcttgagcccaggagttcaacaccagcccaggcaacgtgtcaccatgtagacaccccgtctctacaaaaaataaaaataagacaggcattccctctgataagccaaacggcatcgtcatagtcaccatctcttcaatgtggtaaaactatcatcctcaaaacaattacttcaagaattcagaaacgactgctcagaaaacactggaaataaacttttatattttgcaacactgagcatttaatttattttactttactttttaaagagttggcatcttgctttgttgcccaggctggagtgcagtggcccaatcatggctcactacagtctcaaactccggggctcaagtgatcctcctggcttagcctcatgagcaactgggactacagatgcgtgccactatgcccagctaatttttgaaaaaaattcttttagagacagggttttgctatgttatccaggctggtcttgaactgctggcctcaagcaatcctcctgcctcagcctccagagttttggggagtacatgaacgagccaccatgcccagccaacactgaacatttataaaagcaaagaaattaagaagttctcgggaacgaaaactgatttttaaaaattcaatttatgttaatctgcgaataaacacgctactagatttgagttctgagtaatcagaaaaatgtagttatttctgttaagtagaattcaatgaaggatataccttcggaaaagatcagatcactttatatttacaaaactgatttcataatgtcttcaacagagaaaatttactataacatttcagtcagcttgtaaaataaaaacatatgtatatcaaggcacaagcaaaaaaacctgttctaacacaactttttgtgtgtataattagtgtgtaattctacacactacacagcccatcacagggggaatgtgttcataaaactgcaaccatattgtatcagtaacaacttttccccagaaagaaaaatgtgggtatccttgaagctgggaagtgaacaaactacaggttaaaacagaatgtaccaaatttaatatttccacatttctaagcacatttttttccccagctgaaaactgcttcattttctattgactagaagcagctgatgagcggcgattcaagcagaggacacacactgacttccaaatgcttgaatggcggctctcaaaccttttgtctcaagacacttttacaagttgagaacaccaaagagcttttgtttatgtggaatgtattgctattttcaaaattctaagtatgtattaaaaataaacctattaatacattaatagtatctttaaatgaaagttatttctaaaacaaacaaaaatgaacaggaagagtggccctgttgtacatttttgcaaatttctggcataaccgaagacagctccatgttcatgtctacttctgccctcaatctgttcccatagagtgtttcagctaaaacatgtcatcaaaatcttgcctcacacagataggtctttagaatggagtattgtaaccatcttcacataactggatgttcactgatactacaccaactctcgccaaggagcagtttcataaaagttagctgaaacagaatttgcagcctttgtcaaggaacttctccctttctttcatgaaaactgactgctgtgttcactctgaacacgtccttgcactctggacccatgtgcatgctgttcacctggatgacacgggttcaagtaacagacagattctcaatgtccacacatctcatcggatagcataaaacaaacattttttttcctgttgcccaggatggagtgcagtggtgcaatcaaggatcactgcagcctcagcacctcccccacccacaccaccgccaggctcaaagcggtcttcccacctcaccctccccagtagctgggactacaggtgcatgccaccatgcccaggtaatttttgcatttttttttgtagagacagggtcttactatgttgcccaagctggtctcaaactcctgggatcaagtgatctacccacctccgccttccaaagtgctgggattacaagtgtgagtcacctcacctggccgataatgtcgggtccaatctccaagaagactttaattactagaaagccatcaggtttacaatggcagatacaagttttctaaaattccaattttcaccccaaagctcaaattttatccttagcaacaaatactgttcgttttttctttgagacatcactcgttttggacaaaacgcctgccacatgctgagtctgaaaactgtcctccgtctgttgttctgtcagggacagacagcgtttccgagaccactcggctcccagctcaatcccctagggctgtgcgtggacagtaccacgtggggatgcagcagaagctttatatataacttgacatttaatcacagcgaaagtaaaaaagatgtatgtttgcgggttccgaaaaaaattaatatttactgcatcatcagggacattatttgggaaaattggcatattctaaacattcggtgcccatgcacggtgctgaagagggctccaatctgccctgtgccaccgatgcaaatgtcaaactcaccagaaaaggcctgtactattagactattattatgcagaagtcatctttacctcttagccccagaaagggcttcaaggacttccccctcaggagtccatgaaacacaaagaactgtggcaacatgccatttctaccagtttaggagtacactggatatgtgcaaagcagtaatacatacctatgcttcagacatcagaagagactttaaacatttccttccacaagggttctgtaactacctgttaatcttccctcagattccccaactcaccaaaacagtaagcagccaaaagtgaaatttcttaaaaaccaaataaaaatatcttcccaaaaggtcagctctgttactttaaaaagcctaactgcaactattacaatgcatgggtttgcaaccactgcaaatctgtatgctcaacttttactactctaaaatctgcttgaagtcattaactcaagcgtgcccacttccaggttgtggtacagctgcatgatcagggctcactgcagcctctacctcataggttcaaacgatccttctgcctcaacctgagtagctgggacaccactggcgtgagccacagtgcccagctcccacctaaagattttcagttccaaaaacttgagactagtttctgagtaattaatctccaagacactttaaaatatgacatacaaccataattaagtttctattttcataacatcgcacctccaggaaaagagctctgacttctaagcaaaaagataaaacaaaaatgcatagtttacctcacctagtggcaaacattctgtttcttcaaacctcacattcccctgaaacaatattcaaaacaattttaacccgccagtcagaaattataatgctacaataaaacctcactattctaaacttcattattttcgctaattctgacagggtaggccaaagtttacatttatttatattttgcctattaagggtctcctggctcatcaatctgtttattatgcagatgaggagcaactgagaagacactaggtaaaagatctttaaactaccacaaatgaaggaaagattacccaatgaaagactcttgatagctcagttttcattaatgcgacagtcactaggagaatatgcctagaaacttcagatgacatccccaaatgcgacgtgttctccagccaccagcagcagccgttcatgtaccatgatggcccactcaaagctccaccagcttgcggcaggaaacactgtgctgcactcaccaaacaggaaagagatttgggcccacaaggaactgaagaagcccaactttcatttactttagtatctatgcagaatctgactcaattgcatagattacatttaaatccttcagacggcaaattcaaagttttgctgcttaccaaataataccgtcattacaaaaattattctgggccgggtgcggtggctcatgcctgcacttcgggaggctgaggcaggtggatcacctgaggtcaggagtttgagaccagcctggccaacatggtgaaatccccatctctactaaaaacacaaaaattagcagggcttggtggcaggtgcctgtagtcccagctacttgggaggctgaggcaggagaatcacttaaacccgggaagcggaggttgcagtgagctgagatcgtgccactgtactccagcctgggcaacaagagcaaaactccctctcaaagaagaaaaaaaaaaagcagcaagggtgccacaacacagtatgtttctcacaaagaaaatgtagagaaaaatccagaaacaacctattgttgttttacatttcttgggtatttgtgtttttatagatacgcggagacaaaaagcaaaacttgttactgaaaaacctgctgaggactaatgctttggccagcccccggctacagccgggccgccaagctccccatgtgagcttgcaacaatcctgccatttccctctatctacttcctagtgcaaaacacaggctggtgaccttggtgggcaactcaggtgggaaatttcaactctccaaatgaatgccaggaaccagaaacagtcacataaaatcatttatcgaggtgaaggagaagtgaggtttattgttctctatttaatggctggacataaagtctcctaaaccactacctttgatggactcctcttgtctcagtaaaaaagaaagtatggtttcaaacacttaagatacggtcccaattctacataccaggattcctgttgctcttaataaaagattaccacttgggccctggtgaggaccacaatgcacaggttcttatccccatgaagaaatccacctcatgccgcaagtgtggcagtgtgagctccccgggtaccatgtgagtggggtgcgctgcgggaggtcatcccagcagggtactgtgggggctgcttcccctcaagggcatctgtttattacaggtttaaatcactgttcctttatgttctcctcggtccacacccttagagacctgcataattccatggccccaagcacagcctactcttgcctccccccaacccccgattttcactgctgcaaaggattcagcaaggggctgtgtagggcactttgagggagaggtgtgtactggaacagctttaccggtgacagcgcatcagattgattccacacttgccccaaggggcaagcacatggttgagccactaaaaattgttcaaagacacagcttatcttcctaaaagtaatcaatttccccaagtgtttagagctattttacaactcttagagaagtggttctcaaagcgtggtccaggggtccttttgggaggcccccggatcaaagcagtctgcacaacaccaacattccatgctgtttccacagccactctgagtatatgctagagcatttcagaagctgaacggagacactaagtttgaattcggaaggagaatccagaagctgtcagttaagccaaacagatttgtgaaaacaaaaccatctttctcattgttttcgtcattgaaaacaggttccactaaatggtttacttatgttaatatataatggtttacaattttactttatttatttgagatggagtctcgctctcacttaggctggagtggagtggcacgatctcagctcactgcaacctccgcctcctgggttcaagggattctcctgcctcagcctcccgagtagctgggattacaggcgtgtgccaccatgccgagttattttttttgtgtctttagtagagaaagggtttcaccatgttggccaggctggtcttgaactcctgacctcaggtgatccgcccaccttggcctcccaaagtgctaggattacaggcatgagccaccgtgcccggctggtttccaattttaaatagaaggcacttcagcatttaaatgactcatttttaaatgtcaaacatggtgactatcaatagatataacaaaagctctttggggtcttccctgctttttaggagtgtaaagcagtcctgggtcctgccagtctggtaaccgctgacacagcagcgccttccactgctggagcctgaaaggctgctccccgaggccattccggttcagtcaggatcctagtggcagtgacaggtactgctttagcattcactttttccagacaccctgtctactctcattcagtttcatgtgattactgaccaggcagggattgccaagtgagatgatggccaccctaagttcaggtggagagaatggggtttcttctttaaaaacccttctctcacaagaatttgcttctcaaattggagctgcagccaattttttttttttttttttggagacagggtctctgtcgcccaggctggagggcaatggagcgactgatcacggctcactgcagcctcaatctccctgggctcaggttatccttctacctcagcctcctgagtaactgggactacaagcatgcactacaatgcccagctattgtgtgtgtgtgtatatccacaatatatatatactatatatatccactacatatacccgctatatatatatccacaatatatatacacactatatatatatccacaatatatatacactatatatgtccaaaatatatatacactatatatgtccacaatatatatacacactatacatatgtccacaatatatatacactatatatatatccacacaatatatatccacacgatatatatacacacaatatatatatacacacactatatacactatatacacactatatatacacactatatatatacacacacacacacacatatatacatatatacacacacacacacacaaacaatgcccggctcttttatatgtatgtgtgtgtgtgtgtatatatatatgtacatatatatacacacacacacatatatatatatacacacacacacatatatatacacacacacacaggtgtctacctggcctgtgtctccagggtcttgggagcatctctggggcctactcccctcagtgcaggttcagcattcccagtcctgacagctgcagccagcagtgcccacccccacccagacatttataaccaggacaagccctcagttaagcagatggggggctcactcaagggggaacctgtctatgaatgcagggttcaaccccagctgcaaacgatagcgggggtgggggggtacagtgtaccaggcagtgtatctgtctaggaacgcgggggccacagggtatcaggcagtgcatctaaggcctgcactttcctgtctgtgaaatggggacggtaacgacctcacagcttcctacaaggttttctgaagcgacatcctgtgccaaatcatctgcggcaagtgtgcaacagacggtaggtgccacctaagaaagtgacacagcctgtgctggcgagggcttggagagaaaggccctcttaggcgagtctatttgtccgacatatttgccaacagccctttatgggcttggcacagggaagagagcgggtgacatactgttctcatggagggcagggagtgcttcacgatgacccaggagaaattaagtaggaagtacacactaacttatgagtgttttttttctcacaaaggtgacaaactgaacacaaactaacagaccagtttgaaaaatcaagaaacatctatatagtgaaattctttttgttgggggtggggggtggacagagtcttgctctgtcacccaggctggagagcagtagcagaaccacggctcactacagcctggaactcctggcttcaaggggtcctctggcctctggcctcagcctcccaaagtgctgggactacaggagcacatcagcatgcttggcctaattattattattttttttttgagacagagtctcactgtcgcccaggctggagtgcagtggtgcggtctcggctcactgcaacctcgacctcccaggttcaagcgattctcccacctcggcctcccaagtagctgggattacaggcacgtaccaccacacccagctaatttttgtatttttagttagagatggggtttcaccatattggccaggctggtcttgaactcctgacaagtgatccacccatcttggcctcccaaagtgctgggattccaggcacgacccaccatgcccggccgggaattctttaagggtgatgaatcatcacatgcacagccgtgagaaaaactccctggcacctgagtgagagccgcagacaagccggccagggcagtggccacagcctccaacgcatcccgttcactagtgcaaaacagctgtaacgtggagcttttctggacagcaccctttctagtgtctttactttctatttttacataatgtttaagtttcctgtatgtgtattacttttgtaatcaaacacattaaggtatcttcattttggaaaaaaagttgatttaccttattataaaggtatattaagtaccacttaaatgtctatatcagcatacgcaaaacaaaaccacggcatcaaaatttgatacccaaggagagaaatgcctcctttacaacttacacacgattacaaccgcctattaagttttatggacatggttacagaattcttattaaaatatgtacaattacctattcaacttcatataacaacttaacctcaaaattactactcaaaaaataaaatgaggcctagacaacacagactgtctcacagatgactgtgtacacgtacatgaaatgagcaaactggactttgttctttgacctcctctttcccaattagtacatttccattaactgttaattatagaacttttgtaatgcaattaacacacatcatttgatagtagtcataaaaaggctgatcttagtatccactgtaagggaccccgtcatttaaataagaaatgtaagtgagagactctgtttagagagaattttctagtggtcttctgagcctgccagagagatgagacctctcaggcaagggcacagtgcagggacccacagatagtagggagtcacctgttaaacactttcaatcttagctcttcaagagccaaataagccacttggtattatgggacaggcatataaaaaggaaaaacgtgtcttgtttacagagattccaaacaatgaagacgtggcacagcttaaaaataaacactgaagagaagcaccctactgggctccacagaactgaccttaagggaattatgaccctaaggctgtagaaaaactcacagtatcaacagcagaacctgccaacttcaccgcgaacaaaacgggagccaatgcccattccaatcatttcctccttacatgaagaaaccccagcaccctccaaggcccaaccgatgatccgcacgtcctagacaagcctttgcgaggctcacatatgcacatgcaacatgggctgggctgtctggtaaccatgggtacggctgggcagtcaatcacaaattatcttatttgtgccctgtcttctcaccacagcacaatgagctctgcttgacatagtctgaattcaatcaactactaataagggacagcctctggtggaaagcctgaaaaaattcaagatacgcgcttttccaaaacaagaggtatcttatgaaacttgctgaaacaagtctacaagaacagacatctcctccccatgtacacagcaagtaggaaaacaagtgtgcattaagcagggagtttcacaacagggctgtgtctgtcttcctgggtgacacttctgagatgtctatgccgtatttaaaatagtgaaatagtcacagacacacatacactaacagcaacccaaagggccactaaagagccctaggctccaggtaaacgagttggcaacacctgatttaaaggaaggagctggaataatctctcaagttccccagtgaacttgtctccaggactgggacaggggccaccttggtcactgctgtatccctcgtgctaacagtaagcaatgaatgctcatttaaaaaaagactgtatttactccttaaaaggcactgctaaggacctttctcagaactgtatttcaaccaagtcatatgtggccctacggaaaccatggaacacggggtatatagcaaagttatgtgaatataccgaaaagacgttcccatctgcctttccctcctctaagtccctgagtacactaggctcaaatctcattccatcagcagacagatgacacggatatcgaaggcccaggcacaagttaaagagtattttcaataactggtaacgcagtaagctactgctacctgtggcccaaactctaaacttatatattaaagtcctttatttagagcagaaaagccggccttgacctccactgtctcagaaccgcgagaaggagccccggacgccgcagcggaggcagcacgagcacccctcccgccgagcgcaagagcgggccctttcggcttccggggtcactggaaggcaaaatgtgtcacaaatacggccagtacaaaccaacgcaacaaactattccacaaaaaaactgaaaaccagcgcggggaggtaaggacacactcttcagaaaagcgaatccgggctcttcgcgcttcctgcagcgccagccgcccctgcagtgccggaatcccccgaaggcacgccagaagctaagccggccaccccgaccgcacccaaggcccgggaggaagcgccgaggtccccgagaatgcctagggaaaccagctgcgcttacaagccagctacgcagcccccgagccccgggccgcactcgcccaggccagccctgcgctcttccccgcgagcggccgccccgactcccaccctcggaaccgttccagccgcgaccaccgagtgctcgccagtcccctcgacctcacgcagcccaccagggccggcgtctgaggcccgcgccccaggccgcggcggctctgaccggccccgcccgctcgcccgcccgcccgcccgctccttcccttccgcggccgccatcttctcggcgggagcggcctgtgcgggatccgcggctctcgccagccgggctccgatgccggccccgccccgctcccgagggcggcccaagcggcggccggctcttctacccggcgcccgggacgccacttaccgcaggccgcaggcctctagggtctcgcagccatttccccgaacgccgcggagtgggcggacggccaccgagatggcgcggggctagagcggcgcccccgcgcggcgggcggaggacgagaccggccaccgagacgctgcggggctagagcggagcccgggctgcgaagcccggccccggactgcgcgcatgcgcccgtctttcatacctgcactccggacgcgcccttcgggtctgcactgacaatgacttgcttgcatcctttgtggacaccttatttccccgactccaagagtgaaagctggggcagtgcccttgcggggatccctcggaacagcccgggcagggcgcaggcggaacgtggatgctagccccgagggactgcactccgccaggatttcgctcttaagaccgataaacccttcaagtcggtggggatagaaagctcctgggctaaatttgtaagaggtgtaggggggcggggacaggggataaaagaagaaaaggcccaggttttctcttccagattgtgtttctcaaaacgcaggcccctgacggcctcggctgggaatggcagcgaggggcgaggtccaggtgtgggcggggtttctctccaacttgaagaccctacctgctgcctccccaccccaagctcggctccagaaaccaggagcgtgggggtgggggggagagaaaggagcacagcgaggaagggaggcgggcacgctggacctctaggccccagggaccttggcggtgtggtcccaaagctctgcctcctcccaccatgtcaatcctacactcagaactactgaccagtagctagaactcaaagaacgcatggacatgtttgcccacaggggttggagggaaagattagacacttactatcaagagaggggaaagtgaggtatggtagatgtcaaccttccatgtggattttcttcagttcgctcaatagtaactagagtgacactctatcacctgtctgtccccagatactgcaggaaagagactgggagggggcaggaggggcagctgttgcctcgaggcaccatgggcactggccacttgctccgagggcagggacctggggggggtggaggtggccccattacttgtttctgcttctgtgaacagtgatacgctacctggaagcatggaccatctagcctttggcgttggccctggccaagagtaaaaggggcccagagtgccgtaaagctgcccctaatacagaggcttctgcgatgcttccatggatgaaccaggggctttgaggcaggtgtgctttttaataataccgctgaagattacagggtctgctagtttctgaggcagacttagttttcttcaaaggaatacaacgcagcttgtttttgctggtgtggcccattaggaccacattaatagaatctggcagggatgggcttgacagtcttccatcttgagtgtgatctcaggttgcaaagagggctttttgctctcagacatggggtagtgggaagcttagaagacagacggggttgagaccacctttaacaagcagtgagatcttgggcaagctctctgttaaaggagggctcacatgctgaggcccaggtgaagaccacatgaggcctccctacaagaggctctctctaaatccaactggtatgggggaacctcagcccagtctctttagctgaggatctttaaaccagccacaatttgtttctgcaagacggtgagatttttaagagattttaactcttgggtacagtttcacgctgggcactcaggagagatagatggaaaggcactaagggaatagaaagagtggacaaggcggctcagggacaagagaaccaagaggaagaaaaaggcaggaaaacatgaggaaagggaaccctcactcagctcaccgcagtgctcagcgatacgcagaatgccttccttcctgcaagtccagaggatactggaacctgcctctcgttctcatctcccccgccccccagcagaagctggctcggctgtggaggcctggccagactatccactctggccttccccacctacaaggtgacgaagtcagctttatcccagcttacctgccgtcactattcctgggagctgccctccctggtgagaaaggcatttggagaatctacagtctgggtatttgaatttgaactccactagcaaaagaatactttttcctaaccgaatttattttaaaagtaaaacccaaaggaggaaacaaactcttcagttgtttcaataaattgttccttaaatatccccaattcacaaacaaaaccccacaagtagcaccgatttacaacaggatgtggcccagaaagcaggaagggggccaagagcgctccagcaggaagcttaataggtggtccatggagaaaaacacgatgggtgcatcacaaataggtgtaaacagtacacttttgtaatgtgtagacaccagtttctgcaacccccatgccacgcaaagtttcagggaaagtctttgaaagtacaatccggaaaactcagcaattcttaaaaaaaaatggctttccgctgttataagcctccttcctaagactcagggtccgcagcagaataccctgacccaaaataaaaatactatgacaaaaatactccaggaggcagccggctttacttcgtttaaagccggatttcgcttagtcccgtgaaagcgaaggagcaccagcgcttcctgattccgcacagttctctcggcagagacggcccgtcctctccaagaaccggaagccggacagcgtcaggacgttttattcttctcacctgggattcagagaggcagcggccaaggacagggcccccgccgaggccaccgggcagcgtccaggtctcggcctttgggaggggagcagcgggggaggggcacggggaggggcgagggcggggcgcgcctgggcctcggcgctgggctcctcctctgcccgctccgggggacacccacaggattcttgcagacctctgccgaggcaggatggaggcctgcagggatgcaccgcgggcccgcgacccgggcggccggaacatagttctttctggccggagatcggcccggtcgtgagtcgtgtctgtgccaggccccccacgctgtgctccagggcctcagtgcccggcgcgccgggggctgtatcgccagccacttggggcaggaaaaaggaatcacaaaatacaaccctctcctttacccaggaggagaacgtggattcccagaaaaaagaaaaagtgtatatatatatatatatgcctactgttttcttattgctaacaaaaacttcagccactgttttgttttttttttttgagaaactgatgaattttctttacttttacgttgtataaggccagctaactttaacagttaattttagataaatcaactcaccaatgctaaaaggtgtcacaatcaaatcgtccactacttcccctcaaagcaaacacgaaagcactgcctttggctcctttgaagaatactaaccagatctgccaggcgcggtggttcaagcctgttcccagcacttaggtaggccgaggtgggtggatcgcctgaggtcctgaggttaggagttcaagaccagcctgaccaacatggtgaaaccccatctctactaaaaatacaaaaattagccgggcgtggtggcaggcgcctgtaatcccagctactcgggaggctaaggtaggagaatcgcttgaacccgctgcactccagcctgggtgacagcgagactccgtctcaaagaaacaaacaaacaaaaaaaaaaaaaacacagatctttgtctaccaaagggcaaatgctacgtttgtgcatcactgagtaacagcactgccagaaaaggcaacttcacagaattcacccactcaatgaattccgctgaatgctgttttgagacaaccaacacagagggagagcatggacgatagtgggtaacataaggggaaccggcaagatggaaaagggccaggaaacaaaagaattcaaggaaaaacagaaacagaagttaaactttgtgttccaaccccaaagacctctagaaagctgtgggatgtgatggagctacacgttctatgcggcatatgagaatcataccaattttctgtcttttagacaaaagaataaatgtgaaataggaaaaagggagggaaatgagatgggaggagggcatcaccccctttaatgctgtaccaaattactatacaaactgaattgttgtaattagaattatggacagtgtcttatcatttgtatgttaccagaaacctgtgctatgacttttaactagaaaaacaacaagggatgatggatctttctttggtcacattagcctctgtaagttactcaagacagctgcaatgaactgacaacaatatccacaaacaaggcaaaaggaacttctcatggcagggaactgaatctggatgttattctcagttctgtcattttccagatacctttagaaagaatgagctgcagtttgtgttgttgttttccttgagacaaggtctcaccctgttgccaggctggagtgcagtagtgtgatcttggctgtctgcaacctctgcctcccaggctcaagcaaccctcctgcctcaccctcccgagtagctgggactacaggtgcatgccaccacaactggctagtttttgtattttttgtagagatggggtttcactatgttgcccaggctggtctcgaactccagggatccactcgcctctgcctcccaaagtgctgggattccgaaggcatgagccacagtgcctggcctaagctgcagtatttctatatcttctgctaaggagtgaacacattaatacagaaccatgctcatcactccttcctctgagaatgtttcatgtttctctaaggtgtctaagttttctctttgaggtcagtgaaaagtaaataaaaacaactttggaataaatcaatattttagttaagtatagggcaaaaaactatttcttttctgactggttttatctcaaccatctttaaaggaacacagcaaacaagccaaaaaaacgcttggacagattctgacagaataagagtaaagtggttgtacccaaataggacatttacccttacaggctcttcacaccacggaatagagacccgcgaaaaaggggaaacgaacccatagacgactgaattcctgcacctgctggcgagcaccaggaggaaggtgcagggatgtccatgaggtcagagacagccatcagttcacactgcattccagacgcaatgggccccggccccattcttgggccttctacctaacctcaatgccttgggagtatgggaccttaggggtaaggatagggctacaattgtgcaggctacaattaaagatttttttcttaaatgaaaacactttaagaagtgaaagagactccagcaaccttccagaatttgtccagatatgaataactatataaattaattcctgctcttgcttagttcacaaaaacaaaatggtaaaactgagaaagagtgtgtttggaggaaataccaacaacaacaacaaagactgaggtattagcagtttccaaaagacacccaaatgggaactggaggttttttcccttcagggaggtcttgctttgttgacctggctggtctcaaactcctggcctcaagggattcccctgtctcagcctccccaaagtgctgggattgtaggtgtgagccaccctgcctctttcattccaataggaaagtatttaaagagtaaatgtagggccaggcacggtggctcacgcctgtaatcctgacactttgggaggcccaggagagaggatcacttgagcccaggagttgaaggccagcctgggaaacataggaactcttatttctacttctacctgcccatcagacacgtgatcacaacagctgcatgcatacaaataacttaagacacagagagaactatccacatgtatgtgtgtatatttacatatattttttgttaatttttataaaaaagaaaagtcagatcccaaaccagtaactgtctatcaaatcctgaccagccaggttcaaactacataatcaaactcaaatgaaatagtacataaacaatgctttgaccatgtacattgctactcaaaatactctttggcctttcccactggtctgcaatggcaggactgtatcaccttccctcctaccacatttgtttcaggtaacagtatgctagatacggtttgtctcaacctcagcaggagttaaaggttttaaaaaaataaaaataaaaatcaagaaaagattattcttgctctcacccaaacaaacttacaaaatattcagtgctttctgatttagtggtataatctagaaagggaaataaaatcaggcaaaaagagggagggggaaggtcacctatatcaaacaatcaccagtgaagattctttacagggtctgggttcaccagacacatggtgtcagaatatgtgcagcaggccaggcgccatggctcatgcctgtattcccagcattttgggaggcccaggcaggtggatcacctgaggtctggagttcgagaccagcctgaccaacatgaagaaaccccatctctactaacaatacaaaattagccgggcgtggtggcgcatgtctgtaatcccagttactcaggaggctgaggcaggagaatcgcttaaaccggtaggcggaggttgcagtgagccaagatcgtgccattgcactccagcctgggcaacaagagtgaaattctgtctcaaacaaaaaaacaacaacaaaagaatatgtgcagcagactaaatagtaaaattcttccttacctctttccaacatctctaattgtttaaaatactgtgaaaagtgaagttcatgaaaattgaggtctgagtgtttcctacctacttctgctaaccattctaagcatcaacaactgatgggtttatcaattatcctgaaaagtaaggtggtttgatttgcccaatctctttgaaagcctgaagtctccagtatgtaggggtttgattttatgcttttgggttttgagagtaaaacaaaacatccatgggaataatgtggttttgaaacatggctgatatcctggtttttaaacattctatgatttgagtaaaggaagcactctatgcagtggttcacacctgtaatcccagcactctgggaggctgaggcaggaagactgcttgcacgcagaagtttgagaacagcctgggcaacatagtgagacctctcctctacaaaaaataaacaaaattagctgggtgtggtggcttccgcctgtagtcccagctactcaagaggctaacatgggaggattagctgggaggtgtaggttgcagtgagccattatcacaccattgcactccagcctgggcaaactgctctcccctttttaaaaactcattaatgttcttttaagattaatatacctttagcactcctctttctgttcatctctttcaatatgaaacaactcaagttcaaagccaccacctcagcttgcaagacactggaagctctgaacacctggttgcccctcagctgactgtaagggccaagcctttggtttctctcatccacatgcccacctctgtcataggaaagctcaggcagttgatgaatccagcaggctgaagtccttgtcactgtcccagatgccaacccgtgtggccctgcaccctctcctgtcccgggacccacctacctctttcctgctctcctgcactcttggtgagcctccatgctggtggcttcagggctctggcccaggctctcctcctctccctccacccatcccttctccacagagacttcatgcacacctggctgtagttgcctttatctctgcctggatctgggcaccatcattcacctgctcccctggcatctccacgtgaatgcctcaaatgcacttcaaaacctacctaacacatgcaaaatgagcttaggacttctgacctccctactacatacttccaggctcttctctggcgttccctatccagaggatggtcccaccaccctataaattcataggccagaagctgagaaattatccttgacccccctccctgctcctcagtctcacctgctgctgcagcgttttgtggcatctagctcactgctcacttctcagtacataagtgcatggccctaatggcttctgaacaccttcaacatactacgctgtcttcacctcacccctgctcaccacactccaatgtttcccattcccatcacatctctcaacttcttgctctctcaccaaaaaccatcaaatggggagttttggcaccttcaccctggacttccctgccgcctggaaactgctaacatagcttctcgaaactggacaccctgtggcttcagggagcgcctttgaagcccctggttcttgtcagaccccccggccactttcttgctacccttcataggcagcttcttccttagtgaatacagcttgcagctctgcattctggacttgatccactccttgtctccatgggcttcctctgaatactgtacccatcaactctcaactctagccctgctcttccccttgagctttagatgtgtcccacaggcacctccaattgaatgaggcccacggtgaactcaccacctttccctcgttgttgcacctccttcttcttcatgatcattctcagttggtgccaccacctcatcagctgggctactcacccgcatcactctggtcttccttcttagctcccacaaattgtcagtcaccaaggactgctcatttccatcctgactgaaggtctctttccatttttgctagtattgcttccagttaagatcctcataatcattcactcatttattccttcgtcactcaacaaataaatatttatggagctcctattacgatttagccataatcaactcacatgaagcttaccattttatgctgaatcatgacatcccatcagacagcaaccacacggaccgtgtgctaagagctacgaagagctaagttaggattctgtgcaagcataaaggaaaggcactcaatccagctttgttagggaagacttccccgagaaagccacgtctctactgaggaggtgagcaggagttagcctagggaaggctgttagctagggcccagactgagagcacagcgataacaaagcttgttgacatgagaaaacctccaatcagctgggatggctggagcagagagtaagatcaggagtgcagacttatagctgcgctaactttacacaggcaactggggagtccccaagggatgttagaaggatagagtcaatgagtgatggcttttggagagatcaccctgtctgctatgtgagaggtagtgacaggacttctggagctcaacaggagttacggagacatcctggcaatccaaaaagcaaagatgatggcttccacgttatggtggaagaggctgggaaacaacacaaaggagccagtttctagagaggattaaggagggggctcgagcaggacttggtaaccggttggctgttgggaggaggagcattaacctgtgacccacaggcaggcactgagacagcctctttggactggaatgttaaggaatgtcgccttaaggcgctagcactcaagctttctgctcgtgcatccccttgcacactttctccttgacgttcaggctgggcatggtggctgacgcctgtaaacccagcactcccagaggccgaggcgggaggatggcttgagcccaggagatcgagaccagcctgggcaagaaggcaagaccccgtctctaaaaaactttaaaaaataaaaataggccggatgcggtggctcatgactgtaatccgagcaccttgggaggccgaggtgggtgatcatttgaggtcaggagttcgagaccagcctagccaacatggtgaaaccccacccgtactaaaaatacaaaataagtagccgggcgtggtggcgggtgcctgtagttccagctactcgggaggctgaggcaggagaatcacttgaacccaggaggcggaggttgcagtgagtcgagatcatgacagtgcactccagcctgggcaacaaagtgagactccttctcaaaaaatagaataaaataaaatcaaaataggccgggagcggtggctcacgcctgtaatcccagcactttgggagtccgaggcgggcggatcacgaggtcaagacactgagaccagcctgaccaacaaggggaaaccccgtctctactaaaaatacaaaaattagctgggcgtggtggtgcgcccctgtggtcccagctactcgggaggctgaggcaggagaatcgcttgaacccgggaggcggaggttgcagtgagccgagatggcgccactgcgctccagcctgggcgagagtgagacttcgtctcaaaataaataactaaataaagaccaataactgtttcccatagggttatgtagttgcaaatgaaaaaattactggcatgtactgcctctgcatatgaagcataattttgtcaagaccttatacctgcagatttagctctttcgattaacggaaaatgtccaaaatcagtctcctccaacctatttgccgaactggacttactgtcgctgagtagaccgaccgacatagcttacacgttgttcagctcgcttgtaagcaaacacacgaaaccacctcacccctgacttcagaaagaagccgtcccgtgaattcctcacagatgaaatcaggagctgcccctcaaggactctatttcttccttcggctctatcaaatattttaaggtacttcccagcaacggaaacatgggaccctgcaatgacagacttcgcattcctcctgagcggacaggcaataagcaagtaaacgcgcaaatacccaagtgcggcctcaacccgcgctcctgccgggagggtctccagtcaccgagtaaccccggccctgccccgcgccgccgccgggactccgccccgcaagcaagtggggtctcctttgtcccgcgcgccctggccgcgtcccgcccttcggcgtagcccatgggaggcgccctgagggcagggcccttctgattccccacctggcctcgagtgaggacgcgctcaacaacatctcgagtaaagcgggggaactcgcttcaacgcgcagacagcacagctctcgcccagcccggtctcgggtcagccgtctctccctggacctcagggacactagccctggaaggccgccggtcgggaggggactccctccccgtctgaggggcggccgcggacacccggcgcctttcccccgccccaccccgtgcggcctcacgcaaacgacaggaaaaaagctgggaccttcgcctccgactcagtgtagacgtcgccatcccggttccagatttccgcgctccaacgcctccgcagcagccatcttgccagagggccgacgccttttgactctggcgccaacccgtagtgcgtggtcgccgcgaggggagttctgcgcaagtacggaagctgaggttccgcgcttccgggaggccgtccgccccgccccctcgcgggggcgcttcattggtcatcggctcgcgctctcgcgctctcttgctgtcgcgagaggtgctgaggggcggcctccggtgcgcctgccctcccgctccccgcccccgcccccgcccccgcctccgccgcggcccccacctctgcctccttctactcgggcgccccggcggccgccacctctccccagcccaggagaggctgcggagccgcagccgcccagaccgcgcagcgcgggaggcaggttccgcacggtaagatggcggcggcgggcccgggcggccgggccgagcgtctcccggggccgggccgggcgggcaggcgggatgtggccggggtgcgcgccgcccccgctctgggggccttggaagcgccggcgctggcaggtgcggaattggggcgcgcagtgagtccaggcccggacggccgccccgcgccggtgcccagggggcagtcagggctcagcctccaggcgcgcggcctcaggcgctggtgttctggggcggtcccggccagcctgaggggcggcggtagctgtctctgtggaggagcgacgtccgtaacgaagtctttttaataaaatctgctgctttaaagcagaaaccgagcgggtgaggatgtaaagtgtggcatggaaagtaggagtcttcagcacacgggtgttttcttctgctgaatctttttatgctggagtttgagactaccgagttcttcctgctaacaggactggccagttctacaaagttgttgcttttcatgggcgcacgtaactgcccggagtggaagcgctgtgagtgccgatcaccgaatgggccgagagaaaaggtgccttttcctagggagctcttaacgttggtcctagggccgggcgcggtggcggaggtcgaagtgggcggatcacttgagcccgcgagttcgagaccagccgtggcaacagcgagactcccttctctgctaaaaataaaaaaattagccaggcagagtggtgcgctcctgttgtcccagttactctggaggctgaggtgggaggatcgcttgagcccaggaggtcgaggctgcggtgagccatgatcgcgccactgccctccagcctgggcgacagagcgaggctctgtctcaaaaaaaaaagaaaaagaaaatgagtccttaagttaccattaattgtcgtgaataaaaagttggtctcagtgagttttgcagttgacaacgaaagatgggtgttcgtgtgtgacagcgactcctggtttctcctccactttacctgccgctccacatcaagttttcttctgctggtgccactttctctgctttaccttcaaggttggcatcctccaagtaatggcgattctcattccctatctacgctcttcctatggtctttgctgaattcttggctttaaatatccctgtgccccagcaccgccccccccgccccttatttcactaattcatgttttcagctctgagctcaggatctgtaattc

SEQ ID NO: 164 - protein, 1480 aa, Homo sapiens
MQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEEGFGELFEKAKQNNNNRKTSNGDDSLFFSNFSLLGTPVLKDINFKIERGQLLAVAGSTGAGKTSLLMMIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILHEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTRKVSLAPQANLTELDIYSRRLSQETGLEISEEINEEDLKECFFDDMESIPAVTTWNTYLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVGLLGRTGSGKSTLLSAFLRLLNTEGEIQIDGVSWDSITLQQWRKAFGVIPQKVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLVIEENKVRQYDSIQKLLNERSLFRQAISPSDRVKLFPHRNSSKCKSKPQIAALKEETEEEVQDTRL

SEQ ID NO: 165 - DNA, 3895 bp, Homo sapiens
ctgcaggaattccgatccttccgcaggttcacctacggaaaccttgttacgacttttacttcctctagatagtcaagttcgaccgtcttctcagcgctccgccagggccgtgggccgaccccggcggggccgatccgagggcctcactaaaccatccaatcggtagtagcgacgggcggtgtgtacaaagggcagggacttaatcaacgcaagcttatgacccgcacttactgggaattcctcgttcatggggaataattgcaatccccgatccccatcacgaatggggttcaacgggttacccgcgcctgccggcgtagggtaggcacacgctgagccagtcagtgtagcgcgcgtgcagccccggacatctaagggcatcacagacctgttattgctcaatctcgggtggctgaacgccacttgtccctctaagaagttgggggacgccgaccgctcgggggtcgcgtaactagttagcatgccagagtctcgttcgttatcggaattaaccagacaaatcgctccaccaactaagaacggccatgcaccaccacccacggaatcgagaaagagctatcaatctgtcaatcctgtccgtgtccgggccgggtgaggtttcccgtgttgagtcaaattaagccgcaggctccactcctggtggtgcccttccgtcaattcctttaagtttcagctttgcaaccatactccccccggaacccaaagactttggtttcccggaagctgcccggcgggtcatgggaataacgccgccgcatcgccggtcggcatcgtttatggtcggaactacgacggtatctgatcgtcttcgaacctccgactttcgttcttgattaatgaaaacattcttggcaaatgctttcgctctggtccgtcttgcgccggtccaagaatttcggaattccgcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttttgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaagatgaaggaaaaagaagcaagatctaaatttagacagggttgtcaagctggacagactattaaagttcaagtctcctttgatttgcttagtctgatgtttacatttattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagacaagcactgcagatggtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaagtaaagtgttttcctgaacactgatggaaatgtatagaataatatttaggcaataacgtctgcatcttctaaatcatgaaattaaagtctgaggacgagagc

SEQ ID NO: 166 - protein, 1430 aa, Homo sapiens [sequence omitted]

SEQ ID NO: 167 - DNA, 2060 bp, Homo sapiens
ctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggtttttgtttcttttgggtatttcttttttggcacatgtgaatcttgttttgtgtaaaatgaaattactttctcttgttctctgatgatgggtttaaaattaaaagagcatccggttttggtatggggatgatccaggattatgttgtgactgatacatattagttacttgtgctttttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattctttttaaaaaaaaaaaaaaaaaaaaaaaaa

SEQ ID NO: 168 - protein, 963 aa, Homo sapiens
MADLAECNIKVMCRFRPLNESEVNRGDKYIAKFQGEDTVVIASKPYAFDRVFQSSTSQEQVYNDCAKKIVKDVLEGYNGTIFAYGQTSSGKTHTMEGKLHDPEGMGIIPRIVQDIFNYIYSMDENLEFHIKVSYFEIYLDKIRDLLDVSKTNLSVHEDKNRVPYVKGCTERFVCSPDEVMDTIDEGKSNRHVAVTNMNEHSSRSHSIFLINVKQENTQTEQKLSGKLYLVDLAGSEKVSKTGAEGAVLDEAKNINKSLSALGNVISALAEGSTYVPYRDSKMTRILQDSLGGNCRTTIVICCSPSSYNESETKSTLLFGQRAKTIKNTVCVNVELTAEQWKKKYEKEKEKNKILRNTIQWLENELNRWRNGETVPIDEQFDKEKANLEAFTVDKDITLTNDKPATAIGVIGNFTDAERRKCEEEIAKLYKQLDDKDEEINQQSQLVEKLKTQMLDQEELLASTRRDQDNMQAELNRLQAENDASKEEVKEVLQALEELAVNYDQKSQEVEDKTKEYELLSDELNQKSATLASIDAELQKLKEMTNHQKKRAAEMMASLLKDLAEIGIAVGNNDVKQPEGTGMIDEEFTVARLYISKMKSEVKTMVKRCKQLESTQTESNKKMEENEKELAACQLRISQHEAKIKSLTEYLQNVEQKKRQLEESVDALSEELVQLRAQEKVHEMEKEHLNKVQTANEVKQAVEQQIQSHRETHQKQISSLRDEVEAKAKLITDLQDQNQKMMLEQERLRVEHEKLKATDQEKSRKLHELTVMQDRREQARQDLKGLEETVAKELQTLHNLRKLFVQDLATRVKKSAEIDSDDTGGSAAQKQKISFLENNLEQLTKVHKQLVRDNADLRCELPKLEKRLRATAERVKALESALKEAKENASRDRKRYQQEVDRIKEAVRSKNMARRGHSAQIAKPIRPGQHPAASPTHPSAIRGGGAFVQNSQPVAVRGGGGKQV

SEQ ID NO: 169 - DNA, 207799 bp, Homo sapiens
gaattctttgatgaagaataagggctgagccctgactgaagtgttttccacattcatcacatatatgttgtttctttcgagagggatttctctttctttcaaacctgcccttggggaaacaggtttctccatatttaaaaatttgaggaacacccatattgagagtgccaggaacttcatgggattctaatgctgaaggaagctcctgctttggagctagtgctccattttcagtcctaccatcatcatctgaaataaacagaaaatgtaaatatcattcattatctattaagggaaaagaaacctaaaaaaaattttttttttaatgaactaaaatagctagcacacatctataaaccactctgacactggtgttaaggcctattctcaaaaaagaaaaaatgaaattactctgaataacagtataacatcatgatataagggatatctgaataaaacataggcaagtggtttacaaatggtagtcagaaaacaaaggtcagaaagatggtagattctaagatggttagggagatagtcaaaatgatgtggctaggtatggatgaaactttgtaagaataaaaataaaataaaattggccactaggaaatcattataatgttcttttactttgagaaagggagaaattacatcaaaatacaaagatgtaaattagaaaaacatgtcagaaagtggctatttctgaaatgaacaagccaagtcaggtcacagccaatgttagcctaaaagcagaacacaggagtcttgacaagaaggggctgaagataagctgggggcctcctgtgttaaccaaagacatgacataaaaattcagtatgcccctaataaatgaaagttttccaataaaagcagcttctcccatgtggtatttgtcatggtacttagaaaaatcgttatttctaagcctcagtgaaacgtgtccaatgaaagaaaagcctgaattaccaacatgggttagcatcactcacacgcaggcagagataacagcaagtgtcatttaagacttttctaaaacttcatgccttaaggagtaaagatccagttcatatagggttagcaactgccttcagcgaagaggaaaacagtaaataattaacaaaaagatcaagtcaggagataaggctaagagagagagactgaaaggttagaggaggatagtgaggcttggagacttgaaaaacagaggagcgtgaagattaagtggagacaaacggcacacaggaaacagaaattcccaagtgtggaagagactagacagctgaaataaggaacgcaggtgaaaagtcactctaaaattcagatgatgagaagttgaaaatatcagccccatatatcaagaatgatacttctcaaactttattgcacagaagaatgtcccatgaaacatgtaaaactgcagattttcagcagacttcagccccaccccaaaagttgactggctggcactgtcccctcagatgtgaagaaaacctgctcagacctcattcagtggcataccagcaccatctccaactacttcaaggaatgattactaaagcagagtcaaacaaaatttcattttagttcacataaacatgagaaagcaatctagcagttttaggaatatactgggccatatcaaaggatacacataagtatatggtgttaatggctaatatattgggaaagactggtctcgtgaattaatacaactttgagcttttaaaaaagatttttctgcatttaaagcatgttatagctaaggaggctttttttgcataaatacttagaaaaaggaaaaaaattactccaaatatttctacaaaagaagcttcttagaagaaaatgactctaggtagacgttgaaggaaatcagaaataaatatttagaaagatttcagtgatatacaacaaagagattagaagaggttttcaggtaagcttactgtaccaatggaattaggcaggagattgaaagtaaaaggatgtaaaacagatgacaagtaatactgaatgcaaaatagagggacttggtccatgggtgggtgctggctcaaagtaaggcaaatgctagcctgacatgggcaactctttttaggaaggagactgaaagggaagaaaaggctgaagatgttaatgtctaggaataaaaggtctgaggccagcaaaatcaacttaatcagaaaaaaactgagatattagattaagagtgatatgatccccccaccagtgagaacaagcaaagttctgaacaaaaggcctatactctctttcaccctctagcccacacagagttctggtcctcaccacagtgccttagggaatggagctcccaggatgcccacttgagctggttctccacagcatcaagctcagaacttggtaatccctgagcttcttcttgagataccatgtcttctactagtacttcccgttttcgtcgacggagagaaacctggaaacagaaagatttgattcagagaaggaactgtaatgagaatcagaactaaaaacacgtaagagaaaccccatgaaacaaatactgcagaagcctagatggcaaagcggcacagataacaaggagtggtaggggaatgggggaaaaggcataaacataattctaacttagttgagtggaattaattcagcagctttgcctactacctatgccagtgcttctgacacaggaaatgacacaagcaggctcaccggttgtccagggtcatcaagttcactctccaaatcctccagcactgtcactgcctcctctccattctctggatgatgatctcgaacccaagtctgtagctctttgggtaggatggcaacaaactgctccagcactaccagctccaagatttgttcttttgtgtgcgtctctggcctgagccacagacggcaaagttctcggagctggctcacagcctcacggggcccaggtgaatcctggtatccaaactgcctgaatcgctgtcggaaaatctctgggtctgggagatggttccaggggatacttgatccctcttcgccatcaggatcctcctccaacttcactctcagaattttttcctcttcatctggagttgggatgataagtattgaatcttcttccactgactgtgcagacattctgatttataatatttcaagaaaagacaactgaggcagaatataagcctcagggcaataccccgttttcttcacaggcactcctgaggcataagaaataaaagatatataaataagcaaaaatatcctaagaatttgaacttatactggtaaaagtaaaagatacttgttctttgagttaaaaattccaatcaataacctacaccaggaattggcaaactacagcttcacggccaaatctagcctgccacccatttctgtacaacacttgcaccaacaataattttcacatttttaaatggctgtggtcttcatcacagtgccttacggagcggagatccctaaaatcaaatgaatacctaatgatatttagggaatggagctccccaaaatcaaatgaatacctcatgacacgtgaaaatgatatgaaattaacatgactgtgtccataaataattgtacttactcatacttcacgctacaatagcagagttgagtagtttcaacagactagatggcctaaaaaaaacccaacacagtcatgcactacaaaatgatgtttgggtcaatgaaggaccacctagatgacagtgctcccataagattataatggagctgaaaaattcaagattcacctagtgacactgtagctgttgtaaggtcaatacattactcacatgtttgtggtgatgctggtgtaaacaaacctgctgtgttgccagtttaacacatacagttatgtatggtacataaaacttgataacaataataaacgactatgttactggtttatgtatttactatactttttatactatattattttagagtgtgctccttctacttactaaataaaaaagttaactgcaaaatggcctcaggcaggtccttcaggaggtattacagaaggcactgttattatggagatgacagctccatgtatgttactgctcctgaaaaccttccagtgggacaagatatggaggtagaaggcaatgatactgataatccagaccctgtgtaagcctaagctaatgtgtttatcttagcttttaacaaaaacagttccaaaagaaaaaaaaaattggccaggtgcaatggttcacacctgtaatcccagcactataggaggctgaggcaggaggatcactaaagaccaggagttcaaggctccactgagctatgatcacaccactgcattccagcctgggcaacagagtatgaccctgtctctaaaaaatgaatttaaaaatagcaaaaagctgtgccgggcacggtggctcaggcctgtaatcccagcactttgggaggctgaggcaggcagatcacgaggtcaagagatcaagaccatcctggccaacatggtgaaaccctgtctctactaaaaatacaaaaattagctgggcgtggtggattgcgcctgtagtcccagctactggggagattgaggcaggagaatctcttgaacccgcgaggtggaggctgcagtgagccaagatcgcgccactgcactctagcctggcgacagagcgagactctgtctataaaaaaaaaaaagcaaaaagcttacagaataaggatataaatatatttgtacagctgtacaatgtgtttgtattttaagtgaagtgttatcacaaaagagtaaaaaagttaaaaaaaaatgtaaaagtttgtaagtgaaaaagttccagtaagctaaggttaattattgaagaaaaatgttttcttaataaatttagtgtagcctaagtgttcagtgtttatatggtctataggaatgtacaataatgtcccaggcctccaaattcaccactcactcactgacttcttagagcaacttccaatccagcgaggtccattcatggtaagtgccctgtacaggcatatcttttttttttttcaaacattttatatcatattttactcttatcttttctatgttttgatacacaaatagttagcattgtgttacaattctctacagtattcagtacagcaacatgccgtaccggtttgtagcctaggcgcaataggctataccagatagcctaagtgtgtagtaggctacgccatttaggtttgtgcaagtacattctatgacgttcacacaaggatgaaatagcctaacatatttctcagaccatagcactatcgttgagttatgcatgaccttatttactatatggccgcttacagaaaaagtttgccaatcatgacctactaagacgacaaaccctatgtcaataatcaaaagaatccaagtaagaaccagactacttcagtgctttctaaatgtgcctgaccctggaacgcattatttccaattcaggattggtgtttcctgacacacacaagtcaactcaaaaggaaggttcgctttattattatgtgcttaaaaaaattttctttaccatttaaaaaatatttttaaggtgtttaagaactccttggacttatatgtgaaaaaatgttcacttgctgagtagcagatcacataatattgaaaagatcatatgtgaaaaacatcacataattttgaaaaattatcttgcacataatacgtaaatattcagtcttccaccacaccatacgtacatttatatttataatgataggcattaatcacagaaacttctattaagaaaaggcactcgcataagcaccttgacttcctgcagtggtccagtgtcttgtccttacactggaggactcacagtttccccagcttctaccttcagtgaaactgtatactgcttctggacctttattatttgcacgatcatgcccgtgctgttgtttacgacacatactagcaatgagccattcagcctatttatttattcagggcccaaaatctgaacaataacaacttaaaaaaacttattgtaacccaagcaagatgaagactagaatcagaaaaggccttatcagacaagtaatacatactggtttaattaaataccctggagtgtggtggccttatacataaggtctagccaacattcattcgttcctattccaagaccctgcttatcaacggtgcaagtatttctacataattttctcttccttttatgctgtagagcataccgcttgtgggaaatggagggaaggcccacggtcccgacaatgtttgggcagggtacctcgtcccaggtggatcgcccaccttactgctgcatagacctgctgtgtatcccggccccggccccggccccggcccgacgtcctctagcccctcttcccagcactcaggaccgcggatttcagatgaccaaaggccaccctgtgacaacagcgtcggaaccacggcacttccgcctgcggccggtgagactacaaatcccagaagccccgcgcaagtctcgtcccactaccaccccctcccatcacgactcccagaaccctccgcgagacgccagggcctcgaaatagaacaaaaccggccggtgggggagggggaaggtgagggtctcggaggacacagggggttagagagctctctgcaaatgccgaagacccaagcaggcctgccgcctacccctccccgccccacaactgctaggcgcggagaccgcggcctgttccccgcgcctcccgggaagctgaggaaggtcccggacaggcttccccgccggctcctgctaagaggtccgcagaccctagcccggtgtcccccctccctctcataacgttccccgcacaccggcgcaaacctccggctcaggaaccgcagcagcttcgctgtccacggcagacgcagaaacgccgttcacaagccttttcccagaagcccccggcgcgggctgcttccggtctgcgggcctgaggaggcggggagaggtaaagcccacgttgccatggagaagcgccccgggcgggggaggggcggccccacgacaatgaccgcattgaggctgcgcttggcctcgcgcctctcctcgaacagcccagcgtcctctggaccgtttaaaagaaaacataaagaggactctaccattaagatagtccttacaatttcgcaagccctttcacgtgcattatcttgtggatcctctcagtaatcccctgcaagaaggaatgaaagtgagtgtttgtgaaagcttactacattgtgccaggcgctctcgtcgtgctttacatgtcatttttttttccacaaataaatgatgtaggaactttcattatccccatttcacagctgagatagttgaggcacaaatacagtaaataacctgacaagagctcacaactcatttgtgggtagcaagatttgaaaccaagacgtgattcaaatctttggctcccactagttatgtcatggagctttattccgacctatttatctgtcaggaaaactagataagacaggttaagagttttggcagtgatgtcacggtgaatttgtagaatgcatggtcatcttaaagctgggcattttataccataaaacaactgctgacgcgatcatttaaaattacaaatcagaccacttcactcccctatttaaagccctccaatttatgtcataataatttatgacataaaaactccttataatggcctgtaagtcccctgtggtctgttgcctgcccgcacccccagaccctggcgcccccagtcacctcagctcctcggctcattgtggcccaagatcctcagcctcaccacctgcctttcatggcgcatgacccttcatggcactgttattaatggaagtgatctcatttatttacttgttttattttttgttttgttttgtctttaagtcccttaagggcagggaccttgtctgtcttgctcaccacagtatcccatcctagatcctggaagctgactgcctggtaaatagagaactcaataaatatttgttgaataaataaatgaattgtgggatggttacattgctgcctttagctaggtcacatgattggcatcagacaccacacaaaggagccctgttgtttaaggactggtcaaaagtgtagatccagcctaacataagcatttcaagatcctcaggctttgactttttgcctcattggagaaaatgccctctgaaaagtgccgtcaggctccgctggattcgtgcatgagagagcaagtgagcgagcagctgatggtataccactgcttttcattccgaccagagctcttctcacaacccctgctaacacttctctccattgcaggaagcttcagaagtacagccttttcactctgctacttggatacggcccctaagcaacttggctgctcttcccaacctttccctcttatctgatttgtaaaggctagctgaaggcatttttgttttaagagtttttacatctaattaatgttggaaaacaaaaataataaatctgaaacctaaccttgaggaagttaaaaatgttgcaaaattttacaaaacccttttcctgtgattatattgtttgctttgtttttgagacagggtcttgctctgtcacccaggctgtagggcaatggtgcagtcttggctcactgcagcttcaacctcccagactcagtgagcctcccgcctcagcctcctaactgggcatgttataccataaaacagctgttgatgcaatcatttaaaattacaaatcaaaccacttcattctcctatttaaaggcctccattttatgctgtaataatttatcttgaaatgcttatggaaggctggacttacacttttgataagtccttaaacaacaggtgtgctccaccatgcccagctaatttgtttgtttgtttgtttgtttttcagagatgagttcttcctatgtttcccaggctgctctccaactcctgggcacaagtgaccctcctgccttggcctcctaaattgctaggattgcaggcatgagccaccgtgcctggcctccattctattattattaattatttgtaaactactaaatggaaaccacagtaaggttttcctcactaagttactcctttgagggcaggggctactaacacccgctttgaaacaccatccttctgaggtcctctgggattttttcctgaatggtggcccttgttgccatcttaaagatctagtcaagataaaacatgttcctctggacaacctgaatggagggagcagcttcatacccgggcctgacaaccttgcacatatccacataggccacataggcaatgcctgaaccacagctgatctgagtcttggcagaacaccttgggatcttcccagaagatgagtgcatgagaggcttgtaagcagctagtgcaaggccatttcccactcagctctctgtcttccaaagagactatcatgaggcagtttctattgcttcctgggttccaacgagccattctgccttaccctcttagagtacagctgcaggttataacaaggcttagctgcagcatggcattaacccctcagcaacaaggtgtccacagtgtatgctgtagtcatccagccccttctgttttggtgtcatcattttggtatctgagacaaaagctcatggagagctggcacttgcttttgctttcaatgtctgtgcaaataataatatgtctaaattcaaaaagggttcatttctttaccagccaaatctttcaaccttgccttgataccaaacatctgattcattaattaatggtaaaacgaacaaaatgaccagacagatactacctgggtaccagagataatagagatgaataaaatgaagtcatgattccgtctttgtttttccctttaaaagagatgagatctcactctgttgcccaggctggagtgcagtggcataatcacagcttgctgcagcctggaactcctggtagggatcctcccgcctcagccttctaaaacgctaggagtacagttgtgagccaccatgtccagtttgattccttcttttaacattaccatcttgttaaggaaataaacaacaacaacagaaaaaaacaagtattcacaaggcagtgtagaagtgctacagtagagaaaagcagaaggcctgtaagggctcctaaatgagatagtgtgctaagagggaagggaggcaccctgaaatggaggaagccagccagaaaagttttcaggctgggcatagtggcctgcacctttggtcccaggtactcaggagactgaggtgggaggatttcttgaacctgaggggttgaggatgcagtgagctctgatcgcatcactgtacttaagccttgtggacagagtgagatcctgatcaaaaaaaaaaaaaaagtgttcacactggaaggaaagcatagaccttcagatttggtgttatcagattccatccaagactgattttttttccaggctttggagctctcagtccccttcagctcaaaagtatctccctctgggcactttaagtacattgcttaaagattccattttagctagtaagtatacagtatgaggagtcttttgattgcaagtgactgaaaacctaataggcaagcatcgttagcttcccacacaaagtgctttcccttgcttctaatacactcctgatttttttggatggagagggggaacagtgtgcccagctgtaagcaataaagtgtaattgagctaagctatccatgaccattctgcttccctgtgccagaccctcgctttgccttgctggcaccgaggaatgagtatgtgattcatttctggtccatgagatataaggggaaatggtttgtatctttgaagaaatctgtctaattcatttaagttgtcagatttattggcataaagttgttcacaattatttccttaatatcattaatgtgagttccttaatatctttttaatgtttgtagggatgtcccctctttcattcctgacattgctaatttctggtttcttttttcttaatcaagacttcaagttttgcttgaggcttatcaattttattaatttttcaaagaatcaacttttggctttgtttatttgtttcattatttgttctctatttatggagttcttctcttaataaaattaacagacagcaaaatatggcacttttgggggggcagatatttctgagttttagatttgtgaaacgaccaccaaaatcatgacacagaatagttccatcattctataaaactccatcaagttgtactcatgccttcgccacatcccaattcatggcaaccacagatttgtcatctgtcacaatagtattgacttgtccagaatgtaataaaaatggaatcataaagtatgttatcttttaaggctggtttctttgattcatcataatgcctttgagattcatctgtgttgtcacatgtatcaatagtcgattccagtctattactgagtaatattccacttgtatctatcatagtttgtttatccattcaaccactgaaggactttggggttgtttctggatttgggtgattatgaatagaactactataaatattcatggacagaggctaggcgtggtggctcatgcctgtaatcccagcactttgggaggccaaggcaggcggatcacctaaggtcaggagttcgaccagcctggccaacatggtgaaaccctgtctctactaaactaaaaattagccgggcatggtggcacgtgcctgtaatcccagctacttgggaggcttagataggagaatcgcttgaacctgggaggcggaggttgcagtgagccgagattgcgccattgcactccagcttgggcgacagagtgcgactctgtctcaaaaaaaaaaaaaaaaattcatggacaggtttttatatgaacatagattttatttctctagagtaaatatctagaggtgggattggtgggtcatatggtaagtacatggttaactttcaaggaaactgctgaactgttttccagagtgtctgcaccattttgcaccaccagcaatgcatgagtgctccaaatgctccccatccttaacagcacttggtattgtcttttgctgctgccatttatccattctaatgtatgtgttgtcatagctcatcatggttttaatttgcatttccctaaaggctaatgatgttggacaacttttcaggtgctttttgccacccataagtactcttttatgaagtgtctgctcaagtctccctccccattaaaattttttttcttactattgagttttgggaattctatgttggacataagtcttttgtctaatttgtgatttgaaaatatctgagtctgtagcttatattttcttctcttactagtgtgttttgcagagcaacacttgttaatttttatgaacatcaatttattttttagtgcttttagtgtcatatctaataatacctaataccagaccatgaagactctctcttatgttttcttctaagagttttacagttttacatttcacatgaatatatgatttagtttgcatgaattttagtataaggcatgaactatatcttacactaaagggttttttgtttttgttttgcatggagatgcccaattgttctatttgataaaaagttcatcctttgtccattgaactgcctttacatctttataaaaaatcaattggtcatatttctcaattctctaatctgttatattatcaagcatgttatctcacatgcttgattactgtagccttatgataattgtcaaaaacctgggctgggcatggtggcttatgcctgtaatcccagcactttgggaggccaaggtgggagaatcacttgaggccaggagttcaagatcagcctggtctacatagagagacccccatctctacaaaaatatagaaaaaattatctggatgtggtcgtgcacacctgtagtcccagctactaaggaggttaaggcaggaggactgcttgaacccagaagattgagactgcagtgagctacgattgtgccactgtacttcagcctaggtgacagagcaagaccctgtttgtttaaaaaaaaaaatctggtagtttgaatccatttagcattccatatatcttttagaatcagcttgcctatatttacaaaaacaccctattctattggaaattctattggaattacattaaatctattgttcaatttagtgatgtccatgaacactctacatctccccatttattttgatattctttgattttcttcatcatcattttgtagatttcagtatacaaattctacccatgctttgttcaatttattcttaaatacttagtgttttatgagctattttaaatgtttttcttttgagacagtgtcttgctttgtcacccaggctggagtgcagtggtgcaatctaagctcactgcagcctccacctcctggatgcaaggattctcattcctcaacctcctgagtagctgggattacaggcaagtgacaccacgcccagctaatctgtgtgtgtatgtatatttaatagagatgaggtttcgctatgccagccaggctggtctcaaactcctggcctcaagtgatccaccagcctcagcctcccaaagtgctgggattataggcgtgagctactgcacctggcctttaaatagtatttaaacattttttgatttccagtgtttattgtcagtatatataaatgtaattgatttttgtatattggcttttgctatggactaagtgtttgtgttaccctgaactttgtatgttaaagccctaattcacaatgtggtggtatttggaggtgaggccttaggaggtgatatagtttggatctgtgtccctgctcaaatctcatgttgaattgtgattcctcaatgttggaggtgaggcctggtaggaggtgattggataatggaggcaagttctcatgaatgatttagcaccatcctcctttggtgctgttcacgtgatagaattctcacgagatctggtaatttaaagcgtgtagcacctcccctcttctctctcttcctcctgctccagccatgtaagatgtgccagcttcccctttgccttccaccatgatttgaactttcccaaggcctccccagaagttgaacagatgctagcatcattcttcctgtacagcttagagaaccaaaagccaattaatctcttttctttataaattacccagtctcaggtatttatttatagcaatgtgagaatggactaatactgaaaattggtactgaggagtggggcattgctataaagatacctgaaaatgtggaagcagctttggaactgggtaatgggaagaggttggaagagattagagggctcagaagaagacaggaagatgagggaaagtttggaaatttctagaggcttgttgaagtcttcctagagacttgttgaccaaaaggccgacagtgatatgaatagtgaagtccaggctgaggaggtctcagatgaagatgagaaacttattgggaaatggagtaaagatcacttttgctatgctttagcaaagagcctggctgcatagtgccctgctctagggatctgtgaaattttgaacttgagaatgatgatttggggtatctggtggaagagatgtctaagcagcaaagcattcatgatgtggcctggctgcttctaacaacctatgctcatatgcacgagcaaataaattagctgaaagtggaacttacatttaaaagggaagcagagggtagaagtttggaaaatttgtagcctggcaatgttgtagaaaagaaaagcccattttcatgggaggaattcaagcaggctgcagaaatttgcataagtataaaggagccaagtgctaatagccaagacaatggggaaaaggcctggaaggcatttcagagacctttgtggtagcccctcccatcatgggcctggaggcctaggaggatagaatggtttcctgggccaggaccagggccctgctgccctacacagcgttgggacactgttccctgcatcccagccactccaactccagccacgtcatataggggcccagatacagcttgggccactgctccagagagtgcaagccataagacttggcagcttccacatggtgttaagcctgtgggaatgcagagtgcaagagttgagattttggagcctccacctagacttcagaggatgtatggaaaagcctggaggtccaggcagaggcttgttgcaggggtggatccctcatggagaacctgtactagggcagtgcaaaggggaaatgtgggattggagcccccatacagactcccactggggcactgcttagtgggggaatggcagatccaccagcagcttgcaccctgcacttggaaaagccacaggcactcagtgtcaatccttgagaacagctataggggctgaatcctgcaaagccacagggtggagctgtccaaggccttaggagtctacccattgcatcagcatgccctgggtgtgggacatggattcaacagagattattttggcactttaagatttaatgattgctctgctggatttggggcttgcacagcacctgtagcccctttcttttggtgggcttctcccttttggaataggagtatttaccctatgcctataccttcattgtatcttggttgtaactagttattttacaggcttataggtgaaacggtctaaccttgtctcaaatgagactttggacttttgagttaatgctggaatgagttaagactttggggactgttgggaagacatggttgtattttgcagtgtgagatggacatgagatttgggaggggccaggagcagaatgatagagttttgttctgtgtccctgcccaaatcttatgtcaaattgtgttccccaatattggaggtggggcctggtgggaggtgattgattggatcatgggggtgagttctcacgaatgatttaacaccatcccccttggtgcttttcttgtgatagagttctcaagggatctggttatttaaaagtgtgtagcacctccccacctctctcttgcacctgctccagccatgtaagaggtacctgcttccccttcatcttacaccatgattgtaagtttcctgaggcctccccagaagccaaacagatgctaccatcatgcttcctgtacagaaataaatttctgttgtttaaaccactcagcttatggtatttttgttataggaccccaaactcactaagacaacgttatattttacaatcttgctatactcccttattattattaggaagttttttatagattcagtgggattttttaggtagatgttcaagttacctgcaaattgggagcacttatttttaaaataaatagcctgcataactttcttttttaatttttaaaattagagacagggtctcgttttgtcacccaggctgcagtactatggcgtgatcatggcttactgcagcctcaacctcctgggctcaagtgatcctcccacctcagcttcctgagtaactggcactacaggtgttgctaccacatctggctttttaaaaatttttgtagaaatgaggtcttgctatgttgccaggctggtctcaaattcctggccttaagtgatcctcctgtcttgacatcccaaagtgctgggattataggtgtgaaccaccatgccaagctgtgcataattttcatatcttgccttattgtactggttaggacttcaattacaatgttgaataggagtgcagagtagacatccctttttttgttctcagtcttaaggagaaaaacattcggcctttcataattaagtgttatattaactctagatttttagtagataacctttacaagtttgaagaagcctccttctattcttttcataaatggatgtgaattttgtcaaatacttttcctgcatcaattgatatgaccatgtggtttttcctgttgagactattaatatggtaaattagcttcactgatttttgagtactgagtcaaccttacagttctgggataaaccctcttggtcatgatgttttatcctttctatacattgctgaattaaatttgctagtattttgttgaggagttttgtgcctacgtctgtgaaggatattggattgtagttttcttgtactgtcctttttttgtttgtcggtcttttactgtctgtgtcatttagattcagtaatttctattgatttatcactatttcctctgtcatctccgtttccctattgaacccatcaggtgaatattttattttgattgttgtatttttcacttcaaaaatttccattcatttcctctctatatcttccatttctttcctgatatatatccttccattcattcacccttactttcaaagcatggttataaaacttgccttaaagttttttctgtgaaccctaatgtctgtatcatctaggtgttggcatcacttgatttttttttctcttgcaagtggagatattcctggttctttctgtgcctagtaattttgcattgtatcctgcacattttcaatattatgctgtcagatcctgggcattatttaagtcataaggagaatgttgatgtttttctttaacagtcaactgccctagttagggtcaggttgcaagttctgatctgcattgtgtgggctgtagttccaatgtcagttcaggtttcacacatttccagttcaatttgggtctttgtgtctgccacccagtggccaatctggggcctaagcggtagtctatcttgtagctcagttctcaatgcctgtgatgtgccagttagggtcagcttcacacatgcgcagtttagaggcaagcagacagcgctcatacaaaactttaggggatctcacttgatctccatcttctttgcaataactttatcacttttctggctccctggggtctgtcttaccagttcttcagttagaaagctggggttttagtttcctggtttagttctgctgtttacttctcccagctgcattccgcatcctggtccaagcagccagaggacacagagaaaataaaagcaatggggatttgctccatgcttctgggaccaaagcaactctgttcagaacaaagtgttcatctccctctgagcttaaagtgccttcccacagcctgggtgacagagtgaggccctgtctctaaaataaatagatcattaaataaattaatttaattaaatgccttccaaaagactactgccattgcaatgctgctgacgccaatgctactgccatactattccctgaagactggggtagaagagaagggaaataaagcaaagaatactgtatgtgggattttcccattctctctgacccttagaatccccctttcccactccaaactttattagggcagggatttttttttaaagcagcttcaatttgtttcttccaatacttttctttttcattgtggtaaaatatatgtaacatgaaaattgatcattttaaccattttaagtgtacaattccttaggccagagacagaactcttatcttggaactttctattcattttcggtgtgcacttctgggtttcaggctgcctttgagtataagcaaagagatgccaagtggggaatttcgtgcgcatctgtgtgaagaaaccaccaaacagactttgtgtgagcaacaaggctgtttctttcacctgggtgcaggtgggctgagtccgaaaagagagtcagcgaagggagataggggtggggccattttataggatttgggtaggtaaagggaaattacagtcaaaggggacttgttctctggcaggcaggtgtgggggtcacaaggtgctcagtaggggagcttttgagccaggatgagccaggagaaggaatttcacaagataatgtcatcagttaaggcaggaacaggccattttcacttcttttgtggtggaatgtcatcagttaaggcaggaactggccatctggatgtgtacgtgcaggtcacaggggatatgatggcttagcttgggctcagaggcctgacattcctgtcttcttatattaatacgaaaaataaaactagatagcagtaaaatgttgagatggtgaaaattttggggggtggtatggagagataatgggcgatgtttctcagggctgcttcaagcgggattaggggcagcgtgggaacctagagtgggagagattaagccgaaggaagattttggtaaggggtgatattgtgaggttgttagaagaaacattttcgtgtagaattattggtgatggcctggatacggttttgtatgaattgaaaaactaaacggaataatagaaggagaaatacaggtattaaaggactaagaattgggaggacttaggacatctaattagagagtgcctaaagaggttcagcatagccttgccagcaaagattatttatttactttaagagttaagagtggcagtttggggatagcaccaggagatatcagctgtgatgccttggagaaacagtgtaaaccggcagtgtaaacaagagcagggcatgtatgagtagttgagaacggagaataagagtatgactagacagaaaatagtagggatgacaagttttttggggcacaggccaagttggtctggtgtctgggatgagactggggcctaataaaaaggagcatctatacaggagctcaaatgggctgtaccctgcagcattgtgaggacaggcctgaattctgagaaggaaaagtggtaaaagtattgtccagtcctttttaagttggtggctgagcttgatgaagtgtgtgtttaaaagatctttagtccattctacttttcctgaaaactgaggaccataagggatataaaggtttcactgaatactaagagcctgaaaaaatgcttcgctgatttgactaataaaggttggtctgttatcagactgtatagaggtgggaaggctaaactgaggaattatgtctgacagaagggaagaaatgactgcggtggcattctcagaccctgtaggaaaggcctctacctatccagtgaaagtatctacctagactaagaggtattttagtcatctgactcggggcatgttgagtaaagccaatttgccagtcctgggtggggacaaatcctcgagcttgatgtgtagggaagggagggggcctgaataatccctgagaagtagtagaatagcagatggaacactgagaagttacttccttgaggatagatttccacgatggaaaggaaatgagaggttctaagaggcgggctagtggcttttactatagcatagcctgcctttgttggtgtgtagcgattaggcctggtggaactgccatcaataaaccaagtgtgatcagggtgaggaacaggaaagaaggaaatatggggaaatggggtgaatgtcagttggatcagagagatacagttatgggggtcaggtgtagcatcaggaataatgtgggaggccggactgaagtccgggccaggaaaaatggtaactgtgggagactcaacaaagagtgagtacagctgaaggagctggggagcagaaagtatatgtgtcaggtgtgaagaagaaaatagattttggaagttatgagaactgtagagagtgaattgagcatagtttgtgattttaagggcctctaaaagtattagggcggcggcagccaccgcatgcagaacttgagggctaggcaaaacagtaaggtcaagttgtttggataaaaaggctacagggcacggtcttggttcttgtgtaagaattctgactgcacagtcctgcactttggctgtgggtaatgaaaatggttgggatgagtcagggagagctaggtgggggcagtctctaaagctgtcttcaaggaacggaaagaggagtggggaaaggatttaggatctatggggtcagctaggtttccttttgtgaatttatatagtggttttgttaggatggcaaaaccaggtatctaaagttgaaagtatctaaccatgcctaggaaggaaaggaattgttgttttgtagaaggtgttggggtttgagagatcagctggacacgatcagcagggagagcacgtgtgtttttatgagaattatgccgagataggtaacagatgaggaagaaatttgggcttgactgaaataatgggggctgtctgtgaattcttgcaggtaatttgctgagcctaatgggtgtcaaggtcagtgcaagtgaaagtgaagagaggctgggatgaagggtgcaaaggaatagtaaagaaagcatgtttgagatccagaacagaataatgggttgtggagggaggtattgaggataggagagtatatgggtttggcaccatggggtggataggcaaaacaatttggttgataaggcgcagatcctgaactaaccagtaaggcttgtttggttctaggacaggtaaaatgggggaattgtaaggagagtttctaggctttaaaaggccatgctgtaacaggtgagtgataacaggctttaatccttttaaagtgtgctgtgggatgggatattggcattcatcggggtaaggttgattaggttttaatgggatggtaaggggtgcatgatcggtcaccaaggagggagtagaggtatcatacttgtgggttaaggtggggagatacaaggggaggatgtgaaggaggttttgaactgggggaaaaggtggcaatgaggtgtggctgtagtccaggcacagtcagggaagcagataatttagttaaagtgtctcggcctaataagggaactgggcaggtggggataactaaaaaggagtgcttaaaagagtattgtctaagttggcaccagaattagggagttttaagaggtttagaagcctggccgtcaatacctacaacagttatggaggcaagggaaacaggcctttgaaaagaaggtaatgtggagtgggttgcctccgtattaagaaggggatggacttaccctccactgtgatagttacccagagtgtctgtgatggtcctgtaggcttccaaggcgattgggtagtgtcagtcttcatctgctaagccgagaagatctgggaaggagtcagtcagagagccttaggccagagttccaggggctctggaagtggcagccaggtgagttgaacgtcggattttcattggggtcccgcacagatgggatatggcttagaaggaatcctgggctgtgggcattccttggcccagtggccagatttctggcactcgtagcaagctcctgggggaggaggttctggaggaacccctggcagctgcggttcaggcatttggagttcttgtgtgctggagatgtggctggggtttgtctcacagtggaggcaaggaattgcaactcagaaatatgttgctacttagctgcctctactctattattgtacaccttgaaagcgaggttaattaagtcctgttgtggggtttgagggctggaatttaatttttggagctttatttaatgtcgggagcagattgggtaataaaataaaatgtgtattgagaataagacagccttttgacctttcagggtctagggctgtaaagcgtctcagggttgctgccaaatgagccatgaactgggctgggtttttcatatttgatgaaaaagagcctaaatactaactgatttgggagagaccagataaagaaaaaggagcattaaccttgactatgcctttagctccagccacctttttaagaggaaattgctggggcaggtgggggagggctaatcacagaatgaaaccgtaagctggaccaggtgtgaggaggagaggtgataaaaggattatagggtggaggagcaggggctgaggaagaattgggacttagctcggcctggcaaggaggggagaggtcagatgggtctgtagaaaaggaagattagaaagactcagcgacgcttggggttgggactgaggggaccagtgggaggggaggaagatttgggacgagctgcattgggaacagagactagagagggaccgatgtgtaaaagaatgcctggacatcaggcacctcagaccgtttgcccaatttacaacaagaattatttagatgatgtaggatggaaaaatcgaaagtgttgttttctggctattggaaccactgttgagtttgtattggggtcaagtgacattgtagaagaaaataaggcatttaggttttaggtcaggtgtgagttgaagaggttttaagttcttgagaacacaggctaagggagaggaggaatggagggtggaaggttgcccatagtgaagaaggcaagtttaaagagaagggtagagacacggagaagggggtggggagcagccctgggctgcaacatgggtgagcagccaaagcaggcatccccacaattgacttgccaccaaaggaatgtgggtgaatgatcaaggcaggcatccccgcggagatcagacaccaatggaacgtgggtgaataatcagagaggcgtccccacaatgattaaacaccaagggaaggctgccttctcgagtccgtgaccggcgccggagttttgggtccacggataaaatgtgtctcctttgtctttaccagaaaatgaaaggaattgaaattaagagaaaggagagattgaagtgtggcgccaagattgaaaggagaaagaggttgagggatagtgagggaggttgaagaagagagtaaaaagaggccacttaccggatttgaaattggtgagatgttccttgggctggtcggtctgaggacccgaggtcgtaggtggatctttctcatggagcaaagagcaggaggacaggggattgatctcccaagggaggtcccccaatccgagtcacggcaccaaatttcatgcgcgtccatatgaagagaccaccaaacaggctttgtgtgagcaacaagactgtttatttcacctgggtgcaggcgggctgagtctgaaaagagagtcagcaaagggagataggggcggggccattttataagatttgggtaggtaaaggaaaattacagtcaaaggggggttgttctcaggcaggagtgggggtcacaaggtgctcagtaggggagcttttgagccaggatgagccaggagaaggaatttcacaagatattgtcatcagttaaggcaggaacaggtcattttcacttattttgtggtggaatgtcatcagttaaggcaggaaccagtcatctggatgtgtacatgcaggtcacaggagatatgatggcttagcttgggctcagaggcctgacaagggggagtgtgcttactctatcttccctggagtcagagcctctgttcttgtttttatcattttacttggtttaagttgctttttttgtttttttttcccccctagtttattaaggtggatgattagataattcattttaaatattctcttttactatagctattgaaaggaatggtacatctgggcttcagtcgtgctttcctgttgttttctattttttcccttcacatttatgtgcttaaaatcctgcagttttcatagctctttcttccacatgtgtcagcttcatcttccagctgatgcagcatttcctagcatcataaccattcacagtaacatgtgggaataggacgatatcatctgtatgtctcttttttttttttagaagaaagcaagcttttcccagaagtcagggggcaggcttctcctgatgtctcattggcctggattgggtgaaatactcattcctaaaccaaaagcaggcaagtggaattgtttttgttttaattttttttctttttaaaaagatggggtcttgctttgctgcccagctggtcttgaactcctgagcttaagcaatcctctggtcttagcctcccaaagtgctaggattacaggtgtgagccaccatgcctggcccacaggtggaattggatgatcatgattggcttggactaatcatttggggtagaaaaagtattaagaagtcaaaccgtaaaaccacctaggtgacaagactggtaatagccaaaaaattaaaaaaaattaataggctgatccagttctgatgcagcacattaacatgtccaaatggagatattctacctagaatcctgacaactacttctaagatggatagactggagcccccaaagctatataggaaaagataccaaatgtctatgtggttgatcattaactatgacactagagtccacaccttatgtaagctgtctctcaatgtcattgtcacctttgcataaaaatgacccttcagttgaagacaaaccatttagattcaaacacaactaagattaatacacccagacaataaggtacatccattgagcaaaatctcaggaatcagcaaagtaattaaacatatagatttatataagaaaataattttgagtctaagaaattacaaccaatttttatattatttcctagccattcaggatttgtggcctatatggtccatttgaacattcttccagggctccttggataatctcatcatcccctgtcctcaatgtttagtggcaaagggaacattatttgggcttacagtcagtcagtcctttcaccaaggacatctggattttatctttcagattctttgcttttgaataacattcattccacaggattttcttttctttgctagaatataagctttattatggcagggattataaaaaagcagcttcatttttgtttcttccaatgcttttgtttttcattgtgataagatatacgtaacaaaaatttatcattttaaccatttttaagtgtacaattcagtggtgttaagaacatttgtaatgttattcaactatcaccactttacatttccagaactttttcatgattttaacagaaaccatgtatccacaataacttccattccccctttcctctagcccctgataatcattatttgactttatgtctttatgaatttgcctattctagttacctcaaataagcagaatcacatttgccctttcatgtctggcttatttcacttagcatagtgtttttaaggttcatccttgtagcatgtatcagaatttcatttgtttttatggctgaataatactctgttgtatgtctataccaaattttgtttattcattcatatgtagatggtcatttgtgtagtttccaccttttggttatttcaaataatgctgctatgaacattggcatacagatacctgtttgagtctctgctttcagatcttttgaatatatacatagaagtggaattactggatcatatgagaattttgtttaactttttgaggaaccaccaaactgttttccatagcagctacaccattttacattcctaatggcaatgtgcaaaggttccaatttctcctcatcttttccaatacctgtttctttttaaaataataaccatcctaatggttgtgaagtggtatctcattgtgcttttgatttgcatttccctaatgattagtgacattggccatcttttcatgtgtttattggccatttaggtatcctctttgagaagtgtctattcatgacctttgcccatttttgaaatttctgttgttgttgagttggaggggttctttatatattctagatagtaatcccttatcagatatataattttcaaatatttttgttccacaagtatttgagtgcctattatgggccacgtactgtgccagatgcttgggaaacaatggtaaatgaggcagcttatgctctcaggcagcatgaaatagtggagtcaatacagaaatagatataatctccatttagcagggcaaaaagttatcacattgcttctcaaataagcaaaggaaaatgtagtttattttttataactgataatcttttttcttgaatccttgccccattgggtgggtgggtgggtggtgaaagagctgaattaaattgctatatttagttattatgaaattgaattattcagtccattttaagttcaactccctctcatggctatttctcactctgcccttttctgccacctgcttgggaaggtgaggggggcatacattccctgtgatgaggtggtgctatggattaggtgttaggtgggcttgctgttctgatcttctctggtttctattctgggcagctggtcttctgtggtgcttgctcaccaaacctgcggcaacaaatcatctgtttttttggttgggctgggggccagtgtctcttccttggtgatttgcctccactttgtttctaggaagagctataggtccccagtaaggtctggtgggccctgcagctcttagctacaggatccacaaggttacttgctcaactatcccaactttccagctctatagtcagctattttccaaggttcccactgggcacagagaactgccgtatctctttcaagccacatactagctgatagaagccatttacctaacactgaatggctgtttttatgagagttcagtgttggagcactagcagtctgttcaacaattttcctcccaatgcactcaatggcaagggggcacagccttctccccttgattctcccctaaccccctccaaaattctgcagggttgggcaacagaggtgaaaggacaccctgtgcctgaccctctcattgactcactcttcccaggactaggagagccttaaaaatttttctttttgctactccataactttttccatcccaaggtgtcatttattctcctcttccttgcagccatacttgtaatttaatactttaaaaatattttatttcatgagataaatgtaatggtaaggataagaacagactgatatgcaattaacataagagtgtggtggtgctctccaacctactctttgggtgttagggaagaagtggtacctaaactaaaacatgaagaacacacaggaattaggtaacatgtgaaagctagataggagttcaaaaggagtacatggaaaggtccaaaggctagaggacttctgatatttcaaaatggctgaagcatagaggcaatggcaagagctgaagctgaagtggtaagctgtggtcagatcacaaagagccttaacaatcttgtttagcagttctgactttatcctaaaacaagggaaagcctatgtcttagacagggaaagggcatgataaaatgtatgccttagcaagattactctggttgagagatgaatgcatatgaagaggggaaagttaagggccacataattcccctcactcagggactagccaccatcttgaattttgccagtgtaagctggaaaaatatagggtaggaggcagggtcacaacagcatatttaagtgttgaagggatggatgcagaaggaaggcagagagtgaagaaatagaagagaggaagaatgactggcagccaaggcctttcagaggtgagaatgctgaggctcagaggggagagacccctctctcattctcagacgggggagaggcccctctctcattctcagaagagggagaggaaatgatgggtaaagtgtaaataatttggcaaatttagtcataggaacttgtaagagttcttatctttttttcctttaatgcaggaagcaaaagatagttgtctgcccgtaaggaggaaggtggcaaaggattagtatggcaaacacggttggctaacccaatgtcgtcctcaacccccatctggcctgctttccctctagaggttgaaaacgcttgccctaccagacacagttgcaacagggaaacataagccagattttgctaaggtttttggaaagctttttgcttagcatggctgtctttctcctttcttcctgacttaatcctagttcctagagctgtgacagctctctcgaaaatcggacaaaatagcatgaggtaaagttagaccagtcgtcattccagctgcagattgagagccagcaacccaccttccagatttcaggttgaaaattcctatttgtttaaaccaccaaagatggattttgcatccagaagcattcctaacacaaaggcttgctgttttaagccactgttgtaaggacagtgatgaacatttgacttggtctctgaagagaatgggagtggtaaacaaaaacaaacaaaaacaaacaaaccatataggattattggtaatcttgaaggcccagatgaagtgaaagccagaaaacaataccaatttcattttggagtatttactatccctgaaaattaatataatgggggtgctaatgctaatttttaaaaccaaggttagctcaatgaattctccttttatataaactagtaccattcactcattaggatacctacataactgcaaaataattcaaagtacacagagacaccctttaaagattcatcatatacttagacgatatgattcataccactttcctgtggaaacactcaaattattcacaataaatagaatgcaatcttacaaagttgatggcagcaccaagtgaagatgggtgcttccttcaaaatacttgatttagattctgccatcttattcacatagaacctaagaaactctttccgtaattaagcagtaattcacaatatatacatctctgaggcacttgttgtttcaatagatggtttgttcctctccgtaattacaaagacaatgagccccaaataaaaagtatcctacatttttagtgactcaagatacacacaactcaatataaaattcatattcactagagctacaaatcataatcactatcagaaaattctataataaaatttacattcacttctcctcctactaatcttacatttatcagcatactaactaagcagagtgtggtaattccacatatttggagctcctctaagccagtttctggagatactctaagatatggttggattttctgagaatgaaatgttttatactttatgaggaacccaaccagacaaagaagtttactatgagtctcttcccttattccaaggactttgatttctgatgtttgcctccatattgtgtaactgtagcaccatggaaaacacaatacatgtattattgtagtaacattacagagttttatcaagaatctctggaaaatagataattttgttgtttgtatactgtcagaataattttaataatgtacgattcagtaattttaaacagggaatctggctgaattaaatgcaggtaaaacatagttactcatatcccatagataagccaaataagatatcccataaatgtcttaaaacttataaactataatggttaggttcaacaattgtttataagggactgcagtggaccctttaaattgaacttcagtgatttgtccatatgtacaagagcatcaaaatccagggtctcatttcatgacagcgtgtctagaaactcatcttactaagaatacagaagactctgaaaaggttgtcttgtgatgcttgaaacatattcatagttgatttatgccagaaaaggggacactgaaagtattgtcatcagcagttacgggcttcctcttccagttaagctgtggtacatctctccgacacacactgtacttgacaacacttgtggtacatcagtcttgtttgacaattttgttcatctcccttttttctttatattaagatgatcatccatcttacagaagcacccatagattaatattgttatgaaaacattccttatgtttagctgactccttgtagacaagcagtcattttcatgtttccattgacttatttccaaattacattgcaaaggagattatttttttccaacacgggaaattaacttgatattaatagtatggaggctcttgtgtgctttcataagataaggcctttatttatctgcctcctgaaagtgacctggggcacttcagcctagtcttgaagtacatattcttttgggcctctgcaatcgcatgttcatattttgaatctagtaacagaagacaaaataggaatttatttttatttttatttatttatttatttatttatttatttattttaaagacggagtcttgctctgtctgagcggttcaagcaattttcctgcctcagcctccctagtagctgggattacaggtacacgttgccatgcctggctaattttttgaattttagtagagacggggtttcgccgtgttgtccaggctggtcttgaactcctgagttcaggcaatctgcctgcctcggcctcccaaagtgctaggattacaggcatgagccaaccgcacccagccaggaattctttttgagtgctttaatttttggtctttagaattctagtgctcaagttatgaaatggaggagaatgtctatttttacactgagtaactcacacattccttctcaatgagggaaaaaacatacttgtctaaaaagatatatactaattcattatatgtgttaataatgaaaatagtagaacatgtctgagaatgccttttcaaggcctgcatagggatggaaatctgaattaagctttggaattgcaaacgtcagaattgagactgcattgataagcagaaaagcaaataatgctgacctgagatcttcaaccttctctcctgtggctttcatgagtcttgaaaggagactggtgcttactaagaccactgatttgtactaaggagcgtttgcatctggtgtcttcccttgtgctgaaatagctctgagtaaatgctttgattccctcatgatacttatgggactttttttctaatgtgtcttttcctatgtctaaaaagatttgagctctgactaaaggctttgccacagtcatgacacttgtagggcttctcaccagtatgggttcgtcgatgctgaatcagaattgcgcttcggctgaatgcctttgcacactcgtcacatgcataaggtttctttccactgtggattctctgatgtaaaataagggctgagctctgactaaagattttgccacattcatcacatttctgttgttttttccaagaagggtttccttgtctcttttcaaacctaccatcttgttcataggttcctctatatgtggaactctgggagccattcatatgaaggatattggaaacattgcaatgcagttctatgcctaaagaagtcttttgccttgaagcagatttcacatttgtagttttgatgtcttcatctgaaatggaaaaacaaatgtcaccaggaaagagaaaggatgatccaaatgaaatatacatgattattgctagcatgtttataaaacaacacacaatgtgaaggacggagagtgtaagacaaaatattgagaagtttatataagacatagagaaaggtttacatactgaggaggcagtcaactaaactgtaaagttgcaaagttctatggaaaagacagaatagggaataaggataaaaagatatgtcagagactaaggaaagtctggaaggaaagaaagggcttagaaagaagaaatgattggagacacagagagctagaaggagaggaatccaatgtgccagtgggagtaacaaacaagatttagtactggagtatcaataaataaataaagcttaatattcataaaggaatcagtaactatgcaaagaaatgagctgaagaaagccaaggggccaaaaaggaatgtggaaaataaagtaagaaaatataagttaggccaataaagggaagattatagactaggataactagtacctcaaaagatcaagggtagcagagtacccactgatgaaaaacctctactcctgtatggattttatattactggttgaatcgctgtttgttgtattattttgtattacatttaacatccatgaaaaacgtacatggctgcttatgggctgcggccactcaggcggcacacaaacctggcttgatgcagagggccttatgactcagggtgcctaaagctccagcagaactgctaactcagatgtgaaaatgccagtgtaatgtggttgcattacctgaagaaatcacttcagttatcctcatggtggcattttttttttttttttttttttttttgagacggagtctcgctctgtcgcccaggctggagtgcagtggcgggatctcggctcactgcaagctccgcctcccgggttcacgccattctcctgcctcagtctcccaagtagctgggactacaggcgcccgccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggcccatggtggcattttaactgaagctgctgaaagacaggagcttaaaatgagtttataaaagcaaagtacaacagttttggacatgtctggggagatgacttggctggggctgactgtgactactgggggtgcctttatctgaagtaattatataaataagattaaaagcaacccagagaggtactgatgataagtgattccctgggccctctcaaggcctaatgaaaaggttagggtgagaaaggtagtctggggagaagaattagtgatgcaatgtgatactgaataagaaaactgagttgttgttttactctttagaatttacttaaaatggatctacctgctgtctctacaatctccttagaatcacccaacataagctcaaatcttaacataagcccttcccaattccttcttaatgacacaccccatagtttctgtgccgtgttctctttcttgctgcagcaaactaaataaacctaacttgaaaaaatatataaaaatcaaatcaaatgggtctaaatagttattacaaaaggaatttaaaattatttattgtatttattcacaaatatggtgtctcagtccattttctgttgtttagaatagaatacctgaacttgagtaatttatttataaaaagaatttatttcttatagttatggaggttgagaagtccagggtggaggggtgcatctggtgagagccttcttgctggtggagaccctctgaagagtcctgaggcagtggagggcatttcatggtgagggggctgagcatgctaatatgctaactcagccctttcttcctcttcttataaagttaccagttctcctatgatcaccaattaacccattaatccatgaatgagttaatccatttatgagggcaggggtgataattcaattacctctcaaaggcctcacttctcaatactgccacacttgggattaagtttcaacacaagttttggaggagacaaatattcaaaccatagcatatggcatactcatttattattactagtttaagtggaaatcattttataaatggtaaggattctgtctcaaattcatttttgatagtttatattccaaagtgacctcaatgattagtcattactatcaaaatcctggcatcaattagtactttacagtactgagaccaagatcatctcccagaagctttcataagacatgactcagtaccacagaaatcatgttgtggccttaagaaatggttctattattctatcaagtgattctggttctctctgccttgtactgcaagatcctggacctgttgcattctgtttcaaatttctacgaatcttaaaaaaaaatgtaggaaaggcctccatgaggacattcacaggtaggatgtggttcttgccacacctggctttgaggttgatcacttctgtagtcaccaccacaccaagctgctgaggctgggatggtctccctccctttcctgacggaaaatactttttcgtgaaaagactttcacttttctaagtataccaagacaatttctagactggaggtattacgtgtcccagtataagccttcagagagccagtacttgccaagttagggtgaacaatgttttctaaatctctttctaaattactgtatttcctttgtgtagtttcttataaaaattcccttggaaaaactctaaccttgcttagctatcagccactcctgaactatggaagcagtgctggagagaaggaaggagatgctcccaagtaggatttccctcttaatctctggctcctattttatccaggatgatcatctagaaggagggtctctgctcaaatgtcgcttcatcagagaggcctttctaccactctatataataagatcctatccccaccattctgtttaaagtagcatggcccttttatcaaatgaaattttacattgagttccaatatataaaacagacgaaaacacagctactctgtctgaagcaggagcagtcacagcctacaaggcctctaactcagccttatttctacttctcaccttccctctagcccccttattctgttttgtttttattttttccccatagcacttatttgtttagtatctgcaatggaagaatagattgctacacagctattctggagcacttatagaaagcaatgcaaagagcagttgaggccagttgaagatgtgagggagtagagaagtgtattcaaagcacgtatgagagcaaagtcaccttagcagcaatataggcgattctgctacgagatcccaccagtaactgagcagttatataggaaatgatgatgaggatcagtggtctctgggctgtgtaccttggggtcccacagaaaggcctcaagggctgcctgaagataaaagggctactttaaaaaggcatgaaaaccctgatgcagatgtcagggatttaaagtctgaagattttataagaatctctgaaaaagaagcaagaacaaaatactgaagatcttcatttagtaggacaaataacagaagttcccacagtaaggaggagatgagagggggagatttgaggcctcttgcataaatcagctgagatgtgtgtggtgagcagagggcccccacaccttccaacatgaactgaatcctgccccctcaccatgtggtcttaaggactgaagctcccatgatgctccctggagctgcttcttcacgggcatgagctggctacttggcaattcctcagtgatttctgaaggtgctagcttctctgcaatcatgtccttccttcgtccaaaaaagatctaaaaacaggaataattgaggctgaagaacaccatcaggttgggacttgaggataaaataacagagaagaaactatgcaaaaagtatcatggacacaggaaaagggagggaaaaagtagagccaccttctatttgctgggacacccattagtactttcacccctatacatccagttgtgctgagtgggaatacagtttgagagctctactcccaatgatgtgccagtgctcttgactcagcctgggggttcatctccacaggcatccttcttacctgctttggtccatcaagctctctctccacatcctccagcatagtcacagtttcctctccattctctggatgatgcttctgcacccaggcctgaagctcttttgggaggatggccaggaactgctccagcaccagcagctccaggatctgctccttggtgtgcacttccggcctcagccagagatgacaaagttcccagagccggctcagagcctcatggggcccaggtgaatcctggtagccaaactgcctgaattgctggcggaaggtctctgggctgtagctgctgctccagtggaggctagagtctggatcacaggtctgctcttcctcttccatcttctctgtcagaatcccattacactcctctgaagtttgtgttaggagtgatgatgactttcccaattttgcagacattttgacagacaaatagctcagtactgttaggctttaatcctcaaggaggtgaagctgtcctgatggacactccttaaatatgattaaagaaacaagtggaaagaagacaaaagacaaatgcttcttagaacaaaacaactaagattagaaacataagactgtataggaactactgaccttagtcttaacagaaaccatgcttttatttatttatttatttttgagatggagtcttgctctgttgcccaggctggagtgcaatggtgtgatctcggctcactgcaacctctgcctcctgggttcaagtgattctcatgcttcagcgtcctaagtagctgggactacaggtacccgccaccacgcctggctaatttttgtattttcagtagagacagggtttcaccacgttggccaggctagtctcgaactcctgacctcaggtgatccacccgccttggcctcctgaggtgctgggattacaggcttgagccaccacgccaggcccagaaaccatgcttttgaagaatacttctttaagagaaccaaacagctaagactcattaattcatatgcataagtgattcacaattcattctgaaaaccatgcccacaaggctactgaatattacaataagagatcagccaggattgcatagaagctcccagataatggaaataagggaagcctgagaaatgctctaactctggagccagttcaaagagccaatcggtatttagtgtgctgcaaagagctcaaagaaatagtctcatgagggaagcacttttgtgtgacttttttcagcttttactgttaaaacattacttcgacattaaaggaaccattaaaaaaaaaataaaccaatcagctgggcactgtgcttatgcctgaaatcccagcactttgggaagccgaggtgggagatgggaggatcacctgagcccaggagtttgggaccagcctgtgcaacataatgggaccccatctctaccccaccaaaaaaaaaaaaaaaagaaaaaacaacaaaaaaggcaatcacgttccttcatctgaatgtatttctatttttttccatatccatattacttacttaactattttaaaatacttaggttgtttctaatttcactattataattaatgctgggaggcacatctttatgaatatactgtttttctcctttcaaagtatttctttcaagcatgtcccaaggcctctgcttgttgaggatcaaaggagaagagcaaattctgtcttgctatgtattatcaaaatattgcacaaagactgtatcaattcacaataccatcacaatcatagtgacttgtgagggcaacgatttcttcaagtattattagctcgttagcaacaaagttggggggggacggcactttcctttgtatcattttactgttaagtatcaccagtaactaatctcattttgttgttgttgttgttttgttttgtttgagacagagtctggccctgttgcccaggctggagtacaatggcgggatcttggctcactgcaacctctgccttctgggttcaagcgattctcctgcctcagcctcccaagtagctgggattgcagacgtgtaccaccacgcccggctaatttttataattttagtagagacggggtttcaccatgttggccaggctggtctcgaactcctgacctcaggtgatccctctgcctcggcctcccaaaatgctgggagtacaggcgtgaggctctgcacccggtctaatcatattttttaaattgggcaggaggtatatgatagtgtttgtacaacttcagcaaatgatgactactttaaaaatcttacgtgcgcctccgtcttccatcgttatgtatcctgccatttgacttattttctcacttcaccaagtattgttctaggccctgtataaagcctgtgagttcataaagttgttaccaaataaatgatacaactttacacaatgatgtgctatgaaacaaacaatagcagacacacatattaacagaatttactatgtgccaagcactgttttgaacaccttagtaaaaataaacaaaggttaaatcctcataaaagccctagattatttttacccccatgttgtagacggggaagcagtcacagcaaagccaggtactctggccaagggcaaagctggggtctgaacccaggccgtccacatttatccatggtgctgtgtggttagaggccataggcagcaggggcccttgtggtgacccctgcgcgttgtctcagcgcagaggaggaagtggcggcaggcagccgcgctcccagatgaagcggggccagaagagtctggggaacaagacctgagaggtgggaagggttgaggccaccggtttggagccgtcaggtaccctaagggatatatgagggaccccggggctaaagcagcctctggaagagagtggccgccctgtcacttcagcaccaggcgcagaatctgtgctaaacctgaggtgagggtaaggaacccccgacaccgcacgacaaccagaaagaacgtccctggaggggaggcttcgatcaaagcctgggacgcaggggtctttctgcaggggacgccgctctcggctctaccctgctgtggtgggccggctctgggagggctggcttccgaccatctcccgacctcccgcgcccaccgcgccgcgccgcgcgcctcccaggctgggaaccgccggggcgaagcggcaggtggcgcgggttcacctggcagggcaggcgcccggggtccgccggggaaggacgaggggaaggggtgcgcggactcaggggcaggcagcggaggggaggggcctggggatctgggacggtgtaagggtgctgcacttgcgcgcgaagggaggggtggcgacgagtccgcggccgcctctccgcgtcccccttccaccacccggggaccaccgcctctgaccgcagcctgggggccctaaagaggcctcgggtctcacctcccgacgccgtcggggagaaaccggggaactgccagctgcgcaacaacttccggttctggtggcgggtcggggcggggcccggaacgcggggacgttgccatggagaagagccgctgtggccgcgcacttgggacagggaaagagaaccgggaggctcgaccggtgggaatccagctgctctgctcagtgttccgttcaataaactagcattgttgcttcgcaaagtgcttttgcttacattattcatttactccggtaactcagtaaggttattcccattttacagaaaataaactcaaatgtcctgtgacttgccaaggattacagagaggggcgaatgctgtgctgtctaccgctgagtacaatccctaataccattcccactcccgaagtggttacaccccaagtactgacgttttaagggacaagtttgacatccgcaaccccatgctttcacaggagaacacaatggcccttgaaaaagtgagaactgacccacataaaatttgttacaatacatacacatatctctcctcagataatcttaatctcaattgaaaaataagtttgaggccgggcgcggtggctcatgcctgtaatcccagcactttgggaggtcgagatgggcagatcacatgagccaaggagttcgagaccagcctggccaacatggctaaaccgcatctctacaaaacatacagaaattagccgagtgtagagacgcatgcctgtagtccccgcttcttgggaggctgaggggtgaggatcacctcaatctggggaggtggagactgcagttagccatgattgcgccactgccctccagcctgggctgcaaagtgagagcgtctcaaaaaataaataaataaataaatttaagcctaaatgcaccacagccccacctcgtgacttccttctctagcccctttccctagggactcctggaaaatgtacttgtactcgtaactgaggaattagggagaggacggagatgcttgaaaagcacttgctaattaataaagaacaataacaaaaaatcccttttggtatgacgccgccccaaaagtatgttagtactggaatctgaagtgaagaaagaagaggctggtttactcagtttatgacgctaggggactagggagaggtttggatcccaattagagtacagtaaaactaaatctgaagaaattcttgcttcaaacaaggggctttcacaggataagactttttgctgatgcagctgccaacacaaatagcaaacagcccaaaagtgcaggtgggaatgtgtttctggcgctggtgggtagggtaggttaaatgactcacgtcaggggagaatttgaaacgagggcaaggcttggcagtggtgtgaagtcacaggagacaatttaaggagaatatgaacgacagtcagaagcttcaaggagaaggaggaactgtgggatgtggcaagaggtcagggatgatgaattcatgggtatggtccaccaaacagccagatatcagaggccaaagttaaaaacagcaacaacaaaaaagggagcagacataaaagattgattagaaaagtttcacagtcaggtagttagagcaagaacaggtttttgtttgctgttttaattttttaaaaattttgggggtaaagtgaaaagaaattagcaggaataaggtcccagtagggtgagcacctactatataccagttgtatcgtaaacaccgggaattcaatggtaaaatatagattcttgccctttaggggctaatagactaagtaaagagaaagatgaataaattgacttttctaaacaatgtggcaacattctgatggagacaactgcaggatactataaaagcacaaagaaagggaggtcctgggtagagactgggattggagttgatggagaaagctggtgttgatacatttgagactgaggtaccagtgtgggatgttgtttagatttgctggattaaaggacagcaggatgagtggctgaggatgaggctgaagaggcaaacagcagcctagttttaaagggtttgacaggccaagtaaagggctatgaactaaggttttaagcagaaacttgaattagtggcatgtgcacatctgcaattcaggtagggctctctgatagcaacacgaaggatagatctgaagggaggcaaaactcaagacagggttaccagctctgaagctgttgcaaagatccaggctgcagctggtgaaggtctgaactagcacagaggggacgagaatggaggcagattctggaaacacttgggaggctggtgcttgcttagatggaagactgacagatgattgggtacataatgtgtcattcagggaagttaaacaacagagtatgtttgacaatggcttatgtggatatttgaggggatttttgggtagactggatcagaagctgaatgggatgctatcatcaataactgcacataattggacattttgtgtgatcatgtgaaaataaatatcaaacatgttttatatctgaatgcttcccttatataggtatgtaaagatctctatgacttttatgaaccatttctaaggcaatcactctacaatgacattatagagacatttatttctcaactttgtactcttcaccactcccttcatcccaacatatttgctctccacctaggtagaagcttttaggggcatggatctgtgtctgtctaaacacataacccttgttttttttgacccgaggtgcatgaagtggatgtattatacacagctgccatgtttctataggataaggaattagaaggttaagaaatttaggttggctcaagcatggtggctcatgcctgtaatcctagcactttgggagatcgaggtaggaggattgcctgagcccagtagttcgagactagcctggacaacatggcaaaaccccatctccacaaaaaaataccaaaaattagctgggcatagtggcatgcacctttggtctcagcttcttgggaggctgagatgggagaatcacttgagcccaggaagtcaaggctgcagtgagccatgatcattccactgcactccaactcgggcaacagaatgagaccctgtctcaaaaaaaaagaaacttaggtttataaacactgcatgttctcacttataagtgagagctaaacattgagtacacatggacacaaagaggggaataatagacattagggcctacttgagtggggggtcggggttcaaaaactacccactatgcctattacctgggtgatgagataatatgtacaccaaacccccattcagttaatctgtataacaagcctccacatgtaccccaaaactgaaataaaaaattaacaaaaataaaaactttaaaattaaaaaaaaaagaaatttagattgagcaataaaaagcaatttgcctacaatggaactatggtttccaagcaagtggtggatgggttgtatgtgtaggagtccaagtgtgggtacacacttgtcaacctgaaataataaaagggtcagaatccagttttaaagagtttattcaaacaaaaagctgggaatagccattccaggacacacagactccagagaaatgggatcagtgctccaaagttaaaagttaaatcttgctaatataggaagaagacaaagaaatttatcaggattgcaacattttctatacaaggctggcttaatagtttcaacaaattaattagttagtttgttttcttttccatatagcttgttttctttatagttggttttcatttggtttccaatttaaaagagtgtatttaacattctatcttaagtcaatgtgatagtcaagaagtctgtgtgtgagaaaggtaagagaaaggtgaatctataataaaggccaacagtggagagggaaggggtcttcctcttccctttggccatatataacattttacaaaacaatgcaggtaagggaaaaggcttcatctgtaatcagagaaacagaaggttatagctccctagtttataggtgcctaccatgtgactcaggatcagtaataacattcttccaagtcctaaaataatttagagttctagcagcttagatttcgaatgactctttttcacacagtgaacagatatgagagtttgtgtgagggaactaggggagctctctctcccttagtggaagacgtgaataaagtatcaagttgggaaaacaattaaggaagtgtattagtctgttttcacgccgctgataaagacatacctgagactggcaatttacaaaagaaagaggtttagttggacttacagttccacatggctggggaggcctcacaatcgtggcagaaggcaaagaggagcaagtcatatcttacgtggatggcagcaggcaagagaaaagagagcttgtgcagagtaactcctgtttttaaaaccatcagatctaatgagacccattcactatcatgagaacagcatggggaaagacccgcccccatgcttcagtcatctcccaccgggtccctcccacaacacatggggattatgggagctacaaaatgagatttgggtggggacacaaagccaaaccatatcaggaagtatcccaaactgagttcatcttctctctccatcaccctcaataggccaaattccttgctttgatagtgaaactgctgttagctctatgttccaggcagtaagtcttaggagtcatcttacacatttttctttcccttgtttatgaaatccaatgtggtctcaaagtcaacagacaaacctgggttcactccccaactctgccgcaagctactgtgggttaagtcctaaaattctctaatccttatttcctgattataaaattgggatcataataatctgaagattaaatgaaataatgtagctaaagctccccaggtgatttcagtgggcacttgtattagcttcctgtggacactgcaacaaattatcacaaatctggtggcttaaaacaacagaaatatatttcctcacagttctaaaggccagaagtcagaaacccatttcactgggcttaaagtgacagcatgcagggcagtcctccttctggaggctctagaggagaattcattcctttcttcctccagcattttttggctgtcagcattccttggcttctggctgcatcactccaatcttcaaggccaacatcttcaaatctccctctacgtccttttcataaggatgcatgtggttgcatttaggtcccacccagataatccagaataatctatccatctcaagacccttaatttaaacacatctgcaaagtctctttttccaaataaggtaacattggtaaatgtgatgtaaacatttgtaaatgttccaggaattaggacctgatatcgtttgagaccattttttaacccaccacagcagccaatggggagagtctccatatttgctaaataaagaattgtctcaaagaaaaaaaatctttgagaagacaagcatttgagaggaattttaacccatgatctgtggctctttgtgtacccaacgtggtaaccactagacacctgtggctaattacatttaaattttaattaattaaaattagaaattcaattcctcagtcacacttgccacagttcaaatgctcactagcctcatgtggctagtggttcccataatggacagcacaagtatagaacattttcatcagcacagaaagctctaacagacattgctgggtacctcttgaaatatatgtttctaggtgcatatgtgcatttttcttggggcagggtctaacagaagacacaagctataaatcttgacaatgaccagtctgttgacgggttctatttagcccattgttttaaaattgaattggttgttaacttttaagttttgatttaagacattataaagaaaaacaaactacaaggccagaggattgcttgggcccagaaatttgagaccagcttggggaacatagggggacgccactcatctctacaaaaaatttaaaaaattaaccaagggtggtggcacatgcctgtggtcccagctactcaggaggctgagatgggagaatcacttgatataattagtcctgctagcttctgctagcttagtcaaagctttgtcatctgagttagaccgtgtgaaggtgacagtggtgcaggtctccctgtggactagataccccaatcttgcctcacccttgataatgcagtaaggaccccctatcttatgacacagggcaggagggaagacagccagctctacaggatccacatcatgtgcagtcaccaacaactgagacttttcattctccacccaggtggtgacagtcttaaccctgctggaaggacaggtgacctcttagtggagacatcccctttgctggcagctgtcttcccagcccacgacaacagcctctgcttctcttgctttgtctctggtctgtacttgtgggccagcccgagttaattaaggagcttgttggcagtctgaagtctgggtaaactagttaatcacaggaggcattttctgctgctcataggggatagccctttgccgctgcaatcagatatagctgggccatttgacaaagcaagtgaggtccctttggggctgaatgtcctgtccaatgccaaaattcttaggccttttctcaaacaagggatttaccaccttcttagcctcctgctactttcagacagcaggggctggggtcgtcttcttccccttggccttcttttccttgggcatcttgggcagctggaggagaaagaaaggaaagggaattctctcctccatcttctgagcacccctgactgttcctcttgttctgcaaccttacatattattagtgttctccattgttctgccttttgttcccgcacttttcatgccgtaggctctctctggctagcttatctattgccacctatgaggcttcaactaccatatctaaagtaattagttccaacctatatcttgggcctgacctttttttttagtctcttctccatagagttgactgctacttaacataactgcttgtttcccgacaccctacactgatcatgaattattcctctctttccctctacctgcctcttttctcctgtatcttctatcttctggactagcactgccattcacccattttctccaacagaaatttggaatcttctatgatgtgtcaatttcactcatgtacatgttaggcagcgtctgcgtcttatttatccttgtgctgtctatgtccatgctccataaaaacataataaaaaaaggagaggaacaaattgataaaagagtcagtttgctcatagcaatgagcttatgagagtggactggaaacaagaagatgtgaagtttgattcatattcgtaatgggagcccagtgtaagataggaaggaaatgaaggatgaggtcaaaatgttaaatgtgaaatttaacaaagattattcagatggatttaaaggcatagttaccagagaaaacagatgatccatgaggaggatttattttggaataaaaagcataatggggccgggtgcagtggctcacgcctgtaatcccagaactctgggagaccgaggagggaggatcacctgaggttaggagttcgagaccagcctggccaacatggtgaaaccctatctctactataaataaataaataaatactagctgggtgtggtggtgaatgcctgtgatcccagctactcgggaggctgaggtaggagaattggttgaacccgggaggcagaggttgtggtgagccgagatcgtgccactgcacttcagcctgggtgacagagcaagactctgtctcaaaaaaaaaaaaagcataatggcttcatgacaatttgaatgtgaagagatgaagagaatacatctcacgcaatactgaaaattcatgtcagggaagacagtaaagcatgctgagaaacagacgtgttggagcttcagggtctgctataacattggatgctcagcacactgccccgtatgaagtcttgctcctcacctctcttccaaggcatggggctccatgttttcatcttcaattttgttctccacagactggaactaaatattcagctatatgtgaggtgattcctctatgagtttcctccctaggaaattcatactgtaactaccacaaacttcgtggcttgaaacaacagggatttattatcacatgggtctggaggctagaagtctgaaatgaaggtgttggtaaggtcataccctcagtgaaggctctagggaggaagccttccgtgtctgtatgattcccgctggttgccggcagtctttgacattcctcatcacatggccttcttccctctgtgtctgagtgtggttccatgtatctatcatctttttaaaagacaccagtcgttggctttaggacccacctagcaatcaagtatgacctcatcttaattaattacatctgcaaaaaatgtacgtttccaataaggtcattctgaggttctaggtggacacaaattttgggggtattcaacccagcacactgcctttgccagctagtaatttgttgaaattcacccttctgtgactgctatgtaacatgaagtgggtcttttaaatctatttccttaaggcagagaatgaaggaaggggcctaagaaaggtggcaagtcctggatggaaggtggattatgacacctgggaaagcaacatctgtgatgggtggagagactcaaaccgcaaatttgaatacaagtcattctatccaactgcctgatgcctttggaatctaccccttggcaaagaccacgacaaaatatggtaaacagaatataaggctatgatgggatgtatttatagtcacaggaaaatacagggctctgccttgtggaggagatgaaatggaaaccaatgtgatctataactaatcatcactcactttgtacattcataaaatttcccggaagcaggaaactggaatgagaataggcaaactggaagcaatgcactgagcagttgttctgcctccattcttttctagatgacaaaactaaagacccccacagtgaaaatgcttatcccaatttagccagctattaagtgacagaacccaaactggatcccatatctcctgactctgttcttcctatttgatcctgatgcccctcaggaaaataattagaataaaataaaaacatacttcttgcaagttctgacaattattacctagaaagaggatttgaggaaatggcatttttgaggaaatggtgagaaatttgcctttaattcatatgtgtgtgagggagagttcatttaatttcttagtttaatattaagttgtagaaacagtgtttgataaaccaaatcacaggaggaaaaataagaaaaaagctccttaacagtaggcgtgatgttaacaatttgtcagcaggaggcgctagagagacattgcaggaggaagggcttcccttctgggtctggtgcgcacagcttctctagcatccagtaacagctcctccctgtttgctcttgcatcctttggggcagttttgtagccgagtgcctccagtgagaagcctcccagtgaatggctgtctcttgcattctagagggaagacttctggtaagttctgaagggcagatttcaggaaagtttcactaccatggcaaaacagtgacttttctgctatccagtgagccaaggctatgtaccacagaggaggtgcctaacaatcacgtggacaaaatgacactctcggtgaatataagtcagtctctttccctagtgcttgctcaacggactgtaaacaaagtagccacagtggcaaggatggagactatgtatgggctcaaaaacagggaccgtctccactcaccaaaactgacctagcgaacaccaccatgtgtacctactttgtcaacagcagaggccagtactaagcccttcaaatggtcctccaccgtttgaagagggcaacactaagcccttcaaatagtccatgggaaccagccagccacctggtggcaggttgattacattggaccattttattcatagaggaaacagattaatcctcactggaatagacatatattctgaatatggattcaccttccctgcctgttattcttcagctagccctactatgtatgtacttacgaaatgccttagtcatcttcttggtattctgcacagcattgtttctcatcaaggatctcatttcacagcaaatgaaggatagcaatgagttcatgtctatggaaggaatcaattggtcttaccacccacatactccaacatccagaagcagctggcctaactgaaagttggaatcacttactgaagactcaattatggtgtcagttgggagacagcaccccaaaacaacagcattctgtcttacagggtatcatacatgcttggaatctgagatcattatatgatgctgtttcttcatagccagattacatggatctgggcatcaaggggtaaaagtgagcatgactcctctcacttttatacccaataatccatttgcagaatttttcttcctctttcagaaacttagaactatgctggtttggaagtcatagtccccaagggagggattcttctaccagcagacacagtgtttcaattgaatgggaccattcaggagggtgaaactgcttcctagacatattagacttcttatgccattggaccaactggaaaataaaaaagttatataggggaggtgcttgatcatggttaccaagaggaacttgggttgctactacactataggggcaaggactatgtctgaaactcagggaattatctagggatgcctcttatacttctgtggccactagtaaaggttaatggaaaactacagaaaccaaaaaagtcagggttaacaacttagattctccaggaataaaggtttgggtcactatactgggtagagaaccccagcaagctgtgtttctagctaaggatggaggataggtggactagttaatggaagaaggaaggggtagatattcagtttcacaacaaattacaaaaccaaggacagtaatagctttgtgtattttctgtttgcttattatatacatttgtttattttatgttctaaccattttcatcttctttctccacattgtcgttttatacacaaatagtttaaacttaactttacaatgtgttctttaggttacagaatatttagtgggactatgactgaatttggggagtaattaatataaccagtaatgaatacaatgactgccaggactgcgcatctctacattttgaggaaatggtgagaaatttgcctttaaaaaacatggttgtattttattacagaagaaaattagagttgctttgttgatgtacagatgtgctcaaagatgtgaagaaggttgcacgtgtaggttaagtagtcagagtcctattctcatttgaatctctgtgcttttgctcaagctattctatgagggaaacttcaaaaagttcatggaaaatgtgtattatgaaaaactatgcatggatttcaaattttttgcaaataaactcataccaacttgatatgacatgtctgaatagaacctagtttgaggcactaagaaggataagatatcaatttgaaaagagcccctattggagcaacatgaattctgctaaaattgaagcaagaacaaacatcgaatttatggtgatgcttgcatggaagaatggtgaaatcactgatgctttacaaaaagtttatgaggatgatgtccccaaataaatcagcagtttacaaatagataaaccacttgaagaaggacaagataacgttgaagatgaagcctgcagtggcagaccatccacatcaatttgcaagggaaaaaaggatcttgttcatgctctagttgaaaaggactgacaattaacagcacaaacaatagccaacaccacagatgtctcaagtggctcagcttacgtaattctgactaaaaaatttgagcaaactttccactctatgagtgccaaaaccattgcgcccagatccactgcagacaagagcagagctttcagtggaaattttaaacaaataagatatagacccagtagcatttccttgaagaattgtaacaggagatgaaacacggctttactagtgtgattctgaagacaaagtacaatcaaagcaatggctaccgagacgtggaagtggtccagtcaaagcaaaagtggactggttaagagcaaaggttgtgacaacagttttctggaatgctcaaggaatttttcttgctgactttctggagggtcaaagaatgataacactgcttattatgagggtggtttgagacagttagccaaaactttagcagaaaaacacccagaaatcttcaccagagagtccttcttcacagtgacaatgttgctactcattcctctcattaaacaaggacagttttgcaaaggtttcaatgggaaatcattagacatcatccatcttacagtcctgattgggctcattctgactttttttattttctaatctaaaaaaaatctgtaaagggcacccatttttttcgtcagttaataatgtaaaaaagactgcattgacatggttaaattcccaggaccctcagttctttaggagggtctcatcacttacaaaagtgtctggagcctatgttgagaaataaagttttaatttttcaatttttatctcttaattttgtttttccacaaactttaagttccccgtgtatataccttaaatgactcctcccatcctctcaaatttgagacacagtttatttcatcatgaagtttcttccagttaccctaccctgcagtgatttctttctctgtgtccctgaaggatttgatagtatcgtacatttagtacctaattatacattctgaacataattatcttttaattattggatgtattatactgttctccatcccctgccccacctgccccagtccactagaccctaagctcttttaggatgatatctcattccttttttgcactgtccatcgaaaacacacatacagtgagtcactactcgatgaatacttcttaattaaataactgtccttacccacttgctgcactgatcaatctccatcttgctccgaattcagtgtttccgccaatacagtgtttttcaacctaatttgactagagagcatctttgacatcaatatctaatttctcaaaaccacttgggactaaaaagataatttgtcaatttttgcttgatatgtaaaaatgatttacataaaatgttttattttgaattaacatatcataaaattctttaaaaacatattctacatttgtaatatgacttttttccattatttagaaataattaagaaagcagagttaaaatactgtactgtagttcttcaaaacattaaaatagaattactgtatgatccagcaactccacttctgggtgtatacccaaattaattgaaagcagggactcaaaaagatatttgtacacccatattcataacagcattattcacagtagccaccgagtgaaagcaacacaagtgtccatcagtagattcatggatagagaaaatgtggtatgcatttaatggcatattattcagtcttaaaaaggaaggaaattttgacacatgctacaacatggatgaatcttgaggatattatgtgaagagaaataagatagttacaaaaaaaatactatgtgatttcacttatatgagtttccaggattagttaaatttatagagccaaaaagtagaatggaggctgccaggggctggggaagagggaatagggaagtgggtagtagctgcagtcagatgatcctgaagctgaaatcatctgaagacctatcaactcacatgtctggtggtgcatgtgatagtatgttggacatgacgtgtctgcatagctggagtctatccagatatctctccatgctgcctctccatgtggccaggttgggcttcctcaaagtatgacaatgtgagggtggtcagacttcttacatggtgcctggcttcctctagaatttgcattccaaaagacttggggagaagtttcaaggcttcttatgacctagcctcacacaacccagaatatcacaattttgctatatcctattggtcaaagaagtcactaacgtcagcccagattcaaggagagaagaactagacttcaccccctaaagggagaaatagcaaaacaatttcagccatctgtaagctattataagtgagctcatccaattgtaaagtgcaattattactttcattcccattttctgtaataacagactgcatcagtcatattatgtattcactaacatactgtattaccggaaaattaactccttacatgtgacaagactttttgcctaggaaaaaaaaatctaactttttgtgttactatagaatttccatttttacccatttctagtttctgtttttttgagacggagtctcgctctgtcacccaggctggcatgcagtggctctccgctcactgcaacctccacctcccgggttcaagcaattctcctgcctcagcctcctgagtatctgggaagacaggcctgcaccaccacgcctggctaacttttgtattttttagtagagatcgggtttcaccatgttggttacgctggtctcgaactcccaacctcaggtggtccactcacctcggcctcccaaagtgcttggattataggcgtgagccaccacacccggcctacatacatttctagtttttaatataatttcctatttcttaacttgaagattgctttactttttttctcacacaaatgtttttattgagatataatttacttactgtagtaagcagaaaaatggcgctccaaagaaacctacatcccaatccctggaacctgtgaacatgttgtaccacatggcaaaactgaattaaggttacaggtgaatttaaggttgccaactagctgaccttgaaatagattattctgggttgtctggttgggcccaacataatcaaaagggtccacataagtgatagagaggcagaagaatggtcagattggtgtgagaaggactcaatctgctattgcttctttggaagatgaaggaaggggccatgagccaggaatgcaggcagcctctagaagctggaaaagtcaaggaaacatttccctagtaagctccagaaaggaatgcaacactgctgacactttgcttttagcaaagtgaggcctgtaacagacttctgacctccagaactggaatataataaagttgtcttgttttaaaccagccaggttgtgatattttgttacagcagcaataggaaacatatacatgccataaaaattcatgcttttgaagtatatgattcaatgtttttagtatagtcccaaagttgtataacttcaccactaattacagcatagtttaatcacaccccaaataagttccattatcagtcactccccagtgcctccacctcccagcccttgaccaccgctaatccactttatatcactatggatttgcctgtgcaagatatttcacataaaaggaatcatacatgtgtccttttgggtttggcttctttcccttaccataatgttttcaaggttcatcatgtatcatggatcagtacttcatttctttttattgtcaaataatattccatcgtatggctatatcacattttgtctattcatcagttaatggacatttggcttgtttccactttgggggcattctaaatcatgctgctacgaacgttggtatacaagtttttgtgtgaacatatgtttccaatacttttgcatatatacttaggagtggaattgttggatcttatggcaactctctgtttaaccttttgaggaactgcttagctatgctccacagtggctgcacaatttcatattttcaccaccagtgtatgagggttccaacttgtccacatgcttgccaacacttattttctattttaaaattattattatagccatcctagtggttttaaggtggtatttcattgtggttttgacttgcatttccctaacgattaatgatgttgggcatatcttaaagtgcttatcatccatttatattatttctttggggaatgtctattcaaattctttgttcattttaaaattgagctgtttgtctttgtattattcagttgtgagagtgctttgtgtactctggatactagtctgttatcagatatataatttgcaaatactttcttcttcttagtgggttgtcttttcacttttttgatagttactttgaagcatgtaagtttttaattttgatgaagttcaattttttttctttagttgtttgtgttttggtgtcctatttaagaaaccactgcccaatccgaggtcataaagatttattcctatttttttcctgagaactttatgcccttagctcttgcatttaggtcttagatccattttgagttaatttttgtatgtggtatgtgtggtatgggtgcaacttcatcctttttcatgtggcaatccagttgtcccagaaccatttgttgaaaaacccattctgtcccattgtattgttttggcacctttgtcaaaaatcagttgaccataaacatatgaatttatttctggactttcaatgtcattctgttgatcaatgtatctgtccttatgccagtaccacatagttttgattactgcaaatttgtggtaagttttgaaatcaagaagtgtaaattctccaacttcattcttttccaagattgttttggttattctgggtcccttgcatttccacatgaattttggaatcagcttgtcagtttttctaaaacaggcagcagtgattttgataggcattgtgctgaatctgtagatcagttgggggagtattgccaccttaatatcgtatgttttccaatccatggacatagaatgcctctctgttttttaaagtctttttaatttctgtcaacagtgttttgtagttttcagtatacaagccttcagacttattttgttaaatttattcctaagtatttcattatttttgaggctattgtaaatggaatgcctaatgttatttttggattactcattgatgctgtatagaaatacagttgatttttgtatattgatcttgtatcaattacaagggttcagcaacattgctgaaattgtttattatttattagttctaatagttcctttggtggtttcttttttttttctttttttttttttgagatggagtttcactcttgtctcccaggctggtatacaatggcgcaatctcggctcactgcaatctatgcctcccaggttcaagtgattctcctgcttcagcctcctgagtagctgagattacaggcatggaccaccacgctcagctaattttttgtatttttagtagagacggggtttcaccatgttggccaggctggtctcaaactcctgacctcaggtgatccacctgccttccggtggctcacacctctaatcccagcactttgggaggccgaggcgggtggtggcttctttagaatttttcttttcttatttttaggaacaggatcttgctctgttgcccaggctggaatgcagtaacacaatcacagctcactgcagccttgacttcccagcttcaaacagtcctcccatctcagtctcctgagtagggggtactacaggcatgtgccatgatgcctggctaattttttaatttttgtgtagcgacgacttttgctttgttgcccaggccggtagaatgttctttgtattattcatatcattggaaaataaagatagctttacttcttcctttccaatcagggtgctttttatttcattttcttgcccaatttccctggctagaacctgcggtacaatatcgaataggtgtggtgaaaatgaacatctttgtcttattcctgattttagggggaaaattttccattttttaccatttagtgtgatgttagctatgagagttttgttgttgttgtttttttgagtcaaggtctcactcggttgcccaggctggagtacagtggcccaatcatggctcattgcagccttgacctcctcaggctcaggtgatcctcccacctcaggttcccgagtagctgagcccaaatgtgcacacccccatggctggctaacttttgtgttgtagagatggggtttcaccacgttgcccaggctggtctcaaactcctgatttcaagcaatccacccgccttggcctcccaaagtgctgggatgaaaagtgtggcccatagctggccaggtgcgggtttttcatccccgcgcctggccagctatgggttttcataaatgctctatattaggttaaggaagttcccttcaatttctaggtttgtttttctcatgaaaggatattgaatttttggtgaatttttttgtgtgtctattgagatggtcatgtgggttttgctttttattctattgatatggtgtaattacatttattaattttcttttgttgaattgtctttcttaaaaaccatagtatatataattgttttgtagtctgtatctgatatttttagcatctgaaattgttgcatttgctgtttctttctcaaggattctagttttcttacatgttttgtgacttttgactataactgaagttacttgtagaaataatttgagatgaggatgatggtaccttcctccagagaagatatttatttgccacttacaaaacagcaggaagtctccctatccaggaccacctcaaatcatacgaaagcactgagatttcctgaacagcctaggtgattcaaaagtggcctgtaattttgcacaaaagcattataattcacccccacttcaaggaaggtttcctctgactcctgtgtgtggtatctgtcccccttaccctgttagttctctaaaaggaaagttggagtgttctgtaataggaaagtatactaaaaaatgatatagacccttaccttatatcatatacaaaattatcttgaaacggataactagcctaaaaatataacagctgaaacttaaacccctaggagaaaatctagaaaaagaatctttgtgatgttgggttagttagaggtttcttagatagggcacactaagtaagaaccgtaggaaaaaatagataaattgaactacatcaaaaatgaaaacattttgctcttcaaaagacactattaaggaagacacagaaaatatttgcaaaacatatatctgatgagggatttgtattcagaatatgtaaaactcttacaaaccataagacaatctatttaaaaaaaaaggtaaataaacacatgaaatttggtcaacattattagtcattagataaattgcattttaaagccaccatgaggtgctgggcacagtggctcacgcctgtaatcccagcactttgggaggctgaggcgattggatcacttgaggccaggagtttgagaccatcctggccaacatggtgaaaccccgtctctaccaaaaatacaaaagctagccggggccggccacggtggctcacgcttgtaattccagcactttagggggccaaggtgggcagatcacctgaggtcagggattcgagaccagcctggccaacatggcgaaaccccgtctctactaaaaatccaaaaattagctgggtgtggtggcgtgtgcctgtaatcccagctactcgggagggtgaggcagcagaatcgcttgaacgcgggaggcagaggttgcagtgagccgagattgtgccacaatactccagccttggcaacagagcgagactccgtctcaaaataaaataaaataaaataaaaaaataaagccacaatgagctcttactggagtgccctaatgattcttgaaccactcttggaaaaacagatctccagcagactttcagcttcttcaatctatggtctctgttcctggaggtgggctgaagctccctagacagaaaggccagaaactgttacagttctactagaagctgccctttcaggtacatttctggtttcagccactgttgacagggtccttgaagggtccagaaagagacttacgaggtccaggtgaatctggatagcaaaatttcctggcatgttttggaaagacacgtggttcatggcagttacttcactccaggctggaattcctgctctctgtggatagtgttctcttcttcctttatatttatacttatttctctttcatttgcaacccagtacagtacctttattaaaattcaacagtcatcatggctgtggagtgaaacagcaaaacagttattactctgagtttccctcctcagaaatcatttaggaatggcaaattgcaaaacttccttgggtcatagatgtctcctaaaggagggcaatacttaataacatagttttatacatggaaacataatgaaatttcctaagtaatttgcaaggctgctgtaacactatcatgcacatagtcacatttattttaaaataatgctttgttttatagagcacttagaggaactcagaataaggagactgaacttctaacattattaaaatgtggctccaattacagttaacaaaagatattttccctgctgaaggaactgccttatagtgacagtgaccacctttctatagtgctatagaaagagagacactctttcctctgagataatgaaggctggagaggaatacagattttatacatttccaaattgtttcccacacaagacagccaaggagcgtaagtagtagattctccttttcctgtatcagaaatcaacttactaatcctagcaacaaaatagctcacatttcataggcacttgatactactgtgacaagtgcctcatacacaccatcccactgaatcctctctgcagacaggaagtgcctgttaaccattgagctagggctgagctcctctccaggattcattccttttgtgcttcagagcatcctggaggctggaggcttgctcctcagtggcttcaggagcagaggcctctcctaggtcctaggagtctgccatgggggcttcttccagggcttctttgcccaggaccaagaaaatcttcatcgaattggacagtatgaagatccttggtcccctttcctagaactgtttacagggaaggctttgagtgaacgtgaagattgcaatcagctgatgactaaattagaggagcagaaaggaggcattaagtagagacgtttgtgataggataagactctgaaacagcaacttctgatgatgctgttctcagtaaatttccttctcacctcatagcctttctatcactcaagtcatgagcctgaagtgggtattgtttcaagggacagaaaagcttagagtttttccaaatagtttttttaaccacatagtgggaacaatagtctttaaaaccaatattttaaaaattccaatagaacatttatctttttaaatagtgggctttttgagaaatttcctcattcctttcctttcttttcttgagttataaaaattcatctttgaaaattcaaagctgacatctgaaggatctcaaatacaaagttcatagcataaacaatagttagtggggaaaatgcatgctagcatgagttaaagtgtgacaggctagtagaatgagaaaactagaaaacgggaaggcaggtgactaaagcttaggagctggtggctttctgagcaggcaccattagatgcctgcccaatagcagttctctctttttgaaaccagtcattgtaatccaactccttctctttttattacctacttacatttccagcctcatttgttgctaggatgaatggccaagagatccagttattagcaatgagaacaaaggaaaaaatgacctggaaagcatttgggaaagactttgctcctgataaaaggaaagccctttcccccttgccattttcttcctgacttcaatgcagttgtgtaagaaagtgatgcttgaagctgcacggtttggaaatcatgagataataaagcaaaaaatgaaatgcaagcacattgagaatggcaggtgtggtagacagactaatgttctccaaagatggccatgttctatccctgaaacctgtgactatgttatgttgcctggcatgggggaattaagattgcagatggaattaaggttgctaattaactaactttaaaaataagaaattatcttggataatcctggtgggtccagtgtaagcacagggtctttaaatggaagagggaggcagaagaagaggttggagtcagagaaacgaatgtgctacattgctggacgtgaaggtggaagaaggggccatgagccatggaatgtaggcgatctctagaagctggaaaagacaaggaaacagattctctcatgtagcctctagaaggctccaaggctgttggcacagccctgacaacacctttgttttagccaagttagaccattttacacttctaacttctagaactgtaaaacaataaattcatgctgttttaagtcaccacgtttgtggtaatttgtaacagcagcagtaggaaatgaatacagccactcaagggcaaaacacctcccagccccccatgcagcaaggtgtgaccatgtgtgtaagtaacttcccactcatatcctgaaaagaaagctccttgctctcagcttacattttatttctataaagtagaaaatggtcatgcaaatgattggcctatttctacctggtagatgtgaacaaccctgtaggggttggctgaagccacagatagaataacctggatccctgaataatagtaagttgcagagacacatacactccttgttcacccacctactgagactttcacaccaaggggaaataaactctctgtcttgtttaagtcactgttatttagcatgtacagaagtcttgtagctaatatcctgtatttctcttggaaacatagaattgagcagacaaaaaactcagcaaaaatttagaagatttgaacaattcaattaataaactggatttctatacagaatatagaatatatatttaatatatacagaatatacagaatactgcacccaacaactgctgaatacattttcttttcaaggacgcatggaatcttcaccaaaactgaccatatgctgggctctaaagtaagtctcaacaaatctcacagggttgaaaatcatacacaattttcacaggattaaaattatacagaatgtttgcttaccacaatgcaattaagctagaaattaattacaaaattacaaaaagacaactttaaaaatattcttatgtttggagattataaaatatatttctaaataatccatgtgtccaaaaataatttacaatgaatattataaaacattttaaattaaatggtgatatcttgaatcaccaagagtagattttaaatgttctcaccacagtgataagtatgtaaggtaatgagtatgttaattagcttgatttagccattctacaatgtatacatatttcaaaacatcacgtggtacatgatgaatatatccaatttatttgtcaatttaaagtaatttaaatataaattaaaaatactaaaatgaataacaattaactcccaattaaaataagtaaatggtagtaaaatactacacattaaaatgtaagatgtagctaaggcagtactgaaaagaaaacttgtaatctttagtgcataaaaggtgaaaattaacaaagaaagcattcatttcaaaaggttagaaaaggcacaataggctgggtgccgtggctcacgcctgtaatcccagcactttgggaggccgaggtgggcggatcacgaggtcaggagatcgagaccatcctggctaacatggtgaaaccccgtctctactaaaaatacaaaaaattagcggggcgtggtggtgggcgcctgtagtcctagctactcgggaggctgaggcaggagaatggcgtgaacccgggaggcggagcttgcagtgagccgagatggcgtcactgcactccagcctgggcgacagagccagactccgtctcaaaaaaaaaaaaaagaaaaagaacaataaaatatagcaaaatacagtagaagaaagaacatattagaaataaaataaaaacaataaaaaaagaaaacatacaataaaatgataaatacaataaaaatgtattacatttttattgtaatacaatacataatgtatatgtgtatgtaatacaatacataatgtaatgtgtatgtaatacaatacatacaataaaaatgataacaaagctatagttctttcaaagacatccaatcaataaaccactggtgagacccttcaagaaaaaaagagaagacacaattaataagagtgactgtaatttatgtctacaccagggcatgtttacactgagaaaggccactgaatgtaattatatacttttttgaaacctttattaattaacaaattaattttattataccagtgaacctataaaatacttttattcaaaaactattctcaaaaattcttttttaaaaaataaaaagagtatgtatagcaaagcagtcactgaatttttttgacaggtgcatttttttcaacatgatcatattatttttagcacctatataaaattgcctgcaatccttttttaaagctggaagaagctttgaaggagcttcaaagcttcctcagctatgatcaatttatagttggattgggttgggttctttcggaaacagattctgagatgaagttgaccgagcagtctgtttgaggaatgtctttgggatcaatgtgtgcgggaggaaaaggaaggaaaggtgagagagcaaagggccggatgggctgtgatacaacccaatggcagccttaatcaaccccacagggaactctgctattaaaatgacctgtcagagttgtcctgtttgtgccacaatgtccagatctttacccccccaccagttgttgaatatggaccactggaggaagaacaggaccttaggcaaggcagccctccagctgagagaggccctgaaagcattgtatctgtcaccagccctgtggccaaaagtcgtgatggaagctgctcagtgcacatgtgtcttatacgctactgggccacatcatggctgaagcctgaatgaattccaaagtgaaaattgaccaaaaccattatggcttatttaaattcaactattgatgatagttaaattttgtttctctagggaaaaatgctaaactaaataggatgccaggaaaatagatataaactgggactgtcccatacacatcaggtccatttcaggcaaatcgagatgtatgatagccctatgaataactggcattagaaatgagaatggagacatggttacagattggcagagattaaaagaataacaatttgaaatttagaaatattcatttgaaattccttgaaaatacaattttccaatttactgatagaagtagaaataggaaacattaaatgcccaatactgctaaggaaattgaatctataattttaaatcatccccccaccccacaaaaactacaagcctagatagtttcactaatgaaatcttcccgaacatttaaagaggaaatagtgccaacctcaaacattcttacagatgttagaaaaatagaaaatattctcattcttattttataaggccaggataaccctgaaatgccaaaagctaataaaaacattacaaaaaaaagaaaaaaatggcaaggtaatttcactaatgaatacagttacaaaaatctaaataaaatattagcaaaatccctcagcaatacatacaacatgatgaaatgggttcattccaggaatgcaaggtttacttaatactattggaaaattattaaatgcaatccactatattaacaaaacaaagaagaaaaatcatatgatttaatagatacagaaaaggcatttaataaaatcaaatctctatctatgttgaaaagaaaaaaccaacctcttagcaaactagaaatagaaggaaaaatccttaatacaataaagagtattcacaaaagacccacagcaaacattacctttaataatgagatgatcaagctttcttctagacatgggaaacaagacaaggatctgagaaacaagacaaggattccactgttactacctatactcaacattgtcttagagatcctggcagagacaaaggcaaggaaaaaatttaaaagctaaggattagaaaggaggacttttggctgggtgtggaggctcatgcctgtaatccctgcactttgggaggcaggtggatcacctgaggtcaggagttcgagactagcctggccaacatggtgaaacccagtctctactaaaaatacaaaaaattagccagatgtggtggcgggtgcctgtagtcccagctactcaagaggctgaggcatgagaattgcttgaacctaggaggcaaaggttgcagtgaactgagatcatgccactgcactccagcctgggcaactagagcaaaactctctctcaaaaaaaaaaaaaaaaggattttttaataagacatggtaatatttgtagataacctatagataaattaagagctttaacaagttcaatatacaacaagcaactgcatttttacatttcagcaacaggttgggaagtaaaaaaaatttcctttaaatagtcattagaaattaaacacctaaagcatgtaacaaaagataggcatgacttctttatttatttattttattatactttaagttctagggtacatgtgcacaatgtgcaggtttgttatgtatacatgtgccatgttgttgtgttgcaccaattaactcgtcatttacattacgtatatctcctaatgctatccctcccccatccctccaccccatgacaggccctggtgtgtgatgttccccttcctgtgtccatgtgttctcattgttcaattcccacctatgagtgacaacatgcggtgtttggttttttgtccttgcgatagtttgctcagaatgatggtttccagcttcatccatgtccctacaaaggacatgaactcatccttttttatggttgcatagtattccatggtccatatgtgccacattttcttaatccagtctatcattgatggacatttgggttggttccaagtctttgctattgtgaatagtgctgcaataaacatatgtgtgcatgtgtctttatagcagcatgatttataatcctttgggtatatacccagtaatgggatggctgggtcaaatggtatttctatttctagatccttgaggaattgccacactgtcttccacaatggttgaactagtttacaatcccaccaacagtgtaaaagtgttcctatttctccacatcctctccagcacctgttgtttcctgacttttgaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatccttcgcccacttgttgatggggttttttgtttttttcttgtaaatttgtttaagttctttgtagattctggatattagccctttgtcagatgagtagattgcaaaaattttctcccattctgtaggttgacatataggcatgacttctaagcaaaaagttttgaaatataattgagggaatctgaagcactcccaaataatgagaacaatcttgaaacagaacaaatttggaggtctcatacttcctaaattcaaaacttattccaaaaatacggtaatcagaacagtatggtactggtgtaaagacagacctacagaccaaaggaatagaatagagagctcagaaacaaactaccccacacatagtcaaatgctttttaacaaggatgctgagaccatccagtggggaaagtcttttcaacaaatagtgctgggaagattggatatccatatgcaaaagaataaagttggacccttacacatcatacaaaaattaacttaaaatgaattaaagacctaaatgcaatagctaaagctataaaactctcagaataaaacaggggaaaatattcaagacattggatttggcaatgatttattcaatatgaaaccaaaagcacaggcaacaaagccaaaatagataaactggactacatcaaactttaaaactcctgtgcatcaaaggatacaatcaacagagtgagaaggcaacctatagaacttgagaaaatatttgcaaatcatttcagacagggtttaatatccagaatacataaagaactgcaatgcaacaacaacaaacaaccaattaaaatatgggcaaaggtcttgagtagatatttctccaaggaagatatacaaatggtctaacaaacacctgaaaaaatgctaaacaccattaattagggaaatgaaaatcaaaaccacaagataccacctcacatgcattaggatggctactagcaaaaaaccaaagcaaacaactggaaaataacaagcgttggcaaaaatgtggagaaactggaactcttgtgcattattgatagaaaagtaaaatggtgcaactgctatggaaaacagtggttcctcaaaaaactaaaaataaaattaccatatgatccagcaattccacttctgggtatatacccaaaagaattgaaagcaggatcttgaagaaatatctggacacccatgttagtagcagcattattcacaatagccagcattattcacaatagccaaaaggaggaagcaacacacatgtctatcaatggatgagtagataaacaacctatggtatttagtataatggactattattcaaccttcaaaaggaagaaaattctgacacatggtacaccatgggtgatcctgaggacatgatgccaagggaaaaaaagccaatcacaaaaaatacaaacactgaattattcttcttatatgaggtacctagagtagtcaaattcatagagacagaaagtagaatggtgattgccagggactgggcggagggggaggtggcaatgggcagttgtttaatgggtataaggtttcacttttgcagaattacaggagtactggagattgtttgcacaatgtgaatgtagttgacactactaaactgtgcatttaaaaatagttaagattgtaaattttatgtcatgtatattttaacacaattaaaaaaatgaacagagcctataaaacaatatttatggataaaattattgagaaaccagtaaaaaaaatttactgaaacacattaaagaagacctaaataactggagtgaattccatattcatggactgattataccttaattgtaacctatcgtaacctaatattgtaaaaatggcaatttttcccaaattaacttgtagacttaatgtaatcccaataaaaattgaaacactttttatggaaattgaaaaatgaatactaacatttatatggaaatacagagttaagaagagcaaagacactcttgaaaggagaatgtaggtgataagacttgctctactggttatcaagattcattaaacgggccaggcgtggtgactcacgcttgcaatcctagtactttggaaggctgaggcaggaggattgcttgagcccaggagttttaaacaggcgtgggcaacaaagagagaccctgtctctaaaaaaagtttttaaaaattagccagacatggtggcatgcacctgtggtcccagctacgtgggaggttgaggccggaggactgcttaagcccaggaggttgagccatatttgtgccattgcactccagcttgggcaaaagagtgagaccctgttatctcaaaaaaaaaaaaaaaaaaaaaaaagaagattcattgattcattaaaaggttgtaataactaaaaaagtatggtgttaatgtaagacaaataaacataccaatggaagaaattaaaggtaccaggaaaagattcatacatacatgggtggcttgacatgtgacacaaagatctttgcagaagagtgggagaaagtttttttttcaataaatgatgctgaatcaattatctaaatggaaaatggaaaataaaattgacccctacttcataccatacacaaaatcattttcaagttaattataaacctaattgtaaaaagcaaaatattaaagatgatggaatataatataaaaacattttcaagatattgggatagggagagattttagaaatatgacactaaaactctaatctcaaagggaaagaaaaaatgataaattcagcttattaaaaattgggatttttatttatcaaaagacatgcaaatgtggaattccaggatgttagctgtgcaacaaatgaaaaagtagtctcaatttgagcagtagcactgagaataactccagtaatttttcagaaggagaattattggagaattcagacttgtttaacaatattgagaggaccatacagcttcagtagagattttaagcattaattttgataagtacctagaaaactaagcaaaaaaataaagcaaggttatgatttttcaggagcaaaaacacagaaggatgtttccagacaaggaaaaataattatacaatacaatctacctggttcatttgtgaaaaaatttgcaaaatcatactatgatgaagacatatcattacattgtattgcaactgtatgttagaggaagaggatgaactaaattcccgttttctgaggtagtattatagtattctttgccttcttctccacaagagggcgcaaggtgaatgaacctttccttttgtggcctggtcttcatactctgccgttggcatttcaatctaatccacaagtattttcaaagcaatggctcttttcaacttgaaaagtggaaaagtggtctgtaatggtctgtaaccacctttcagaccctaagcctgggtctaggagagcatttccgattgagcttgtctgctatgcaatgcactggcgtaatggaaatcatgccagaccaggggtcatctagcatggactgtcctgctgaggctgtcccctcctggccagggcatctgaggcaagtgagttggcctcttggagtctcagtttcctcatctgtaacataaaggcaattagagtaatcacctcataggattgtcctgggaaataaatgaggtagagttccctaagtgtctaagaaatattttatatgtaaatttttacatataaaattacatatattttatatgtaaaaaaagtaactattattatttttactattaattccttatctgtgaaactctagagggattgccaaggggggactgagtgacctccaagagtctcctccaagatcttttttctgagtttgtcaatgacttaccatgcatgctggtcattttctataatctatctgtaaagcttcagaaaagaagaggagacctctgaagaggagggacacgctgttcccaggaatctgctccagcagattttctgtcctgctgggccctgtacccgccctccatgcctgctgtgtgctgtggggctggaagtatgtggccaacacatcccacagttttggtcctggtctcagcttggtcctgccagcagtggagaacagaggcggctttggtttagtgctgtccatgctggccacagcagcagcctctggctcccggggcaacgggtagctggtgtaggcttggggccagccgggtcggtaatgacttcttcatctctagttaaccctcctctattttccccctctggcacccctccagccacacccaccagccattgcaataccttggtaaatagttctttgccctgaatccttctctgcttgaaagaacaagtggtttctgttctcagactgcaccttgattgatgggtgcaggggcttcaccatctggaaagctctccccaggcaagtggggtgcacagcccagccaaaccacagtcatcatcaccacctcttctcacatgcaggtttctagacattaatatgagccagggggcaccatacgggtgttatttgtatacacctggtgtatacaaatatattcatttctattgtggtgtaaaatcccatacagcctgcaatggggcagcctttctgggcctgaggagtgggtcgaacctttgctaatgttaaattatcaggttgtgtattcccctttaggatgagtgtttccttgctttctgctgccttcctgctttagaagcacagcagccatgaagcactaaacttcatcgcgcacacaaccaggcactgcaggattttgaaagggtgctgaaggatagatacgggctgattcccaagtcatgctcgagactcccttatgaaggaggctgccaaagactggttttgtgaccctagctggcctcctatctttgacctagaaagaggtttcaaaggctgagaaaaggctagtggtgagaaggtttttgagagggttgctgggaggggcctgcatgataccttgaggggcaaagggaacgtgggagtgtttcccaaggacctgatttgggcggctccactgagaaagctggctggggtcatttgatatcccacccaagagagctgcctgaagagcaaaactccgcagcacagtaagtctgaggctccttcatcatataaaggctcaggaaggtgtcttgagtgaccagctggaaagagagccccagagactaaggagtctctgaaaaaaacctacgaagttccttacagggaggaaagaacttgcttcagagagggctgattccagatcatcacaaagttccaagttatgtgagaatcctgctgccccaccctccttagctccaccctgggtgtggccaaaacccacagcaaagggtggagctgaagaaacaaaagagcttggagaagaaaagagagaaatgtatcaggacgcgtctccctgcaggtggctggtctgcagtgggtgcctgccatgcagaggagggaaaagggaagaactaaccccactgtaggggaaatgaatgatgctttctcatcactttccatgaagcccctttgctccacataaaggccaggctggcaacgcatgctgaggtttagagttcatggggtggctaggaggggtggcaatggctttgggctttattgtggttcaagatcctgagcccaagagggttccagcaccacccctaggagtgagggactttgcttctacctttctccaggaacagtgggtctctgcagagcttgaggtgggtgggagagaggatttgagaaaggggagggtggaagtagaccatttaggggaggagtgtgaacttgtccaaggattgtggtgagcctgcagggtagggctgctgctcatctgacatttcggaagggtcttcctggctgtgacgttgctgtccctcagcacctgctcctcaggtctgatggggttgatggttctggttaaccagtgctgacgtttcgccccagtgaagacaaagtatgcaaagtaggtaaggtcattggaaagcaagtggggctagcccaatgaggaagaaagtgagacgttggccctacagaccacgcccagtgaatggaggagttggagccaggattctatagtgagcaagaaccatgggggcttatgatgaccgagcttcaggctcccaagcaagctgttgaaggtggtgcatttacttgtgaagttaggctgtgggtgtcagtagctgaggtgttgaggagggagaggatggttgtcaacatgatagaggactgggaaccagagtgtgtggtgcatctacggtgctgaagtgacagaaggtggagaggagcaggttggtcaggtgcgagtcaccatgcaatgaggaggaggagatggaagggggtagagtcaccaagtggagggtcatgcgcggtgaggttttcagaaagctcgactgggagggaggagaaatggatcagaaagggatttggatggttggaatgaccggaattatctgattactaagcgcgtgcgctctctctctctctctctctctctcacacacacacacacacacacacacacacacacacacacacacacagcctgagctgaccagggcctggaccattactcagcccagacagactgaccctcctaatgctccaggtcacaaatgccctccaagggctcttgggctgggaagtgctgcagaagtagacagggagggcctgaagtattctccctcagccgtccctcctttatttaaagtacagaattatttgcttggtgcaggggctaggaaggtgccataccaggaatctctagtggcattttgtggctcatgggtggcttaggctggggtgagcctcggcaatggcacccctctgcagtaatcctcaccctcctgcaggaacttcagacaaacttcagttcacaaatactcatcgagtgctcatggtcggggaggtgctttgctggatgccttgagggatcagccctgcctccgagaagtttccagacctacagaagacagaaggcttgtctaagagtcacctgagtcacacagtgtgaagtgtgaatattcacacataagggatgcacaggggttggtggaagacttcctgggaaaggcagcttcaagctgagctgggaaggagggtaaagtcttgacagaaagggagaagatttccaggctgagactggcaattggacaaaattgtagttaataggttctggtgattaaacccgccataggaggatagtgtcttctgctgcttgtctgtattacacacatgtgtgtaagcaaattggaaccaacacatctgcatggttcttttcccacagtggaggagagtttcaatatgttaatgtcatattcctcttagcaatgttgagacagtgaaatcttattcagcattctggtttgacatattgctctgtgcttgcatggaatatcagatgtgatcataatttgtagacaagaatcttgcctattttacattttctgtattctgtgcagtaggcatgtccttagtgaccccattctcttctagctgacttcattctcttccctcctgttttgttgaaggtcctgggggctctgtcctcactcctttttcttctttcaggagaacctttgactcccatggctttgatgactcctctcctgttggaggattgggagtgaagaaggagaagactctgtaaatcaggggagtgtgtcaggccttgagttagacactaaaggtttgttgaggacggagagagtgaaagagtggcagagaagcaaaaaacaaaggtggggtctgctgcagcagatgcagctggtgcaagcaggaggaggcctgaaggtgattgcaggggccaaggagagatgctgtgaaaggctggggataggaagtaaaagccagattgcagctgggccaggtgtgagaacaaggaggaagcaagtttttttttttcaagaaatctggacaagaaagggcaggaagagatggggcaataactgcagagggagtgttcttatgatgaatgaggcttgagcatgacaggaagcctgctttttctttaaatgctccttggttgtagtgtgttaaagccaaggtaataatctagtcagactgcatggagggacttgctcaggtttctccctctgacacgatggtagcaggcacctaagcacatgcataccacagtgctagtggttctttgacaaacctctgccccaagagagtctaggctgggcagcagagagtgcctgtattatttagaagcactacaggctgatgacagagagagaggagagagagagagagagagagagagagagagagagagagagaagaaaataactcaacttagaaatatctttatgtaaatgaagattgtttttagaaatctaccaacacctaaaagttaattatgctggatttaaaaacaaatatcaaaaactccctgagctctaacaggcttgcatagagcccaagggttctatggacaactggagtggggggcagtggatgtgatgatctcagtttaggagagagtccagctacagagtgcatctgatctgatgactagggacatcttcagcagttcataaacacgtgctgttctcaccagctgctggggaaaagaggctctggaagctgccatttgttggttacaggcaaaggaggttaacttgaaagaaatgggcatattttatataatacaagctaccagggaggatttcagaatggtctttgtcttggttaaaacgtgatcaaacaccaccataccttaaaaaacagctacaatgaaaattgaattaattaattaaaattaaattagaacagaaaatttaactacttaaactaaagcacataaattatgtttttaaaggtcagatttctgctcctattcaaggtaaactaactgatacgtatttaacctcccacctgaaacaacaacaaaaaagggaaaaacacacaaaatatatgaaataattgtttgaagacactggacatcaggcaacaaaagacagtgatccttgagaaaaggaaaacaaatgattgccccagcttattggtttgagatttttaggcaacagtacagggaaggagacccaagcaaagcaagaccgaactacatgttgcctataagaaacccattttaaatataaagatagaaacaaagaatgcaaattggtaattgccaagggctataaggaggaggaaatgaatagtgactgcttaatggattttcttttagggggatgaaaatattttggaactaaatagagctagtggttgtacaacattgtaaatgtattaaatgtcactgaattgtgcactttaaaataattacttttaagttatgtggatttcacttaaaaaaaaaaaaaagaaagaaaactaggccaggtacagtgattcacacctgtaatcccagcattttgtgaggccgaggcagatggatcacttgaggtcaggagttcaagaccagcctggccaacatggtgaaacccagtctctatgaaaaaaaaaatacaaaaattaactggccatggtggtgggtacctgtaatcccagctactcaggaggctgaggcagaaggattgaacctgggaggctgcagtgagccaagatcgtgccactgcagcctgggtgagagaatgaggctccatctcaaaaaaacaaaacaagacaaaacattaaaacccaacaaattaaaaaaaagaaagaaagaaaactaacgagacatgcaagcgtacaaaaccatataaataaccagctacctacaggagagctagaaaataaagttaaaagactcagtctttaaaataattatgcttgttgtgttcattgagagatgaaagattgaggattttgacagagacatataaagtatataaaaaagaaaattctagaactgtaaatacaactatcaaaattagtaactcagtggatggagttaggtggagaatagatagctgaagagagaattcatgaactttcaatggatcagaagacaatatccagagtacaatattgggagatgaaagatagaaaaagcagaagctggggtaagagacaaagaagttagacaaagaagtcccagaaggagaagagtagggaagtgcaatagaagcagtatttgaagagttaataattgagaatttaaaaaagttgattaaaggtattaagccataaattaagctgacttcaaagcagaaacagtggaatctggacacaatggaatgatgccttaaatgctaaaaaaaaaaaaaaaacaacaaaaaaaaaactattagccaatgaatactttaggcaacaagtgctccacagttcataagtgggaacattcacttaggacaggagagatgtgaaagggtcacgggagatgggtaaggtttgagaaggtcactaaagaggcattagcaagtgatgttttacagccaagtggtcaggaaatctcagggtctgaacactgattcagtctgtttgggtaaaactgagctcctattactaggggtagaatggaaattgaggctagaaagggtcagtaagagcaagatggtgaatgatctcattttacaggtgataggaagtattggaggtgtatctgtggcatctctaccttgtttcttgggaggacaccactagtaaaacctttctgacattttcctggtgtaggtataaatcacactgtctcttgccactttactatgagtgaaatgaaatttagataagtgccaggttcagcctgctctgtactttcactcccttgtgagaacatattattgaattgccatttttaaagaatccagttgcaatgaatcttatttcctctttcatttgttcctctggagccagagtgagacagtagattaggaagggaagagaaaatatagaagttccctttcaaagttgctttcacatggctgacctttcgatttattttctctctaagtaccacacttattttagtcataacctttccctttttgtctccgtaagggcagacgctccttataaacccacatggtcttcatcagcccacatgaattccgtcttgcttaactgtgtttttctcatctctgagtgtcactcctatttggctccctcctccagagtcctactctgacacctctggtgcacatccttgcataattcataaatcttaaaaaaaaatctgtggtgctctttatcatgtgttttaaatcacattaatggcagtgtgcttttagaatcctgtaatttgacctactgaaccgaaagtctaactttccaatcttttatcttttatttgcatttcttggggtttttggttttggtattattcacttcctttaagatttctcaactttaacttttgctgatttaaaatttatgccataaatttgatatagtactccacttctaattgttgtatgcaatgcgcagctttccagacagggtatacataaaggggtttcagtgcacagatgtatgtacacatttaattgcactagtgtcaggttgctgtccagaatggctgcatcagtgttcacttccaccatcgaagcatgaagttttttatttattttgtttgtttgtttgcttttgagatacagtctccctctgtcacccaggctggactgcagtggcataatcacagctcactgtagccttgactgcctaggcgcaagtgattttccatttgcctgctcctgtgccaatatccactgttttaatattgtgtctacagtatgtcttcacaattaattagtaagacaatttgtccttctttgtttttattatcaaattgacttatcaggctgggcacagtggctcatgcctgtaatcccaacactttgggaggccgtggtgggagggttcgcttaagcccaggagtttgagaccagcctgggcaacatagtgagacctcatttctacaaaagacaaaagtaaaaatttagcctggcatggtggcgtgtgcctgtggttccagctactcaggaggctgaggtgggagtatcacttcagcctgggagttcgaggctgcagtgagccatgatcatgccactgcatgccagcctggaggatagagtgagaccatgtctcaaaaaaaaattgactaatctatttgagaatctttagtattctactacattttagaataagtttgccaaatctttaaaaaaaatcttgttgcaactttagtaaggattacatttaatttacagattagtttggaagaaacaactttgtaaagtgttctcattacatccttgtacatttatgtaaatattcttttatttcataattaaaagctttatagaaataaaattgtcatacaaaccgtgcatatgtttaaaacacacaaattggtaagttttgacatacggattaacccatgaaaccatcacaaatatcaagatagtgaacaaatccataatcccctcagacttccttgtgtccttttgtaattcctttctcccatctctctccacatccctgtctttgtgtaacctgtgatgccctctcatcactatagattagtttgcattttctaaagtttttagttaatggaatcatacaggaggtacttttttgtctggcttctttcatttggcatgataattttgagattcatccatcttgtagcacgaatcaacaattccttcctgtttattgctgagtagtattccactgtatggatataccacaatttatttacccattcactggtcagtggacagttgagttgttttcagttgttggctattacaaataaagcttctatgaacatttgcataaaattgtttgcaggaacatatgctttcttttcttttgggtaagtacatgggaaagaaatgattgggttagagggtaggtatatgtttaacttcttaagaagttgccagactgtttttcaaagtgttggtataattttacattcccacaagcagtgtaagagttctagttccttcaaatccttaccagcaggttgtatgattagtctttttaattttagccattctagcaggagtgcagaggtatcttattgtggttttaattttcattttcctaattacaaagatgttgggcatattttgcttatttgccattcatgtatcctcttcagtgaaatgagtgtttaagccttttgcctacttttaaaattggtttgtctgtttttcttttattgtgctttgagaagtctacatatattccagatagaagttctttattatatatgtaatttacaaatattttctcctagtctctggcttgtatgttcattctcataacagtctcttgaagaacaactgttttatggatgaggtctactttatcaaattgttcttttatgaaacgcgtctgtatgtaaaggaattgtgtatataagaagtgtggtgtgtaagtgttgtatataagtctttgcttaactcaagtttatgatgaacatttcatgttttcttctagaggttttgtggttttaggttttaaattaaggcctatttactacttttctactgcagcataacaaattaccagaaatgtagcagcttaaaacaatgcaaatttattatcttactgtttctataggttagaaatccagcatggcatgactgtattctttgggctaaaatcaagttattggctaaagctgcagttctgtgtctttgggtcctcttccaagcaaactaaggtctttggccaatttcagttacttgtgtaattacttcagtaagtaattacattcatttggcttgataattttgaaattcatccatcttgtagcatgaatcaacagttccttattacttcaagaagtaattacacaagtaattgaagttggccaaagtaattacttattgaagtaattcaattacttatggtcatacgactgagatctctgttccttgctggctattagccaagggcctttctctcagcaatttaaggctgtccgtatttcttctcacatggccaagctccatcttcaaacaagcaatggtacactgactcttcatgctttgactccctctaacttccatttctgtctttttcttctgcttttaaggacacatgtggattacattggaaccacgtggaaatccagggtagcctccctattctaagtcagctgattagtaaccttaattacctctgcaaagtcatttttgctatgtaacatattcagtcttggggatcagggtatagaaactttttggtggacgtaattcttcttaccacagtcaatgaccctgatatggtttagctgtgtgtcctcacccaaatctcatctcgaattttaatccccatgtgttgagagagggaagtgactggattatgaaggccatttcccccatgctgttctcgtaatagtgagtgaattctcatgacatctgattgttttataaatggctataaatggtagtttttcctgcactctcacacattctctctctcgcctgcaaccgtgtaagacatgcctgcttccctttccaccatgattttaagtttcctgaggccccagccatatggaactgtgagtcagttaaacctcttttctttataaattacccagtccagggcagttctttatagcagtgtaagaatggactaatatagatccattttgtgttaatatttatatatagtgtgaagtatgaatagttcatttgttttcatgtggatatgcaattgttccagcatcatttgttaaaaaggctatctgcaatgatctggatgtgtcctcccaaaattcagatgttgaaatttaatcacaaatctgacagtattgagaggtgggacttttaggaagtgattaagtcatgaggcagagatgccatgaatgggattactgcccttataaaagaggttgaagggaacagccttgacctgccatgtgaggatgcagtaacaaggtgccaccttggaaaaagagatcattccctcaccagacactaaatctgatagtgcattgattttggacttcccagcctccagaactgtgagcaatacatttctattatgtataaattactcagtctaaggtatttttgttatagctgcctgaatgaactaagatactttttctctactggatttccctgtacctttgtcaaaaatcctttgtcaatgtatgtttgggtctatatctggactctgtattctgttccatttatctgattgtttattgctatgccaatacaacactgttttgactatcacagcattacagtgtcttgaagtctggtagagttaaccgcaatttttctcttatttttcaaagttgtttgaatatttcaggtttttgcatttctatgtgaattttagaatcaaaatatcaatttctatatgaataatactggattttgagattgaattgaatatatagattaatttagggagaattgacatcacaactatatgttgtgttttcttaccaccgaacaaaatataatctccttttatttagattttcttttatttatctcagcattgttttatatttttcagtgtagagctctttcacatcttttgtcagatgtatcccaagcttttcattttttggaaacattgtattttaatatcaatatatgattgttcattcctagtatataaaaaaggaatttatttttgtttccgtttcttacttttctttcttattgcactggccataatctcctgtgcaatgttaaatgttgtccttgtcctgttcctaatattaggggaaagccttcagtctttcaccattaagtataatgttaactctaagtctttcatagatggcctttatcaggttgaagaatttccctcatattcctagtttgctaagatttggattttttttcacaaaaaaacaaacaaaaaagcccacaagaatcagctgggcacagtagctcacacctgcaatctcagcactgggaggctcaggtgggcagatagcttgagttcagaagtttgagaccagcctgagcaacatgacaaaaccctgtttttaccaaaaatacaaaaattagccaggcaaggtggtatgtgcctgtggtcccagctacctagaagactgaggtgggagacccacctgagcctgggaggtggagattgtgccaagacccaagatcacaccactgcactcaagcctgggcaacaaagtgtaaacccatctcaaaaaaaaaaaaacccacaaaaattgatgttggattttgtctaatgctttttctgtgctattgagatgattatatggtttttgttctttctgctgatatgatgtgtcacatttattgatttgaaccatctttgtatccctgggataaatcccccttgatcatggtgaataatctttttaatgtgctgctggattcagtttgctagtatttcatccgagatttttgcatactggtccatcagagacattggtgtatagttttctttttttgttgtatttttggttttggtatcagcggaatgttgacctcatagaatgagtttggaagtagttcctcctctttacttttaattttccttttaaccaggaagaatgagcttgaatcttctttactttttgggaatagcttgagacatattgttattggctctttaaatgtttgggcgaataactcagtgaagccattggggcctcggcttttctttgatgggaggctttttattacagatttaagctcataactcataaggggtctgttcaggttttctgtttcttattatttctatcttgataggttgtatatgtccaggaatttatctatttccattcagttttctgatttgttggcatatagttgtttgtaatgtaatagacaaataattctttgtatttctgtgatattagttgcaatacctcgttttcatttctgttttatttatttagatcttcttttttcttggtcagtctacataatggtttgctgattttgttcatctttttaaaaagccaacttcttgtttcattgatattttatatctttttatgtctcaattttatttatttatgctctgttctttattatttcttaccttccacaaattttgagtttggtttgcttttgcttttctagttccttgagatgcattgtgatatagtttcaatgtgtgttcctgcctaaatctcatgttgaattgtaatccccagtattggaggaggagcctggtgggaggtgattggatcatgagagtggacttcatccttgctgttctcatgatagtgagtgagttctcatgagatctgggggtccttatattctcattttccacacaatgggggggatttagccaaggaaatctcttagtgtcaggtctgatacagcctacaagcagctgcaatgacactgggttccaggtgcaggtgcttgcagtagttgtgagtctggagtcctaggcttagtgtcttgtgaacctattttggcacctgggtgttggggtactggtttgctctctgtggtggggttggttgtagcttgctcacagagatagaatctgtcaccttgaggtaacttctagcagctcaggcccagagggctgggttgtagctatgattatatccctgggggtcagagcacagcattggcccaactccagggagtaagggatgctctggaggtttgggcctggggagaagggtatggctgcaattcaggaacctgagccaatagggctcagtaacaacttgagtgccgtgagtgccacgagataaggcaccatgtagtagtaactatagaccttgggatggtggggcttggcagtgtcccagactgtgagggcaggtgcattgacagcaagtaccccagaatggtgaagcacagctgtcgttttgccctggggagggcagagcacagcacagtgatcatttgactctccagggctcagaatctagagggctagtccagcttcagggaagcaggatactagatttgtttggcctgtagggtagggcgtctcacctcagccactgctctatttccctgggatgcaggggtacaaagttagctcagccttgggatacacagttgctcagcatggccaggccaccaattcaccaggtggcaatgtgccacttcagttcaggactggggtgaggtggtttagtggtggcttttagggatgaaagggagctatggctactcacacccagagtaagacacttcagctgtagttccaattccaagatggcatagtgtagtcgccacatgagctacagtgggcagggcacaatgtcagctccttctctcggagaagcacaggtatttggactgtgctccctcacctgagctcagtgcctgtgaggactgcaggggacctggtaatgaggtctacagatgtccaaggtattgatgggggttgctgggatcttctttcttacctccttgccttaaggagaagttcttgctggttcccagctgatcccagttgagtgggagggttgtagaggcccagtgtttccttctgtggcgatcccaagtttctgtgctcactggggtttctgttactcctctgatgcaccctggtgctctttctcagttaatctcattaaaatgtagttgtttattcattgttctggctgtctttgtgagaggaatgagtactaggggcttctagttggccatcgtgcttcagtgtgggaacttgagcagtctattctacatatgtcatgctgcttgaagctgttccacagtttaatgaagctcgctattttttttccttttcttctgtcaagtctaatctgccattaattcttccagggcatatttttattgcaaacagtgtagcttttcatttctagaaatttggtttaggtcttttttaaaaaatctcacatgtttttatataactttttgaaaaatacagaatacagatttaatgattgccttaatgtcttcgtctgcttactctaacacctgggtcagttctaggtcagttttgtttgatccattattctcattgtgaattatactctcctacttcttttcattgcctgatgaccatgttttgatgccagatattgtgaattttacattgttgggtgctggatacttttttttttttttttttgagatggagtcttgctccatcacccaggctggagtgcagtggcacgatcttggctcactgcaacctcctcctcctgagttcaagcaattctctgcctcagcctcccgagtagctgggattacaggcacctgccaccatacctggctaatttttgtatttttagtagagatggggtttcaccatcttggccaggctggtcttgaactcctgatctcgtgatccacctgcctcggcctcccaaagtgctgcgattacaggcatgagccactgtgcccggccgatagttttttattctgtgaatatttttgtggtctgttctgggatgcagttaagtttcttagaaatagtctcatcctttcaggtcttacttttatgattctaatggcgccagagtagtgctctgtgtactgctaattatttcccactactaaagcaagaccttcttgggtatcctatccaatagtctgtgaattaagtttttccagtctggctggtgagaataagcactattcccagctcagtgttaatgccaggcactgttctctaatcctttcagctagcttcctcccaccccccacacccagtcttgggcaggttcctctcactcctgcgctggtcactcctccactgaatatgcagggtgaccatctacaaatatctgtgtttctctctttgtcttaagaacttcagccacttttatctacctgggactctcagttctgactgtgactcacggagactgctaggctgtgcctgggtttcctcttccaatgctgtagcctgggaactctctcaaggcagtaagttggtacaaccatagggctcacctcatctgtttcctgtctttcaggattaatctttttgttgcctgatgtccaatatcttaaaacccattgtttcatatatttggtcttgatttgtttgtttgcttgtttgtttgaggcgggagtgtaaatgtggttcctgttaccccatcccgggtagaagcaaatgtttcttcctttattttcttaattcgagattttgtctccataaatatcttatatattcttgaattatttccttgatagttcttttctctctgttttctctctctctctctcattctactttattggagactttctcaactttatctttgaaatattctgttgaatttttagtttctactattatattcctaatttccaggagatctctcttgttttttgaatgcttctttttttatagcctcctcttcttatttaatggatgaactatcacatctatctagaatattaattcaattttaacacattttcttctactcattgcatttcttagtttccaaattccctttttctacttgtttatttgatttatatattttatattatatattttatgttaaaggctttcttccattataaggtgatctctggtttctcattcacatatatatatgaatgagaaaaatatatatatatatatatatatatttttggaaacagagtttcactcttgttgcccaggctggagtgcaatggcgtgaacttggctctttgcaacctccttctcctcccaggttcaagtgattctcctgactcagcttctggaatagctggggttacaggcatgcaccaccacacctggctaattttttgtatttttagtagagatgagatttcaccattgttagtcaggctggttttgaactcctcacctcaggtgatccacctacctcagcctcccaaagtgctgggattacaggcataagcgactgctcctggccctcttattcatatttaagagtagtcacttacaagcaaattggaagctcttgcttacttacacaacagtaaatttaatatttataaacagtaaatgttaccaaattatacactcatccttatatcccttattccaaggtgccttcctatatttactacttcccttcttgctagaattcttcctctaagagtgttatcaaaaagggttttgtttgtttgtttgtgtggttttttttttgtatagtaaaactctatgagactcagtatatctggggatatctttattttatcctcaccctaaatggtaatatacctgaatataaagttctagttcatattgcgtattctcacctataagtgaaagctaaacattgagtacatatatggtcacaaagaaggaaacaacatatgctgaggcctacttgagggtggagggagggaggaggatgagcatcaaaaaactacctatcggctgggtgtggtggctcacgcctgtaatcccagcactttgggaggccaaggcaggtggatcacctgaggtcaggagtttgagaccagcctgatcaacatggagaaaccctgtctctactaaaaatacaaaaattaggcaggagaatcagtggaaccctggaagcggaggttgtagtgagctgagattgcgtcattgtattccagcctgggcaacaagactgaaactccatctcaaaaaacaaacaaacaaacaacctatcaagtactatgcttattacctggatggcaaaatatcctgtataccaaccccctgtgacacacaatttacttatataacaaacaagcgcatgtaccccggaacctaaaataaaagttaaaaataaaaataaataaaaaattttagctcaattctttttctgaaacactttcaaaatcattactccatgatcctcttacactaacagttgctgttgacaagtcagatgtctgtcttgttcagaggtgtctgcaggttctctggagtggtatctttttctctttttcaaatatccctaatgaagccatgataccagatctctttttagagaagagtttgataatgccatgtaattaaaccctgcctaaagccagggttgtaattcccaccacaaggtttgtgaggccagtcactgagcaccctgcatactagattctgcagctgaaggaaacatccaaccacagaatcatcaaaatttttcatcagttttctcttggagagcttattatgaggtattaaattttaagagtcaaagacaatgggagattggcatgcatccctgcccacaaagggttccaggtcacctgggttccatctagttggaacggagatgcctgcctttgtgtcgtcccaccccagggcttccactcaagcctgttcacaggaatgtttggcttggtaaaggaggagcccaggcgcatctgggtctcagaagtgacataatgtgcttgcaatgtctatgaaacacagtgatgctgcaggagatgggtctttgggaaagaagtgatggaagaacacgatgctggacagtgtacaagtgtgagtgtgtcaacacaagcttgctgttcagatgaaaacatatgggttaatccaaagtttctctctttccctgaagtaaacgaggatttttactcactctcaccaatctcagaaaagtacagtgagacctacaggacttccattttccatgaggtctctcaggaaattcatcattccctgacatgccccatacacctaggtgctcatgtgtccacctagacaaagtctgctcagaagatggagcagacatatgactttagttcagctttccccatctatggggatgtatgtagaggaccctttgggaggcagaatagtggccacctcaaagatgcctattcccgagtccctggaacctgtggatatgtcatgttacatggcaaaagggactttgcagttgtgattaatgtaaggagcttgagacactgaagttattctggataatctgggtgggccaatttaattacataattcttttaaagcagaaatccttttctagttaggtcagagagatgagatgaaagaaaaaggagacagaggatgacagcttcaagccacaaaatttgacagcctatagaaactggcaacagccctcagtttacaaccagcaagaaaagggggacctcaggcctaccacccaagggactgaattctgccaacaatgcaaatgagcagtaaatgaattctctcctagaacctccaaaaaggaatgcagcctgctgacaccttgattttagctcagtaagacccatacaggacttctgacttccagaactataagataatatatttgtgtggttttaagccatggggtttatagtaacttattatagcagcaatataaactaccatggagccttatataaatgtaaaaaaaaaaaagtcaacaaatgagatgactataaattgaggtgctcctgatatatacaatcctgggcactatcatgcgcccagatacagatcacaagaagcaggaacatataccgtctctcacccagtcacagacaccacagattataagatgcatccctactttatagatattaaaatatgaattttaaaattgatgaacttctagctaggcatggtggttcacacttgaaatcccagcattttgggaggctgaggcaggaggatcacttgagaccagtttaagaccagcctgagcaacatagcaagaccccatctctataaaataataataataattttaaaaaaattatccaggcatggcggcatgcacctgtagtcctagctactcgggatgctgaagtgagaggatcgcttgagcccaggagtttgaggttgcattgagctatgattgtgccatcgtactccagcatgggtgacagagtgaagccccatgcctaaaagtttttttcaaaagatgaatttctgtttaagcttcgggaccaagtcaagccctaaagaagggaggtgggagggcactaagaagactgattggtgctaggccctgaggatgtcctgctcacctgcctccagcatgaccttgctcctgttctccctcctccaactgtcagaacccccagcatggtttcagccagcagaggaagacagtagcactgcacctattatgtgctttaggtttaatatctttctcccaacatctcaggaagatggtaaaaatcaagagccagggtcatggccagcctctctagcacagatgaggttaataataaaagagtctcatgaactaagctgtatgtaaaaacaattgaaaaacccctttgcttacataaaataaaatagctgtctataaaggtggtatattagtccgttttcacactgctataaagacatacccgagactgggtaatttataaaggaaagaggtttaattgaatcacagttccacatggctggggaggccacaggaaacttataatcatggcagaaggggaagcaggcaccttcttcacaaggtggcagaagagagaagagcagggggaactgccatttataaaaccatcagatctcatgagaactcactgtcacgagaacagcatgggggaaaccatccccatgatccactcacctcccaccagattcctcccttgacaccctgggggttacaattcaagatgagatttggatagggacacagagccaaaccatgtcaggtggacattttagattttgttccatctacatttttttcaactttgttttatggaaatattcaaacacacacaagaagtagagagaataacataacaatctctcatgtgcccatcatctagcttcaacaattatcaacgatagtctggtttcatttctccccacaagttggttttacgatgggtatattttaaagcaaattccagacaccatgtcatttcacctataaacacttgagtgtgggtttctatcagataaggatagtattttaaaaatatttttcctatgacattatcaaacctaacaaaattagtgatttgaggtggaccattaggcatggtggtatcaaaggagagaggctagcagtgaagtgttcaatcttgtattcatattctattgctgctgtaacaaattacagcaaatttagtggtttaaaataatacacatttattttcttacagttctggaggttagaagtccaaatcagtctttttttttttttcttttttttgagatggagtctcgctctgtcacccaggctggagtgcagcggtgccatctcagctcactgcaacctccaccccccaggttcaagcaattctcctgcctcagcctcccaagtagctgggactacaggtgtgtgccacacatcagttaatttttgtatttttaatagagacggggttttactatgttggctaggatgtctcaaactcctgacctcaggtgatccacctgcctcggcctcccagagtgctgggattagaggcgtgagccaccacgcctggcccaaatcagtcttagtgagctaaaattaaagtgacagcaggcctgcttcctttctggaggctctaggggagaatgtgtttccttgctttttccagttgctagaagccaccacattccttagctcatggccccttccttcatcgtcaaagccaacaatggtacatgtctctggccatttgttttggtatttacattttcctttctgactgtctctttcacttttaaggacccttaacattatattgggcccacttgaataatctagatttttctctctgttttaacatcagctcactagcaaccgtaatttcatccacaactttaattctgctttgccatgtaacctaacacagtcacaggtaccagggattaggacatgaacatttttgagggggtgtctgccacagtcccctcctcaattatttatccataggttttaggcatatggttaggggtaggagccaggagatgccaataataacaggactggaaaaaccatgagagaagggattcaagttctgcataagaaacttcaaggaaagttttccagtgtcactatcataaataaaagagatatgaaatcttcacaaaaaggtgcaaggcaaactgagaaactcctttgcatgacttgccagtcttggctgcattcagaatttgtttggagaaggaaaaggcccttcctttttctctctaaacagagattcagtaatgccaaatgggccctcgttgatggaaaaaatcactatgtaactttaaaaaaattatagaaatgtaaatcagtgatgacaacaagtctttggcccatctgataaggtggctggtgcccactgctggtggcctttgctggggctcaaatagagaagagccaccaggatgagggtagggtccccagcatcccctctctgtgagtcagcttacaaaaggccatgttgacttggatgtgaatcacgcctatctgttccaagcaagattaaaaacccaagaaaattattgttgagcaaggtgttttatgactttagcttacttccttttttgaaacattaggaaatgtcaaagttagtttgttcagatttattagagaatgtgtggaaaagggaaaacctaaaaaacaaaacaagaacaaaaccgcttgtggttggttgacgcacaactgtctcttgggcatcatttctaggcaaagattgtcattttgtaaacaagggtttatctcccagacttccttgtttttggatagctgattgccagacattgctggcacatgcatactcacacagttatctatacttgttccttgctgcttattgctcatgctaaaacctcttgaatgtaaggttttcaaacagtaacatttccaaatactaacactttggcattctcacgtatatactttgtgtattcggaagttgtattattaacgtggtgcaaaccttgtgtttagtttaattaaacagcaatgctttgctatgtttatttcttggagggtgtgtgtgtgtgtgtacgtgttccatgcatgcctcacatttctatttgcatatgtgcataaatcaagaaagcaaccaaataaacaaacgctgttctacttccctactaaagtgacttttaaagacttattgaattatattttagtgaatttgagtaaagcatttaagtgcagggcaaattagagcaagcaaaacattcgagcatacataaccattttatcttggctcatggccccttcttcatcttcaaagccaacaatggtgcatgtctctggccatttgtttttgggatttaaatttacattaaaacaaatttaaattaaaatttgttttaaattttaatttaaaacaaaattgtggccacagcatggattgtgcttctatatttatttgctcagcttcaaaagtaagactagtccagcctttatcctgggcaggctgtggtcaacaagccaccaatctcttcagtggggccaatatcagaggactggcatggggacctcagatatccatcaggttcctctctcaggaacatgggagcagtgatcttttggggggccacatggacactgcatcccctgccttgggcactggatggtattatcttgctggaattcccttccaactctgccaagaatgtctttgagacagagagactgatgggaagaaagtgaggaggaccagctctaatgaggttcaactgcagaggtttcagtgttggttgtgctgtttgacttcactgggaccccatcctccagtttcaagcacttctcagaactcatgattattcctcaatctgaaactttagagaggttgggggaccacttcagacacctaagggcaacagaaaggaagcgccgtgtgccagcactctactgtcattcgtggtgaaaagcttccttctctttcctattttttgtggttggcaaaatataaaaggtctttctacttatttcaaaaggaaaaatagaatgagggagggagggggaggtaaaggcagaaagagagagatcagttcatttttgtttggggaaaacttttagtctataacagcagcaaacatgtattgtggcagtggcctcagccctgctgaaggaaatccaggccacattaaaatctggggaatttgaaacggcagtgtttgtagtggcctgcagatttccactggcaatttctttaaagccaaagagttataattaaaatagaaatggatccaattatttctgcctcctgtctgaaaggatgtagctggtaatgagaatcacatgtctaaatttcagctccttctatttccaagcaagttgccccatgagagaaattctttcttttcagcaaatctcagtaaaccacatttctccctcctccttagctactgtggttttgcactgatttttacaagtcccagcaatggaactcagtcatagtaaatgttcttatttttctctcctttctactctttataagacatgtcagggtgataagacttatttttttgtttcaaagagacagagattagaagagtgggagggcttagtcttaaccagaaaagatttaccttatcaggaacaacaggctaggtagcttggccattgccacttgggatattcttaggctaagggagggaggtgaggaggtgactaggtgatgggggtagaaggggtgtgtaaggtggtataggtgtacagggaggccagtcttgggaagaattttacccactgggtgagtgaggctcagataacatggtggtcaacaatgtgccttagaaatggcaaagcctatactgggacagaatgccatggtcaccatgaataaatatataatactgttgttcttatcagcattactgactattcatgatagatttgatctgtgcagtgcagatctattcaagttccaaaggacattccaagcctccattccttccacttgcagagccagcccccagtgccaagatgctatatacattcacatacaagcctttgtgtagacacgtgttttcatgtgcttattggtcattagaatatcttttttttggtgaaatagctactcaaatctttcacccattttaaatttaagttgcttgaccttctattattgaatcataaaagtttgttatgtattctagatacaaaccctttatcagacatggatctgcaaatattttctcattgtctgtgattcatctttttttaaatggtctcttttgtagggcaaatgtttttaattttgatgaagccaattaattccttattttggtaacatattgtctttttcatgccatacttaagaactctttacctaatccaaggccacaaagattgtctacaatgttttctcctagaaattttagtttttactcttacttttaagcctgtgattcattttgggttaatttttgtacatgttgtgatttaaggatctaaattgatttttctgcatatggatatcaaaatgtcctagcaatatttgttgaagactattctttcttaactgaactaccttagcacctttgtgaaaaatctattgaccataaatgtaaggatgtatttatgaactcttaattctgtcccattgctttatacatctacctttatgccaacagcacattgtcttgattactgtggctttgtagtaagttttgaggtcaagtagtttgagtcctccaacattgttcatcttttcaaaaatttttttggctaatctaggtcctttgcatttcatatacatttaggattggattgcaaatttctataagaaatcccactgagattttgatagggattctgttgaatctataggtcaatttggggagagctgccatattaataatagtgtgtctttcaattcataaaaatggaatatgtcaccatttatatagatttttaatttctcttataatctttgtacttgtaatgtataagtcttgtagttcttagttaagtttattcctagatattttattattttgtatactattgtggacaaaattttttaaatttcatttttggattgttcattgtgcatatgtaggaaatatgtaggaaagattgatattttatgtattgatcttttatcctgaaacatttccagacctagtaccactatgtatatgtatatatgctatatatatgtaaaaaggttttctacatactggatcatactgtctgtgaataaaaacaaagttttatctcttcttttccagtctgtatacaatacactggattgccctttcttgttttcttttattgaccagaacctccagtactacactgaataagagtggtcagagcagatctcctttggttttcagcctacacgtgtctttgaattgaaaatgtatgtcttatagacaaaatataattggatttgcttttttaaatttagtctgagaatctgtgattttgactgaagtatttattccattcacttttaatgtaagtattaatatgattagaattaaatgtgtcattatgctatttgtttttcatatgctttgtgtcttttctgtccctctattcctcctttactcccttctttgtgttaagcaaataattttgtatagtattttaactccttggttgatttttaaactataattttgagttatcatcttagcatttgctctaggaattacaatatgagttttaacataccacaacacacttcaagctaaaactaatttaatccagtaaaatatagcaactttcctccaatccagctcaatttcctccctaccctactctcacttttgtgctgttagtatcgtacattactacatctatttatattttaaaccaaaaagtacagtttttttgcatatcataccatttaaagaaataatagaagaaaaaatgtatactcattaagtcttttataattacccatatgttaaccattttcagtatttttcatttcttcttgtggattcaagttatcaactggagtaattttcattcccatcttgaaggattttgtttagtattttttgtaaggcaggtcattagcgatatattatctcagtttttgtttatctgaaaatgtctttatttcactttccttttcgaaggataatcttgctgaatataaaattattggctgacaaatgtttcagtgttttgaatatgtctttctactgctttccggcctccactgttactaatgaggatttaaccatgatttgtactattgttctcttatagatgattagttttcctcttgctgccttcaggattttctctttgctttttgatttcaacagtttgatgtgactaagtgaagatctctgtgattttcctacttggggtacagtggggttcctagatctatagttaatgtttttcctcaaatttgggaggatttgagtactatttgttcaattttattttcctgcccttttcctcttctctcattttgaaactcctcttccacagttgttatgcttgatgctgtctcgtaggtctctgagactgctcatttttcttcaatcttttttctctttgttcttcagattggataacattctatctttagtagggattccatataatctttttttattttgttactgcatttttcagctctagaatttccatttggttcttttttaaaaatgttatttctttattgatattcctacttgttgagtcactttcataatattttccttaaattatttaagcatgatttccttcaatttttttatcatatttaaaatagcagctttgaagtctgtctgttaaatcaacatctaaagcactcaaagaccatttcattgacgtctctcctgccctccactccaccccctagtatggataatactttcttcattttttttctatgactcataaacttttattgaaaatttcatattttagataatatatcataagaactctggattcatttttcctttcaacctcagagagtcttggttgttgctaccttatattagtttataacttgcctggacttgatctgcagaatctgttacccttcagtgtgcatctgctgatatccctgatcagtttttttaaaaaaattcttatttgttggctgggcgtggtagctcacacctgttatcctagcactttgagaggccgaggaaggtggatcacctgaggtcaggagttcaagaccagcctggccaacatggcgaaaccccgtctctactaaaaataaaaatacaaaaattagctgggtgtggtggtgggtggtgggtgcctataatcccagatactcagggggctgaggcaggagaatagcttgaacccggggagtgggggctgggagggcgagcggaggttgcagtgagccaagatcctgccacttcactctagcctgggtgaaagagtgaaactccatctcccaaaaaaaaaaaaaaattcttacttgtttttttgcacaggtggaagggttggcttcttatgggtcacctttgtgtctgcacagcttaatgagcactcaaaaactggtcagaaattgtgttcaaataccatactttgccactggtggatctgtgattgaaatgggaaatgtattcaaatttgggccagttttcatctctgccctaggtgttatgttaacactgggccctcttgggtctccactgtgcatgcatacaggttcccagacagacagggatatggaatgcttgtcaagctctcaatgctagttcatttccacgaccttcctgttaaatttctggttagttcaatactgctcatcccaaccaggattgcaacttcagtctaggaaatctgcaagcttttcccacttgctgctgactgtgggtttctacttttcacttcaaatcaagtgaaggcctgtgctgtccaggtcaaacaaccatgttgactggtggaggcagtttcagcaagaatgccatgtatttccactgtgtttacttgaatctccatagtttcttgagaacataaatttctcaatttgcttgccccttgtcaatttccagagccctgaaataattgttttcgacaattttgtccagctttataattgctttgcagggagaggatttgttaaccgcttcactccttcatagctggtagtcccatctatatacagtatatttccaaagaaatggattttattattttaagcatgacatcttattaacttagatatgactgcatactaataagtaaagctaaatttagagaaactgtggttcatgatagtgtgcctttgacattttatgatccaaaacagaaaaggtttttcaaaaggcattttgagataattcttaagatttcaagcctttgatttgaaaagtctatttatctgaatagtaagagtctcatattttcatagcaggaaattatttcaagcatttaatttagcaaatgaactggagcctaaattaaagaattccaaatttattcctgaccctggttgttattgagggataataaaatatttccctggtgtcctgtgagagattgaaggaattttgaggtcatgatttatatatttgccatcctcttttaaatggattcagctgtgatgtctgcagcaccaggagaatttaagtgtctgcctgagagccaggactctgtccacgtcaagctttcagccagaccacttccctcagatcctttctagttttctccttcttcagtccattccaatgacccctggttttgatgaggcataggacgaggggctacaagatcaggagcacatctagctctggcttctgaggccacatgatcacctggggagactgagacatccaggatcctggaagcagagcaaagagccatctgtgaagaggaggaagaagacatctgaagaagaaggtttttcttcaagaaccaccacacacttgccttcagatgaagtttgaagccattaagcttccccttcttcttaaagctctccttccctatttttcctgcatgccctcgtttttatcactgacaacacatcgttccctgagtctcactgtctcccaaagaggagcttcaggttcatctttgtctccccaagtctgaaaatatcagataatatgcttgcaacttcatcttgatggcttaattcctgctcctgtcatttacacttcactgccctgttttgtctccttcatcctgccctgcccagccctgggaactctgtgtctcccatatcactcccctgctggggacctgaatggctccctactgcctccctaagccagtccaagttcccctggcttcctgggccttccagaatctgtcctggccttatctacccccacttacttcccaactgggaggtgttgtggccatggcagaggaagggataaaagaccagtcattcagccttgtgtgcctgtaaagcagtgtacctctaacaaaaatttcctggcttaagagcataaaaataagttttacacaaaatcaataacagaagcactcagattgaagcatatttttaaaggtattagtgggagtgattcagagtcagcagacccagggtgtggacatgagctcagaatggcttctctggagcaaaatctgtgacttgatcccgcaaagcaaaagctgccagtcctttctcatcactgtctctttcctggtgtgacatgactatggtcagaactatgttctccaaaaggatccactgaagtcctacccccagtacctcagagtgtgaccttatttggatataaggtcattgcagatgtaattagtgaaaatgaggtcattagggtgggccctaatttaatatgactggtgtccttataagaagagggaagaggccgggcggtgtggctcatgcctgtaatcccagcactttgcgaggccgaggtgggtggatcacctgaggtcaggagttcgagaccagcctggccaacatggtgaaaccccatctctactaaaaatacaaaaaaattagctgggcgtggtggcaggtgtctgtaatcccagctacccgggaggctgaggcaggagaattgcttgaacctgggaggcggaggttgcagtgagctgagattgcgccattacactctagcctgggcaacaagagtgaaaccccatctcaaaaataaaataaaataaaaataaataaaaataaataaataaaaaaaaggaagatgatgtgatgcgaagacacagagagaggccagtgtgtgaaaatggaggctgagattggacttatgttaccataagccaaggaatacctggggctatcagaatttgggagaagcaaggaaggatccacccctaagaactttagggagggtatgccctgattgtaccttggttttagacatttagtcttcagaactgagagaataagtttctgtcatttcagcccagccagtttgtggtgctttgttacagcggccccagaaaactgataaacatgatatgcatattttgttaaagtctgttcactccgactttgacttctacatatccaagatagcagtcctgtgtctgctatctgggacaaaagcccacctgccctgtccttctctcctgggctaccaggtcctgccatgtgtgggtttgaagctttgggaagcagacacatttaatagattgagtttcatttttcccacaacttctcaccctcacagaggaaggtataactcatgctcactgtgaaatcagggctgttcttgggcccctagcgaagtgctatccagacctggctctgtgactctgaggaaaacggcaggagtgtgaggccagtgccctggatgcaaagtgctatccttgggagaggccaagcagggatggctgaccggtgacgatggtggcaagtgactccgtctctggaccctgtctttcctcctccccacactgttcagggctcttgcacaggctgttgcctccactgggaactctctaacccggctctttctcctactttgtgcctcgcctaagtgtcaccttcttccttaagggagcgacgttgtctcccctccccatatgcatcctccccagcccgttctttgcttgtctcataacattcattattattcctcactattttacttgcttgcccacttgtggtgaactgtctaacagtgatgccagctttgtcccccatgggcccctgtagtctagttactcagcagccagaggaatctgttgaaaccgaagtcagcccacatcactctgctgttcagaaccctctgaggctccccagaccactaatagtaaaagcccaggaccttaccatgcctactggggcccctgggtccagccccagctatgtccctgatgcatcaccttgttcatcacaccaattccttagtgccactgagcaggccaggtgctcacctgaattggggcctctgccagggacactgtctccccagatacctgcacggccatctctttcacctctttcaagtattagctgaaatatcaccctctcagtgagcccaccttggccaccctattttttaaaaattaaagtttttattgtgagataactgaagattcacatgcagttgtaagaatgcagaaagatacctggtacactttacccagtttcccccagtggtaatcttgtaaacctatgtacaatggcacaacccggatattgacattgatacagttaagacaccaggtatttccaccaccgcaaggattcccatgtctccaatttttagccaaacactttgctcctgcaccactccctccataaaccctggtaacccatcacctcttctccatttctatgattttgtcatttcaaaaatgttacataaacggaatcatgtagtatgcaaactttggggattgacttttttcactcagaataaatcctggagatttatcaggttgttgtgtgtatccatagtcagtttctttttattgctgagtactatttcatggtatggatgtaccacagtttgtttaaccatgctgcaactggaagacggctagattgtttctagtttggggccattatagataaagctgctatgaaaattcatgtgtatgctttaatctgaatacaagtttccatttatctgggataaatgcctaagacaacaattgctggatcacctattagttgcatagttactttaaaaatttttgttttttagagacagggtctcactgtcacccaggctggagtgcagtggtgccatcatagctcactggagacccaaactcctgagctcaagtgatccttccaactgagcctcctaagtagctgggactacaggcacatgccactgtacctggctaattttaaaatttttttatggagactgagtcttgctttattgcccagattgtttgaactcctggcttccaacaatcctcctgcctcagactctcaaagcactgggattacaggtgtgagccactgcacccagccctacgtatttactttttaaggaagctgtggctattttattttgaactgtactctcctcggcccctagccccttccccaaacatctgatacctttcacctgcttgctttttagaagcactgatgcagacaccagatatgaagtcagacgtctgaccagtgttcgtatatcaggggaaagcttgctggaatcaccagcgcacacaaaagtcaacatgcccacaaactgcgtaatgcggtgatgatgacaagacagaatctgtgcaagaattccccagatgaagcactttgctagatttacaagaaaatcacattgagttcaaaagtcaagttagtgctatctttcgtgaaaacttatcacctcaggaaagttctaactccagaaacactcctgagttgtgggatgaccaagcagagctgtggtccaagcagaccctcacctcaccagcagttccaggcacccaccagtcccaggggagcaagactttttgcaaatgagcagaaacattctagttagaaacattcagagacccctagaggcgggagaatcaaaacagaactgtatttcatgctgaaaagtgaaaaccaaatcaacaaagctccctgtcacagcaactggtcagctcagctgtataagtgaatggcaaaaacattcctgggctctgtggaagcccctggaagaaatccagaaccttaggtacttagcctgactgggggtggttgttattaccataaatttatttatttcttaacatatcagttcctttcatttcaaacatttgcttgacatttgtagtaattaggtgaatgctggaagaaatgattaaatgatattgtaaaataatgttttggcctgactcaaaatagaaatatttatagtgttcccactaatgccagatgatgttagcccgattattgtgctgctttttaaaaaacatgctaggctgaaaaaaaaatcacaaacaatctaaagtgagccgaggctctaagaggctttgtgtctataagccctcttcctgtctgctatttggccccagcagtaaagcccatgtgcttcgatcagtgtggtggatgtctggagcacggtggctctgggtgttgggaactcacatgtctcattatctgaagacgaaaccaaagactggagagatggcttgagtatcactgagtgcagaggtctgtgtcccctcctagccttgtactgtgggatttggaggtcactgtgctttcactcctgcaactcctgttccccacttttctcccctgcctttttctctcccccgtgttatccctccttttcttttcccttctcctcccacgctaagctgaatccattaaactaactgaaccaatgaggtctcggcccagaagcatcagcctcctttatagtggagacagaggtacagactcagtgcagtatatcgccatgctctgcagagagccacgactcattcctgggcaactggaggaaggggagtgtgtctgggaccagggagtggcctatgccagggtgcagacctcagtgttactctccaacccgagcccaagcctgcccctgccccaacccacacgataccaagtgccacccggacctgtcctggcagccctgggcttccttccagagcatcatgggaactacagggagcaatcactgtggtctctttacagtgtcttagggcagaaggtgagggtctgaggaagtttcattgcaggcttcagtacaatctctggggaagattatcaatttgtggaagaaaagcagaagtcatttccaggaagtcttcaaagactaaactataaatgcttagtgagcagtgcaggacgtggatgggaggaaacgcaggtgcctgcccaggcctgcagccctgggtcaagaaccacagggaagaccattgtcttcagagtccatcagaggccccagagcctggatttatgggccaggccatactgggccaggctcatagtggctcctatgttagtctacttgggctgccttaccaaaataccatagactgggtaggttaatcaacagaaatttattttttcacatctctgaaggctggaaagtccaagatgaaggttctggctgatttggtttctagtgaaggctctttctggcttacagacagctgcccttctccctgtgtccttgcatggcctttccttggtgcctgcacacataagcaaagacagagagtgacagagagagagggggggggggagagagaggggagagagagagacagagagaacaagctctcttataatgacgcaaatcctatcagcaccccgtcttcacttaaccttaatcacctccttataggccctatctccaaatacagtcacatttggggttagggcttcaacatatgaattttggggtaacacaagtcagtccacagcagctccccaggaaacggtgttcgactttcctaagtaaaggccaaggattccttgggcatcaatttggttaaggtctgctcatgcaccacgtcagtcactgctctgggtggggactgggccataaagaagtcagggtaccttgagtacccctgccctggcaaagactcagctaagaatgtgggatgttatgctatgcaggttccttccaaatcaagctacagctcccaccaaggttgatgtgcagacacaggagctgtgtgctggcccttaggcttgagagctggacagaaggagaggtgggccatcggtgtatcgtggatggtatatgaaaagaccaggcatcctctgtttccttccctccctggtgcaatggggatgatacagcaaatgctatgcagggctgctgtggcacctgcatgagatgccgtacgtggagtctgagaagaagtggaaggagaagggaagggaggcagaggcataaagagatttgtctcctcgctttttcatggcaccatgggaagcccgcccctgggttggcaatcccagctgccatctctgtctctggcactgtgcctccctggtgtctgtctctaaacccagactctgaaagatccacaacgtgtctagcaaccaaaattagaggcctgctgctcttgctgctgctgaatggagagcaagccagcatgtgggttggaagtgcagggcagctcggcaaacttagaagctgttgcagaccagagggagagccacctgcttcaggaaagaggccatggtgtgtgtgtgtgtgtgtgtgtgtgtgtgtgtgtgtgtgtgagagagagagttgtagccatgagttcttccagcaattgggcatgaccttgggaggctgcaaacagatcctaaattgacagcgagattcagcatcttgggtctcaccgtgtccaaagtcctctggtcctggcctctggcaatgcccctaagtatggatgggacaggagttgcagtgcctgtccttttacactgggggagcccagtgagggggtgacacatattgtggcagatgtctgagcagtatgtccccagaggctctctgtaggggtgtgtgtattgtggggagggagggaggtggggggcggttgggggagtggatgctgtaacactgagctccttgctctcctgtccctctgtgagggataacccaagaagaagcttaaacagaaatgtgtgacccctgccctgactcctgtgggggtagggatgacaacctagatcctctgcagcccactcacccagccatggaggggatatctgcttccacacctagcaggagggagcaaagaagactcaagcctttggtcaagtcacgatattcttaaaaaaataaaaaatgatttaggtcaggtgcggtggctcacgcctataatcccagcactctgggaggccgaggcaggtggatcacttgaggtcaggagtttgaaaccatcctggtcaacatggcgaaatcctgttagacacaaaaattagctgggtgtggtggtgcatgcctgtagtcagtcccagcttcttgggaggctgatgcatgagaattgcttgaacctggggggcagaggttgcagtgagctgagatcatgccactgtattccagcctgggcaacagagcaagactgtctcaaagaaaaaaaaaaaaaaaaaaaaaggaaaagaatgatttagttggaggccacaaataggtatcaggattctcccacatagcattggcagccctaatttaagtcacgatagtatataaagtatactacctccttagttacctgaactggatatggaataagctgttttcaacaggttaatatttgaaaatgtcccttttgtccattcagcaggttcttagggagccccaagctgtgccaggcaggtacagcactagagaccatcagtgagcaaaccagagggtccccaccctgtgagtttgcactttattgggaagagatagacaatgagccaccagcagagtaaagaaaattgcactgcgtgctggaagaagggagagatgccctggaaaaagaaaagacagaaaaggaaaaagaagagaagaatgggcagtggtgccaggcgcagtggctcatgcctgtaatctcagcacattaggagactgagttggggggatcacttgaggtcaggagttcgagaccagcctggccaacatggtgaaatcctgtctctactaataacacaaaaattagccgggtgtggtggtgctcgcctgtaatcccagctactgggtcggctgaggcaagagaatcacttgaacctgggaggcagagctttcagtgagccaagattgcaccactgcacttcagcatgaacgaaagagtgaaactgtgtcccccagtcccctcctcaaaaaaaaagaatgggcagtggcaaggtagatgggtcaggtacagctgtggtcagggaatcctcgtgtgggaggtgacaatcgagaaaagaaggaggcgctattgtgagccaagggcgtgtgcagtaagaggtttacaaccagaaagaagagctagtgcaaaggcccccaaggcttgtaaatgggggtccacggatagtcttcactgggccaagaaggaagaggatggatgcccacctgggcctggatcagactcctcctccatgtgatcttcaagtagtcagtcccctcacctcctggttctccaagtccaggcacctggagacagaacaggctttgtgacaatggacccaacccacggtcatgctaaggacccctcttcttctccctagggcattcctcccttgtctctgcttaatctatctcttgccttgagggccctggttcacactctttctcactcggctggctgtcttcatccccaacccggtgccatgcagcccctggaattattcatctcagaacctagaagacaactcccacccccggggtttttctggaccctctggtcctcatagggcattagattccatgatccattagatctttttgaggatttgtatcctatgattatgggagaaatctctaaaaaatgtaatgcattcctcgctaccttaggatccagtgcaatgaatgttttatccttctgcaaactgccaagtccttattacaatactatagaatcataaggtggtctttgagaacatttaccactctgttctacagataagcaaaggaaatacagggttatatgtacactggccccaggacaaaccctgaagcatacctgcttgtagaagcctatgatttcagcctggtgttttgtttttgtcatttgacttgttctgaaataaagtaaaatggagactgtagctctctgacccgctgaagagcaacatttgataaaacttattactgattaagagaggctatcttcttgcaccaagtttttttttccccatagtaacttttcttcactgttatcagggccctctgaagtgacttaaatccataccacctattgctccctgggcttcatgcatccacagattctccctccagttaaactacccactccctgagagaagcagcagaacatcataaatctctgtatttatcccctatggaactgaggagccacaacacacaaagtccccaaccaacttgctgagttaatttatgaaaggaaaataaacctcaggatcccaaactcactaagccaaagggaaaagtcaagctggaaactgtgtcatgcaaacctatctccctcataatttgcccactaggaaatttctcacgggccccaagatctttaccctagaacagttctgttgaatttcaccctgacaaagtgaattgatagcttatcttcatgggtatgggacgaaggacagaactcaaagtcatctctctgcttacctgagacaaatgcatacctgattcttcctctgccctatgcttatttcatcttatgtaaaaatgcagattcactgagctggatgaatgcataagtgactattcctctacccttctcacatgtggacagctgatcaaagactcaaaagaacaatcgtttgactcttatctacctacagctttttaaaatttcttcctctttccccaatatctgccctttctcctttaaatattgaaactctcaaaatcacctttgaagaaaggcacagacctgtctcctgggcgtgcatcctcaatcttgcaaaataaacttctaaactgattgagacttgtcttgagtactttttggtttatacattctcaaccatttgtaagattcctgccagaataatccaatacttcatcacttctagggcctgaaaaaaggttcagggcccattgaaaaaaaattttcaagtcccacagcaaagttagatagatttaaattctttacatggtatttgatggtatttgtattgacatgtagctatgctataaaagcaaacatctgcaaaatctcggttgcttaaaaaaaacaaagccttatttccttttgtctttgctttttttttttgagacagagtctcacactgttacctaggctggcgtgcagtggtgcgatcttggctaattgcaacctccccctcccaggttcaagcgattctcctgcttcagcctcccgagtagctgggatcacaagcaagcacaaccttgcccagctaatttttgtatttttagtagagacgtgtttcactatgttggccaggctggtcttgaacttctggcctcaagtgatctgcctgccttagccttccaaagcgctgggattacaggcttgagtcactgcgcccagacctccaaagccccattttttgctcatactccatccaccatggtcaggtgggggctctgctttgctgagtgtcacctgccttcaggagtgcaggtgacagagcctttcccaccaggagcattgctgttctcatgacagcatatatttgtttcctattgctgctgtaacaaattaatgtcaaatttaagtggcttaaagcaacagaaatgtattatatatagttgtagaggtcaatgtctgaattgggcctcactgaactaaaatcgagatgctggggctgtgcatggtggctcatgtatataataccaggactctgggaagcggaggcaggtggatcacttgaggtcaggagttcgagaccagcctagccaacatggcaaaaccccatctctaccaaaaataccaaaattagccaggcatggtggcacatgcctgtaatccagctactagggaggctgaggcaggagaatcgcttaaacctgggaggcagaggttgcagtgaacagagatcatgccactgcactccagcctgggagacagagcaagactctctctcaaacaaaaaaaacaaaaataaaataaaataaaataaagagatgttggcagggctgtctttcttctggaggccctaggagagaatcctttttattgtcttttctatcttctagagaccacctgcattccttgtttcagtactccaccctccatattcagaactagcaatgtagcgtcttctctttctccaaattctccttctccaacttctgcttccaaggtcatatcttctcttattctgttactcttattctcttactcttctactttctcttatgaggactcttgtaatgatgttgaacccacttggataatcaaggataatctgcctatctcaagattcttaatcacatttgcagcatacttatcgccaagtaaagtaacatattcacaaattctagagactaacatgtggatttctctggggggctgttattagctgatcacacagagagaagtgatggtgcccaatcacacacaaggcttaaatattctgcccagaaagaggatacttcatgcccttcacatttcattggttaatcaagtcacatggccacacctcacttttataaggtagaaagtacaatccctccatgtatacagaatgaggaggataagaaaatgccaggaattctccttcagagttaggaggaagaacgcaaaaggttttcaccatcatggtcacaagataaaactagaggaaacaaaaatcataattttccatttggtgagtaagtggcagatgcaaagaagccctgattaactgaatttcaggtggtgatgagcccgtcatggttgagtcaaaaggcccagtggaggccagcacctagtctgctgaagagcaggctggccacagaggaagactatgtgaatgagaggcagccaagcttttcatgatagttcacaaagacaaacataagcccacagacccaagaagctgagcaagtcacggcagaataaatacaaggaaaatcacatccaggcactttataatcaaaatgctgaaaagcctaagttaaatacaaaaatctttcaagtagccaaaggaaaaaaagacactttatatacataaaaaaaattagggctgacatctcatcagaaacaacgaatgccagagggcaatggaacaaaatctttaaagtgctgaaagaaaaacacttgcaacccagaatctataaactactaaaatatcttttaaagatcaaggcaaaaataaaagcattttggataaacaaaaggagtcatctgtagcagatttgcactccaagaaatggtaaagaaaatccttaattaaggctgatagaaaatgacatcagactgagcaagttaacaagatagaaaataaattccaaacatcaggaacaaaaggaggttattattggcaatgctgcagacatggaaacattaaataaaggattttgaacaactttatcctcaagaatactgacgacttagacaagataggcaaattccttgtgctgtattttttttttttttttttttggtagagacagggtcttgctctattgcccagaatggtcttgaacttctgaccacaaatggtctgcctgccttggcctctcaaagtgctgggattacaggtgtaagccgctgcacctgatctaatttggttttgagggctgtctctggaaagttggccgtaagccaagatatccactgtctaggagagccttgactagggtaaagttaggttcaagtgtgtgtgtcaggtgaggcacgatgaagaagtgtaaccaaaaatgcatgagatagaaggaatttattacttatagttcccagggaagttaggggtgctgatgggaggctgatgggaagtgtagaggtagtagggagctcaaccagcaagtgatggggaagagggagagggaaatggggaaggataaggagagggaaaagggtaggagggaggacctatgaggctatgcctatattaaggtccataggtgttaccctttaggctttctcacagggattgtggattatctaatttaaagaaaatatgtgcaaagaggggaacttactttcatgactctggtgttgatcattaggttttatcacggttagcagctatgaggtgtgtgggatttggggtcagtgggatgaagaacaagtgggctatatcagaaataaccatcacaggaaggggaagttttaactaggctaaaggaggtggggaatggctgggtttcaaacaacttatgtaaggcctaaagatggatgccaagcaagtatattaaacatatttatgataccttaaaaaaacgacataacaaaactgacacaggaagaaatagaaaatctgaaaatctccaagttgatttaaaaaattgaatgtgcaattacttgcaaggaaacttcagtcacagatggctctactaaattctatcaaacttgcaatgcagaaattataccaattgcacataaactgtttcagaaaataggggaggaggaaatcatttcccaatttttaaatgttttggccagcacaatcctagtaccataaccagacaaaaaacattacaagaaaagaaaaccacagaccaatattcctcatgaatatagacacaaaaatcctttaacaaaatattagcaaattgaacccagcattttttaaaaagaataacacaacatgaccaagtgaagtttttccgaagaatgcagtgtcattttattatttcaatattaataaatccatataattcatcacattatcagaaaaaagagaaaacccatacagccatctcaatagacacaggaacaacatttgacaaaattcaataccttttcatgatacaaactctcagtacactaggaatagaagggaccttcctcaacctgaaaaagacatttcaaaaaaagcccacagttaggccaggtgcagtggctcatgcctgtaatcccagcactttgggaggctgaggcaggaggatgatttgagcccatgagtttgagaccagcctggtcaagatagtaagaccccatgtctacaaaaaataaaaaattagcagggtatggtggcatgtgcctgtggtctcagctatttgggaggctgaggtgggaggactgcttgagactgggaggtcaaggctacagtggatcatgccactgtactccagcctgggtgacagagcaagaccctgtctctaaataaataaataaataaaaacctacagcttacatcatatgtaataatgaaatcttcaaaatttcaccttaacgtggagaacaaggcaaggacgcacaattttaccactttgattcaacgctctactggacatcactatccactgggacaatagggcaaaaaaaggaataataggccgggtgcagtggctcacgcctgtaatcccagcatgttgggaggctgaggcaggtggatcatgaggtcaagagatcgagaccatcctggccaacatggtgaaaccccatctctactaaaaatctaaaaattagcttggtgtggtggcatgcatctgtagtcccagctacctgggaggctgaggcaggagaatcgcttgaacccatgaggcggaggttgcagtgagccgagatcatgccactgcactccagcctggcaacagagcaagactgtctcaaaaaaagaagtaatagtcaggcaaggtgactcatgcctgtaatcctagcactttgggaggccaaggtgtatgaattacttgagctcaggaatttgagaccagcctgggcaacagagcaagactctgctccctgcaccctccaaaaaaaaaaaaaaagaaaaagaaaagaaaaaaaattagctgggtgtggtggctcatgcttgtagtcccagctacttggaaggctgaggtgggaggatgacttgagcccaggaggtcgagggtgcagtgagttggaatcaagccactgcactccagcctgggtgacagagccaaaccctgtttaaaaaacaaaacaaaacagaaataataggcataaagattggaaagaaagaattaaaactgtctagaactaataagtgaatttacagggtctcaggatacaaggccaatataaaagtatcagtcgtatttctatacactagcaacaagcaattggaaaattaaattttaaaaagcaccactttacaaaaggtcagactgagggaatactctggggtgttggaatcatgtttatggtggtggttatgcatgatctgaaaatgaaattaggaaaactattttactagcatcagaaagaatagcatccttaggaataaatttaacaaaggaggcaaaagacttgtacactgaatactgcaaaacattgctgaaagaaattaaagaaaatctaaataaatggaaagacagtccatgtttatggcttggaagacttaatattgttaatatgatagtactacccaaagcgatctacagattcagtgcaattcctatcaaaatcccaatgatattttttacaaaaatagaaaaacccatccgaaaattcaaatggaatcttaaggtaacccatataaccaaaatgatcttgaaaagaacaaagttggaggattcacacttcctgatttcaaaacttactaaaaatcgacattaatcaaacagtgtggtactggcatgggaacagatgtatagaccaatggaatagaattgggagcccagaaataaaccctcacatgtatggacaattgatttctgacaaggatgccaaatcatttaatggggaaatgacagttcctacaacaaatggtgccagaaaaatggaatatttacatgcaaaggaatgaagttagacccttatcctacactacatacaaaaattaactcaaaatgcatcaaagacctaaacatatgagctaaaactgtataactcttacaagaaagcagcaaaaatatatttgtgacattggatttggcaatgacttattggatatgacaccaaaagcacaggcaacaaaataaaaaattgataaactggacttcgaaaaaatttttgaagtttggtgcaccaaaagacactatccaaaaaatgaaaagacaacattcaaaatgggaaaaatattttcaaatcatatatttaataaggatctagtattcagaatatctaaagaactttacaattcaacaacaaaaagacaacccaattttaaaatggccaaagaacttgaacagatatttctccaacaaagatatacaaatagccaataagcacatgaaaaatgctcaacatcattactcattagagaaattcagtcaagccacaatgagatgctactttacacccaccagaatggccataatgaaaacaaaaccaaaattaacaagtgttggtgagcatctggaaaaattggaaccctcatccattgctagtgggaatgtcaattgatgcagcctctgtggaaaacagtttggtggttcctgtaaaagttaaacacagaattataatatgactcagcaatttcactcctagatatatactcaaaagaactgaaaacaaatattcaaacaaacacttgtacatgagtgtttatagcagcactatttataatagccaaaaggagggagaaactcaagtgtcattgatggacaatggataaacaaaatatggtttacccacacaatggaatattattcaaccataaaaaggaatgaaattctgatatatgccataatgaagataaactttgaaaacattattctaagtgaaagaagccagacacaaaaggtgacatattatatcattctatttatatgattctccttatacaaaataaatagaatagctcagtccacagagacagaaaacagattagtggttggcaggggctagagggagggggaaatgactactaatagactgggggcttctttgaggggattatagaaatgttctaaaaatcagatagtcgtgacagttgcacaaccttgtgaatatattaaaaaccactgggttggacactttaaaaggctttttaatatatgtaatttatatcccagtttttcaaaaaaaaaagagaatctatcatagaaatatatatcacaaaagtgaatactaccgcttgtaaataaattttttaaagaccatttataatagcaaccaaaaaccataaaatatttaggaataaatttgataaaatatgcgcaaggcttctatactggaaactataaaacattactgagagaaattaaagaagatctaaataaatggaaggatgagtcaagtttatgtttcagaaaactcaatattaagatactcattcttttccaattgatctataggttcaatgcaattccaatcaaaattgtagtaggcctttttaatatatatataaacttttttatagaaactaatagtctgattttaccatatgttgtgctgtttaagtagccaacaggaagccacttcaggctctgggaaatctttgttttatggaaatgagcagcattagaaccttcagctaggagtggatgagttggattttgcttaactcggggatcctttgattcactagttactactcaagggaaaatgaggaaacagcccagagaaatgaatactatcagatcattctctaagtgtgggccatactcagaaatgagtttggagatgttgaagtcactcagtagctctatggcttctttgattggctgattgttttgtgagacttctaaaccttgtttcctcttgaaatgccaaatccattgctaactaaatgagacaacccgtaaggaggacttgacaaagcatacaggacactcagtaaaagctgagctgcacccttcctggacctggcctttttgggtcaggttttctgtgttgactcatacacagatgaaggtcgtgctctggacaaggaagaacataaaaccagaaaaaaagctggcaaagagtaaaacacaggggatggggaccaggaccgagataggaagaagcccaagagacagatgagctgcagacatgacagggaaaacaaaacaatgagatgctaagattgcagagttgggcaggtctgcatgacagggttcatggagtatatttcagtttttcaaagaccgttgccaggactttttttccatttatttctttatggctgggtgcagcggtgactcatgcctgtagtcccagcactttgggaggcggaggcaggccgatcacttgagcccaggagttcgaggcatgcctgggcaacatggcaaaaccctgtctctacgaaaaaatataaacattatccaggtgtggtggtgcgtgcctgtagtccagctatagggaggctgaggtgagaggattgcttgagcctggaagagggaggttgcagtgagccaagatggcaccactgcactccagcctgggtgatggagtgagaccctgtctcaaaaaaaaaaaaaaaaaaaaagagaaagtattttataatttgaatggtattacaatgtgttatgtaccacaaatatgcaaatcaagacactaatgttatattttgagatatctgtactcagaacaagagaagcttcttcccaaatttccctttgagagcatctctccccttctcaaatcgtccctctccccataaaacaatggcagctcaagaaacatttgatggatgaaaatcagacacatattgataacctcaccaactactgcaggaaagaatgggctaggctttgcatatgcacgatgaggtatggaatctacttgtttggttttattgcacctagctatcaccggaaagcactgcttctttatcacaattcctacagggtagaatgtggtggagtaactgggcattctgagtcatttccaaaaactctttaaaggggtgttctgcaaataatactatttcttaaggtaggagcaactttcacaatctgttcaagtcctaacaagtaatatattacattttgaatcagaataagtcaaaccagaatttttaaagtacatattaataatagttcttgtggattgtgtaatagttaaaatagcagttaaaaaaaaaagaaagaaagaaagtggatttcccacttagtaactagttgatactttatcgtaactaaagtttgaaaggcagcatttgggattcatgagtaagattttcttccatgacacctgaccaagcaattgctgctccattctttcctgcagtaacctttattatgattttaaaataaactttgaaatttaaaacagtttcagatttacagaaaagttacaaagatactacacagttctacagctccaacgccaagtttcccctattattcacatcataacactagtgtgacacatttgttagaattaacgaaccaatagtgatatgttgttattaactgaagtctatagtttattcagatttccttatgttttgcttcgtgtcctttttctgttccatggtcccttctaggacaccagatttcacttagttgtcatgtctgcttaagcttctcttggtcgtgacggcttttcagactttatttttgatggccttgtcagttttgaagactactggtcaggtactttttagaatgtccttcagttgggatttgtctgatgtttttctcataattaggctattgggtgttgggaaggagaccacagaggtgaaatgccattctcatcacatcctatcaagggtacacggtgtcaacatgacatcactgtgggcattaataggatgattttttttttttttttaccttaccagggaagcatggagctccctgaaggatgagccagacctcagtttccaggcatatgtgggagaggctgtggggaaaggggcttgagcttcagattcagtcatggaaaagggagagaaacccgaccaggcagagatcatatgcctgctgggaagccacagtgatttacactgctgagtggagaattgctgagtaaatattgcttccaaggagggaggatgtgccctgctgcctgctcccacccagtgcctggtaagtggatgcccaaaaaagcttttatctatgctgcaaggaagcccaggaatcctgtgggtggtggcagtggtggtggttcaggtgggagtaatttatgaatataagtatttgcttaggaggcagaggttatgtttaaaatgtgagcctgtttaagggagcaacctaagtaaatgaaggcaaaagcattacatagatatggcccaaaccaggctggtaggagaaatgtgcccgaggcttgactccatgggttaggagccaaaggggatggatgtaccccaggctagcctggaaagggattaattcatgggctgcagggccccagaaggcaggagccaggtggggtagtaataaaactgtctgtgcagcccagtggatgttggccatgcctcctccccaaacccactgtggattggtgacagagggatggcatttccagtcttcttcttgctcaccctcaaggactctgtgcagtatgcaggccaggattctctcaggctgtgggtttccacatgtgcttctgcatggaaagtcccctggctgctgcaggatgtcctttgcagagccccatcctgtcctccttatcgcagctgcaggcagcctgagccacattcctcctgcctgagtcactgttccaggccacaggccaccttgcctccagcttggcctatggaccaggccactgtccattccatcatttgccagacactgtggagtgtccctgcccttaaggtcttaccctggtgaccatgcaaggcaacaactgtggagctgggggactgccagggttccatggaggaaggcagagggcagaggaggggacgggggagcctcctggaggaggcgactgctgagttaagtgctggggaaaagggagtgttccaggtaaaaggggataggggatgagattgccacattgtgggaaatgaaatgttgtgttgaatgaaactcatttaaggagacgctaagccagaaatgttaatgggattaaaaaggactcttctatacctaggatggagttctgaggatggtgatgctaggatacaaagtcttgatccctttgttaggctcttctcttcaaaaagtggtggggggccggatgtagtggctcacacctgtaatcccaacactttgggaggccaaggcaggaggatcacctgaggtccggagtttgagactagcctggccaacatggggaaaccttgtctctaataaaaaatacaaaaattagccagacatggtggcacacacctgtaatctcagccacttgggaggctgaaacaggagaatcacttgaaccaaagaggcggaggttgtagtgagctgagatcgcaccaccgtactccagcctaggcaacagaatgcgacttgatctcaaaaaaaaagaaaaagaaaaaaagaaaaggcagtggggttaggtggttggggatcccagggaaggaaagcgagggcacatcctcctagacacctctcctcttcccagtagcttcaagacaagcttggactatgttcctgtgctgcttgggctgatggcccaaaattgctgagcctcagcttcccccagggttaaactggaagcaatagtgcctgccacagaggatactgaggaagtcctgagggaacagtgcagggcccagcgcaaatggccagtaagtggtgtttgtgactaatgacaaaatgggatcaggcctctccctaaggagggacctgcacagcaagaggctcagggcagctagggtaggggaagacgccaacattgcctgtcctagggctctccctctggtcttccctgtccctgcttactctgagtaaaaagacagtccaggcatagtggctcatggctgtaagcctagcattttgagaggtcaaggcaggaggattgcttgaggccagggttccaggttgcagtgagctatgtttgcgtcactgcattccagcctggacaacaaagcaagaccctgtccctacaaaacaataataataactttaaaattagccaagtgtatctatctatacctccttgggaggctgagacaggaggaacccttgagtctaggagttccaggttgcagtgagttatgattgcaccactgcagtccagcctaggtgagagagcaagactctgtctacaaaaaaaaaaaaaaaaaagaaaaaacaaaaaagaagaaagaaaacaaagaaaaagacaaaacacaaactagaatttctggaataatgtgggtcacagaatctttagaaatgggggatacctcaccacccattgctcccagccctctctacccactcacaatttcaagacaatttcagttccttcccattcaatgactcataagaaaacaaaacaatagtttaaataaatactacatctggcaaagccattcagcattttagccttattgttggtttccactcaaatatttatgaagcatataagatgtgcaatgctcactgctaggtgtggtaatgccagtgaagggtagtttaaattaaatgtgtacactcacccttctgctttaaacaaagtgtcttggccaggcttcttcaggaaaacagagccaataggctgtgtgtatatatagagagagaggtttactttaaagaattggctcataagattgtcggggctggcaagtctgaaaactgcagggcagatgggcaggctggagacccagggaagatgtgagtctgaggagggcctagaggcttctttcctctctttggggacctcagttttttttcctcgaaggccttcagctagctggataaagctcacacatattatgaagggtactctgctttactccaagtctattggtttaaatgttaatcttatctaaaaagtaccctcacagaaaaatccagacaacatatgacaaagtatcagagtactgtggcctagcccagttcacacatgaaattaaccatcacagaacgtgacatggggtgatgtgcttctcatgagtgtcccaggcagtgttcctctgcttctccttgccctccgcaggtagctccaagccaaccttctcctgccagaggacacaggggctgagaaggagtgctgggcgtggatgcaggggcctggctcacagccttcccttgcctctagtttctctcttgaacctcaggttccttaggtgtagagcgagcccgccgctacacttgcctcaatattgttgtgggcattagatggaaacaacgtgtgtggggtgcacggtgtgccgtcaagtgcagtggctgtgctatcaggagggctagaggctctgacacagagcagggcagagcgaccctggatcctgatgggtggcggtgggcttgccttatggacggaggcagcagaggacagatggtccaacctcaaggaattttcctgagttcacaggaaagtgttagcaatcctcccagcccagggctcctaaattgagtctctctcactctttgtaaattatattgtactctttccaaaaattctaagacattcaagttctccttcttcatcctcccaccccaaatccactcctttttccaaaggagacaatcattaactccttaacataaatcatttcacatcctctcttactgatttttttaaactacaaaaaggtggttgtctatatttgtgattttattgttgttcacttaccaacgtattgtatgtatttttcaatgtctaaatctgacttcttgtatagtagtaggcttttttaactttctactcacttaaaatagagaagaaagataaagaagaaaaataaacaaaagacttctacaaataaaatataaacctcgttgtaggccaatgaaatcagttttctgggaaagcatccacattgctcagtccctttttctctgagaagggccctggcccaggtgatgctaccaggaggccttgcctgtgctctccaagaacttacgtgcacccagaagtccccacttataggttccattcctagagtgtcctcctttgtgtttctctttggctgctgtagccatgtttgcctctgaggcagagccaaatgctgtgggctctgtgccactccataagcaaacaaatggcagcactgaatttcaaagaaaattccttaggttactgttttccttccttccttccttccttcctcccttccttccttccttctttccctttctttcttttctttcttttttctttctcttcctttttctttttctttctttcctttctctctctctcttctctttctttctttctctttcgctcttgttgcccaggcctagtgcaatggtgcagtctcggctcactgcaacctccacctcccaggttcaagtgattcttctgcctcagcctcccgagtagctgggattacaggcatgcaccaccacgcccagctgattttttgtatttttagcagagatggggtttctccacattggccaggctggtcttgagctcctgacctcaggtgatccatccgcctcggcttcccaaagtgctgggattacaggcatgagccactacgcctggccaggttactgtttttctacaaaaccttccaaacagccaagcaaggagttcggggggagttgtacaaatgcgtactttgaggaagctcatttttgaggtctaatgttgtctgtaataattttccgttgcgaagagcagaaattctcttctttatctctagtgagcaatttcctttccagatgttattaggggagatatcagtcaccaaggccttggctggctccctgataaaagcccttgcagtattccacactgcagaaccccaggctatgccctcctggattcatactagaaagatccaaggctccaagccaccagggctgatggatgtgactcatcttcctgaccccaggggaggcgagtggtgtgtttggtgcacactgtgcacctgtcagtagtcagcatcctgtaggccaggaaaacactgactcttctcaggaaaggctttgacggcagttggaacagaagtacaagtagacagaggccactgagttatggaagaaaaccaggctggatccagttctgtggatccaggaagaaggatccctccttttcctgctcaagctggtcatcaaaacaagtaaacaactagccccccttttttgtttttttagggttttaaggtttgctattacataggaaacatggtagtatacatggtgaataccaaagaaggcataaaacattagtgatttttaagaggtccagtgggtggtttctactggctctttctgtccctcattattctagaggagttcctccattaaagtcctctgctattcaccccacaaatccctcaacccctctctctcccccggcctcaatcacagatcattgcttctttagctagttatttactccttcccttgtctcataaaaaagttgagcaagcttattagaataagagaataaaggacgaaaagaaatggtcaaaataagcaatgaagaaggcaaggaaaatagttgatagagccagcaataagatgagcacatggaaacatctatcatatgatgttattcagttactacaagcgggcatgagccaagagtcctaggagccaaggaaatgagaaatataaccaagcagaacatacaagtcaggaaaactctgcctttctaatgcacagaccagaggggatgtgggtgatcccagtcccgagttaagtgtttctctgacattttcttatttgatcctgacaatctcgtggggtggacattattataacactcattttacagataaggaaactaagaattcaagagtaagttcgtaatgtgcccaagactacagttagtgagatgcagaaatgagattcaaacccaggctatcaggctccatgtctgggtcctgaatgaaaaagctcaccctacaggactggggtgggggagtggggttctgtgggacatttctgagacaaatgtaataggcatttttgtaggtccatatctcctgacctctttcaatccaattccttaatatgggcacaaaagcataaaccctgttgaaattcagcaaaagcaattccttgaagccaaacaatttgtgcaggtgcatagttctttgataacctaatttccttctctatttacataaatgaatactgcagattctatcaggaattataacaacaggtatttattcaagccatagtcagtcattcaatgcatccgcagccctctctattaagatttataccccactagaacctcaaagctgaagtctttggtcttctcactctcaggcttcctaacctctacagagaaaatactcttaaatacacagccctccgggacaactgaacacacaatgaagacctctattaagaacatttacaggacaactttacctgtccatggttcttctcttctatattctttgttagatgttttaggaattgggtacttcctctattcaagaccgcataccatttaggcagcatttctcaaactttcagcatctgtaagccagtgcaagctaatgcaaagcactaactttgggtaagatttcatcacaatttttagtaataaaaatatctcattctttttgaaagcttttttattatgaagaaatgcaaacatataccaaaggcagaatagtataaagaacccccatggacttatcactcagcttcaactataactgactcatggccaatcttatttcaacacgattctcatccacttcctctctctcatatcattctgaagcaaatcccagatgtcatatcattccatccataaatatttcagtaggtgtctctaaaaatatgaattattttaacattacaatagcataatcacaactatttgtgagaattccaaaatattatcaaatatcaaaatatatcagattcccaaatgtctcaaaattttaaagttttttttgttgttgtttgaatgaggatccaaataaggcccacacattcccatcagatagaatattattttaaatgacactattgtttcatgcatttgtaagagggcataatttgtaatctctccccaggatatctgtcctatttgataatggggtcaagttccatagtccattgatttctttcgttaccctttatttttactaagttaaactctcccaatttacagtcactggaaagagtaacaaatatctggtatctttttccaatgactatggattcagaaattaagagatttcttactgcaaacatgtttagccctccaccaggtgccaaatcaatcatgaaacacatttaaaatttggacagatccatgctttaacttgggagatgggggaaaatgggtccccctcacctacagggactgccttctggctctgaagagcatattttcaacgttacaggtcgttttaaaccatgcctaataccagattaagaaagagtcaaactccagtcagagcagactggacctgagtttggtcttaagaggatttctcaagtccagctaattgtttttctcttaaagtgtctgagtttttcttttggatcctgcagaccaataccagaactgacctcttatcagaggcaaatgaccagtagatatgccgtgatgaacaaagtcattcaaagttgtcaggaggacactgaaagtgtcaggcagggtatgaggtgatcctgaagcaggattggagccaagtagaagaggaagagggtgatgtaggaatgaagagggaggaatctgcaatggcattcatagttgactccagtgtgggatgccatgtaaaaaggaactctaaattcacacatacatgcacacacatcccaaagaaaccccttgcaatttgctcatggcctgggatggaaagagccagctgatctgagaataagaaaatgtaccttacatgaaatattctcttcatagttacagcaaatgttctcaacgctggctgcacattagaagcatcttgggagttcaaaatactatgtccgggcccctgcacaggccagtggaatcagaatctctgggtatttttaaacctccctcaccatccccctcctggacaccccccacccacacaggtgattctaacgtgcagcccggcctgagaaccaccggggtacagcatggacagcaagggctatttcagtacaggatcagttaatgagcaagggctcattattcaaaatactcacaacttgaagcttggtttggctcagcctggacttctggagcttggggtgagaagcaacctaatcttcagaattcacagctctcccgcaaaaacaatgtcagcagggagagcctggcaggggaatgggaaaggaggtgtgaggtgtcctgcacacgagcttcccttctgcccggggagaacactggttctctcactcctgtgtgcatgatgatcacacggggatatctgtcaaatgcagcttcctgggccccactccctgggtcggtcagaaggtctaggatgtggcccaagaacctgcattttagcgggtctccaggtgaccctctgagggtttatggaacaaacacacatccataaaccgagaggcctccaggagcagcagtctgtgggtccttcctgatgaacacgtgtggagcagggcttccctcttcaatcctgggccctgcccctggagggtctgagcagtaggtctgaggtgttgcctagcatcagcattagaagtgatttcagggcactgcccaattggggaccttcatggaaaagaagtggacctgccccaagttttctctgtacaatagaaggtggaagcgaagcaggaaggacccttggctcattccctccttgcttctaccaaaacggaagctggcgtttttcctaggctgacatctggcaggaagtacaagcggaaaccaaacagcagcctctggtctttcagagaccattgatttcatcagcaaaatgggtctcaaagcttcatcaaagtgggtctcaaagcatcatcaaagcaaacatgcaaattcttgggccccaccccagaccatctactgatcaggtacttcagggagacaggctccctaatctgtgtcacaggaggctcccaggtgactctgatgcttgctcggtgattgtgggcttaggaaaggcccccacctcttctggccatcctttcaggtcccttgtcatggaggcagggggaggccccacagcacctctcccgctctcggtttgttattgggaaggtgctgaaggatgctggggctgccaacctggaggaaaaggagcctggttccaggcagctgccacttgcacaggctgctctcccagctgacttgctttgttttattttctctaagcctgaagaagggctttccccagagagaaaggacacctggtgcctaattccccaaagcagaggcagctgtggtccagaagccccagggcctgtttccactgtcctccctggggaaatgcgggtatagggcccagagaggcccaggacttatctcgacactctcctttccccggccaagaaaatgcttcctcttcttggaggatggagatgcaaacactccctttctggagcaggctgcagccagaggggtggcatcctgtaccaagacaaaagcccttttgggacagagtgtcaatgctggtactccacacctccaaagatgaggggaggccgatctgaggcagaggcacatgtgagaaccagcccagtgggacagaacaaactacttgcctctttcttctctggacccaattttggaattcttctaagcattctgatcagagacaaagactaacatgctctaaaaggggggtcaccaggattagaagtaatccagacctgttgtggattcactgcagagtctttaaatgtgttatacggggttcaccactttaaaacaaaaattcagggacttgggataaatgaaaagtatggttttattgtatcttcttgtcaaacacctttacttgaggcaacaactgaagtataatttaattcagcaggaaatatcacacttggagggaaaacacacactaaaaaaaaaaaaaacccttaaattaaagccaaacattctttccaaggcacagcactggcattttcagattgacagcagaacgagtttgtttccgtgaaacaaaatcatgagtccagagtctgtttttgaaacagctttccacttcatctccctttctggggctcagggaacgatgctcgtggccttcctcagggccaggtagccggtgacgacgtcagagggcagcctccgaatgtaggaaaactcttcaatggtgctgaaccgcagtttgctctgggggtctgtgtagttggcctgggtgaaaagaggcacagggaagggcagaaagtttttgctggtagggatattttaagttcaagtttaaaaattttttctatttcactgaaagtgatatatattttcattatgtcttactctgccaccaagaacactaaatcactcactgtggcacaggctcattaaccttcccagactctagaaacacttcagggtatggacgagaggaaggggaatgaccacatcagactctgggactcttcttgttggtgcctcaagggctgcaacaggtccaagactgaattcatgatggtcatccctccctgccttcagactcctgcctctttccaacaaatgtcccaggtctgtgctcctcaaggcaggagccgacgcccagcatgctgggcatgtgcccctccctgctgtgctccacttacctccagcatgctcctttccagctcttccaacaccccctgcgccacttccatgcctccctgagcaactctgtagtgcatcaccagccattcacacccacccttcccctagaactgcggccaggatcttctttgcaacgtgcaattctgatcatgtcattcctcggcataaaatctctcaaaatggctcctctgctcttgggacaaaggcccaagtcctcagtgcagctcctcagctatgggccttcctttgtcctcagcctcctcctcagccacatgtccccactctctgattccaactgtccccggcctctaagttcctccctcttaccatgccccatctgtcctttccttggcaggggaccccaactgcagcccattttgctcagtaatcaccagttcattcttcaggactcggccccaaagctacacctctggggaagcctatttgtacccccacaggaggtcagaacctcaccctccactttcacagcagcaaaaatattccagtggaatgcacatctctgttgctttaaagtttattatctacatgactctttgatgatggtctaggctatgagggtccatgagacaggaaccacagtttgcttatcattgtagactggctcctagtgcaacgcagagtacacagagggcctccagtcagggtttgtataacaaaatgaatgactaatgaatgaataaacaaacagacaattgggaccatcacagaaaagagaacttgtttcccagacatatcaaaattctctcttggtctctgttccccatgtgccaagcggagaaaataattcactaactatatacctcaaagcacatgggcttctacggattttgaaacaaaagacatgagggtgagtcattttgagctcctttaaaaaaattataaaagatgccattaaagtctagacagataacatccaattattcaagtgtagatgtctactttaatgtggatcatctttgtgtggacctagactcacagtaatcctgtgatttaggaagggagggaacactcaataaaaaagcaacaagctgtcgggaacttatttataggcttctcatgccctaaaaagtcttccattttgccactgggaaccccccctaagtatttaactgctgtgtgttaggaaatgggattattcctaaaaggctaagattaactaatggctctatataaaacttcgatcccttggcttgatctagatgttacctttctgtactacatttcctttaatgacagtaatataaggaaaggcttaattagaaaaacagtgacaagtctcttctgagggatcctggcagtgagggaagttaggttaactagcaggagaggctgccctgcagttccgagcagagtgtaggcatgtgtgtctggcgtggaccatctggcctccatagacgaaccagcctcggctgagctccatgtctgtggctgcctcactcctaccagcaaactgtgctgagccggcccgcccaagttcagacctcactgccaagagggctgctgaataaacagtgcagaatacagagatcctgtggcaccaacaaaaaggttaccaacaaaaacctgaacagactgcactggacccaggggccaacatctaggattctgaatagaaggaaggatgccaagtgacacccaggagttgaacaagtaaagagcttcacacctacagtccaccctcctctggatgccatcctttgagcctgagtgaaataagcaaacgccaacttcccacagggaagccagcaaacagcttcaggccccccttgctgtagggtgacaggcagtattcacggcttgcccgtctcacccagaatacacttttcatagctctgtaacgagtgctgaacacaggtatgaccctgcatgtcttgctgccatgcctaggcacaggggaaagagtcacatggctggctaggaacaggtgtgtgtcaatgtaaatgtgaactaggctttactttttaattatgtaactttaaattatataagcaacagacgaacacgttctcctctaaaaagaattaaaagaaaacattacagataagactaaagtcctcatttatcaccatctaccatccaaaagtcctctgtcttccccaggagaaaccactgctaagtgggcacctttccagactttttatgtctacccctatacacatatgtaaacacacaagagaaataacccaatttgtgtgtgtgtgttgatttttatatatgtggcaccatgctgtttatattgctttgcatctttcaatcaacattacatcctggaaatttagccatgttgttactatgcattgagctcaagaacagtatgaaaatatccactgtgatagaccttgatgttgcttccagcattttgcgaatgcggtctctcataagcatttctgcatgaagttctttgtgcacactatttcttttttttttaattttattattattaaagttttagggtacatgtgcacaatgtgcaggtttgttacatatgtatacatgtgccatgttggtgtgctgcacccattaactcgtcatttagcattaggcatatctcctaatgctatccctcccccctccctgcaccccacaacattccccggagtgtgatgttccccttcctgtgtccatgtgttctcattgttcaattcccacctgagtgacaacatgcggtgtttggttttttgtccttgtgatagtttgctcagaatgatggtttccagtttcatccatgtccctacaaaggacatgaactcatcattttttatggctgcatagtattccatggtgtatatgtgccacattttcttaatccagtctatcgttgttggacatttgggttggctccaagtctttgctattgtgaatagtgctacaataaacatacatgtgcatgtgtctttatagcagcatgatttataatcctttgggtatatacccagtaatgggatggctgggtcaaatggtatttctagttctagattcttaaggaatcgccacactgtcttccacagcagttgaactagtttacactcccaccaacagtgtaaaagtgttcctatttctccacatcctctccagcacctgttgtttcctgacttttgaatgatcgccattctaactggtgtgagatggtatctcactgtggttttgatttgcatttctctgatggccagtgatgatgagcattttttcatgtgttttttggctgcataaatgtcttcttttgagaagtgtctgttcatatcctttgcccgctttttgatggggttgtttttttcttgtaaatttgtttgagttcattgtagattctggatattagccctttgtcagatgagtaggttgagaaaattttctcccattctgtaggttgcctgttcactgtgatggtagtttcttttgctgtgtgcacactatttctctagggagctgcctataaggcatattgcaaggtcagaggtttttcttttttttaatctcaacagactgctccaattgtcctccaaagaagcagtaccagtgtatgttcccacctcaaaacaacaatgtatgaagatacccatttctgtttgttggtgccaaaatgtataatcaaatgtcttaatttcttccctgtttgatgagtctttctcctaattactagtgaagctgaatatctacttattggtcatctatatttcttctctggcaattgcctatttatatcctttttgctgattcttctgtgggattgtcctttaatgaactaggagagttatctgtctattcagaacttcttatttcctacatacagtggggcaagaggttttaggtaatgtgtaatgtgacaagtccattgccaatgtcataaaggggcctggaataatgattctccctcctcctaatgtgtgaaaaccattgtactagcagatgagctgcctgaaacaataaggataaagctgacattctgaggaaccaccctccaagtctggccataaactgtggcctccagaaactcaaaatgacacagggagagatttccactttgggtcataacagaataactggtgccagatgagctctcttgccataaacgactattacaacaggccaaatacatgaagtagccattttcaggcaacagacaagaggtagcacaagactgcaatgcctgagaaaagagaagctcacaaggtaagttccaggatcatccaaactctctctgcctgtgacaatttcctgaccatggggcagaggtggagctcacgcagagctcagattcaggggctactgaaacacctgttattggcaaagctgagtaacagaagagggagctgccctggaagggaggcaaaagtcagtttgggattccacgtgagtccataaccatgggctgggctatgcatgttcaaggcaagactatatacgtcttactggagagtggttaagagggaaagagaaaatccagaggttgagcagtgctaggagttgctgaagtgccagcccagccagaatagagagatctctataacactcctggcacctagctcaggcaacagaaaggccacagcttgggaaaaaaaatcatgcccttgagtaccatctattctagtctcaccacaacaaagcctaacaccaaacttcagtaagactggcagaggataaagcacttagaagttaagtgcaactaagttaaaggagcttgggaaacatcatgggctttctgcagacctgtcctaacaaaggtgatcagtcagtaactgagctaccacaggaaaaaaatactcttcaaggaaagataacagaatctagagtttttacaatatatcatccataatgtccagtacacaatcaaaaacttgtagatgcaaagaaacaggaaaatgtgacgcacagttaagaaaaaaggcagtcaacagaaactggccaagatgaaccaaatgttggacacagcagataaatactttaaagcagctattatgtgttcaaggacttaaaatatacatatatatatatatatgtatatatatgtgtatatgtgtgtgtgtgtctatatatatatatatatatatatatatatatatatatacttaataactaagtagtcttaaaagacaaggaaatcaccagaaccagacccgaatatgatgtaggttttgaaactaccagacaggaaattcaaaataactataattaatatcttgaaggagttaaaggagagacaacatgcaagatagaaagttatttcaggtcaggcacggtggctcacattggtaatcccaacactttgggaggccaaggcaggaggatgacttgaggccgggagttcaggaccagcctgggcaacacagtaagaccccttctctataaaaaaaaatttaaaagccaggtgtggtggcacacacctgtagacctagcttccggggaggctgaagcacgtggatcgcttgagcccaggagtttgaggctgtagtgagctgtgatcacatcactgcactctagcctggattagagagcaagactctatctctaaataaataaataatttaaaagaaagttatttcatcagagacatgaaaactataataatcaaatagaaaagccagaaattaaaaacacaattagagagataaacgatgcttccaataggctcattggtatactctatacagtgagtaaagaacttgaagacacatcagtagataccatccaaactgaaccgcaacgaaataagagtttttaaaagcaaacaaaccagaacagagcatccaagagttttgggacactatcaaatagtttaacatgtgtgtaactggaatcctagaagaagggaaaaagacaaggcaaaagaaatatttgaagaaataatagccaagaattttccaaaattcttgacagataccaaaccacaaatccaaaacctcagagaacatcaagaatacataccagaaaaataataccctgagtcatattcaatacccagtcatattcaaactgctgaaaacaaaagacgaagagaagatcttgaaggcagtcaaacaagaaacattacatagagatgaacaaaggtaagaattatatcaaacttctcatcagaaaccatggaagcaaaaagacaacatttaaccactgacatcttaaaagtgatgaaagaaaaaactgtcagcccagacttgaaaatgtcattcaaaaatactcattgaaaatatcattcaaaaaggaagaacaaggctgggtgcagtggctcacgcctgtaatcccagcactttgggagaccaagacaggatgatcacttgagcccaggaatttgagaccaggcccgggcaacagggtgaaatcccatctctacaaaaaacacaaaaaattagccaggcatggtggcacacacctgtagccccagttacttgggaggctgaggtagatgcatcacctgagcctgggaggtcaagacggctgcagtgagccaagatggcatcactgcactccagcctgggcaacagagtaagaccctgtcttaaaaaaaaaaaaatgaagaagaaataaaggctctttgacaaaacaaaaaaagaaaggacttcgttagtagcaaatctactttataagaaaagcacagtaaattgttccagtagaaagaatatgacatcagattgcaacttggaaatagacaacaaaatgaaaaaaggtggaaacagaatgaaatgaagataaaagaaagttcttttttttcttatttttatttctctaaaaggtaactgtctaaagcacaaattaacagccatacattttgtttgtagcatatgtaaaagtaaactatatgacaacaaagaatgagagagtggaattagaaattcactactagaagtccctcacattatgcacaaagtggcaaaatatttgaaaatagattcaggttatttaaaatgtatattgtaaacatgaaagtaaccattcataatttgtaaaagaggtgtaaataataaggaaacaaacagaattttaaaatgttcaattaaccccagttttatcatgagaaaacatcagaggaattccagtagtggaggattctactaaatacctgactagtgctccttaaaactgttaaggtcattaaaaacaaggacaacctgagaaactggcagagccaagaggagtctaacgagacaggatgactaaatttgatatagttttaggtaaaaactaaggaaatgtgaataaattatagactttagttaataataatatataactattggttcattaattgtaacaaatataccatagatgttaataacagcagaaactgagtttgggttatatgggcactttctatactattgtctccgtttttcataaatctagaactgttctgaaaaatatagtctattaaaaaacgctcaataaatccagagaaggcagaaaaagggaaataagcaacacaaatggaacaaataacaactagtgagatggtagatttaaatacaaccatatcaacaatcactttaaagatgaatagcctaaggacaacagttcttagattgatagactggataaaaagcaagatccactgggtgcagaggctcacgtctttaatcccagcactttgagaggctgatgttgggagatcacttgagccaaggagttcaaggcttcagtgagttatgatcacaccactccattctagcctgggtaaaagagcaagactctacctccaaaagaaaaagaaaaagaaagacccaacaactcaacaatatgctttcaacaagaatccactttaaatatatagatagtttaaaagtgaaaagataggccaggtatggtggctcatacctgtaatcccagcactttgggaggccaaggcaggaggatcacttgaggtcaggagttcaagaccagcctggccaacatggcaaaacctcatctctactaaaaatacaaaaattagccaggcatggtggcgtgtgcctgtagtcccagctactcaggaggctgaggcaggataatcgcttgaacccaggaggtagaggctggagtgagccaagagcgtgccactgcactccagcctgggcaacacagtgagactctgtctcaaaaaaaagtgaaaagatcaagaaagatataccatccacacatgaacgaaagaaagctggggtaacgatattaatttcagacaaagtagacttcagaacaatgaatattatcagggacaaacagggatattacataataataacaaaggaggcaattctcctccgtacataattaatttggtcaatttgttagataagttggagtcatattttcattaaaatgtaaagtacttaaattatttttccaaatttatgagatgaaaaaggattaagaccctgacatgcaagagctaattaaaagaatctctaagttcatccatttgtttaagaaaacaaaacaaaacaaaacaaaacaaaacaaaaaaagatgaatcttaggttccaccttctgcaaataaggaaatgggggtgttctgaggttcctgagctttagcaacttgcccacttcccactatttcagctctgctggcagtttctgaattgtgttccccagaagcacttgagcagtcactgtggtggggagtggggaggaagataggcggccagatccacatgggaccacagcagaaaggtgggctccaggctgttatatattggattctgtaaaagatttcatttggaaaaggggttctgatgcttaaaaataagtttgaatgtcacaacctttgccaaagcacctgtttagagaagtttaaacatggttttgtaaatacaatcatcatctaaaatgcaggtttttaaaacttcagcagtaaaaaaagaaatacatagttgtttctttcatgttatctcatatagttaactagcagaggtaaagaagagaagctggagtctcctgctttctggttcaatcctccctgcaggctgcccccacagatgcctgtttgcagcaatgaacacactgcacaaacctatcacctatcactgtagacaggctccaggcaggaccagccatgatcaatattcaacacttgtctaattagacattactgtgaaatcttttccatttaatgttataagagatataatcatactcacaagcagacctgaaacatcagaatacttcttagctggcttaaaggatggaggagcatcaatactgaagtctgggaaaaaaaaaaaaaaaagataactaaactgaactgaaaacattcaaatcccttctctttttttttctaaaatagtatttgataatattcctgaaaatttcctttgtgattaagtagtcacagaagtctctggagattaactagagaagtaggggaggattctcagaaacaagacagtatgtcacaggccaagtgcaggctccagatctagccctgccctgtcaccagggaccctctattcccacagaaccaccggaaagctcatctgcccaccagctattttcacgatctcacactacatgggctgatggtgatgaaatgccaaatgagccaataactggatctgagcaccctgacaccctcatgtccacacccagacgaatgaatgactagctcacttgtcacccatgtgagtcacccccatgaaagaagtacagtggagtaggagatggtgagaactttgaacttgtactttccagtgaagctgaacagaacatataacagtgttttacataaatctggacacactgcagcatgaagtatttactaaacactggctcacaaagtataaaagagctggcctttaagctggttgtcaggaaccctcctaaatctggtattatacttgggctaccttgtttttggaaacacattttaagagtagacttttgaataagaagtttgtctagtagaaacaccaatattatcatattgggacctatgaccctaaaaaccacacatccatgacaacacaaacaaataggctcaatacagatacagttatgagaaaatacacacataatctgcccagactgatgccactataaaattctcaagctaaaaattatttcctacaatgatgcaaacacaatacaataatgtaggttgttataagacagttcctactctgaacattacaaacacatggaaggctctagacagctcacagttaggatcgttcagttgccacggcaatgccctttcagaagcgaggatttgtttcaggttcttccaggttctgttcttcttgccagctactgcgccaccgtggccagagtgcttgaattgaaggcatggattagaagaaacaaaaaccaatggagactaccatttcgacatctgacatttatgcctaatcataactgtaatatacctctcatctgtcaacaatcattaagacccctgagactttttttaaaaggtatttcactgtacacattaacatgttaatcttagtttaaaaaagaagttttcagattgtcaaaacccttgagttagtttgtgctggagtagaaataaaaggctacttctttatatgcacgtaaaaaaaaaagcctttattgggtctaactttgtagaattcattcatgaatttcttcatactttaagataaatttactacaaagtcagatttaaatccaggactgcatctctcaactcccttctcggggcaagtctctgccatgtaaactggggatcctggaaaagttgagaaagccccagttgcagtatgggtactcttctaggtacctctttttttttttttttatcctacaaagatgacacaataaaatggaaaagaataccaaaatctgttgcaaacactggtaatattgtatttccaaaactaattcattaaaaaaaaatttaacagtataatctgaactgctgcagtttattaccagtctcaagaatgaaaggaagaataccctgtgttctactccacagcacaacagcttggatttaccttatgaaactaatgaggaagtacttctcatttagctaaatatttcaagctttgtctaagattgtaagaccaatgaaaaggttaggggaacaatcatcatggaaatgtcccaccctccaaacagtatcctttaatgaatccacaaaggacacccaaatccttgggatatggcacattaaaagatcaacagaaagaacccttctcttgtccccatcttgcccataggggagaaggaggtaactgagactgagggaggagagaatgccagtgccaccctggctacaggcccagcaagatcagaggctgaggtgtggcatttggatgtttattcagctaataccttcgatgcttaccacaaagttgggatccttaaatggcaaaggtttggcagctttttccacaggtcctgtgctaaactcagagggcaccattttattctcactcatggcttccatgctgatacccttaaaacataataaaaatagtttgaagaagtcagtttctttcagctgagttccccacctctgctctcaacagggcatacgatgatgccacagggcatgcaagggaagacagtatgcccagagctccagcaggcagcctgccctaggggagggcacaccacacggggagtagcacctgctgtgcagaagccacaggagaaacaggccaggacctccaactgctatgtttcccgggtaccctaagtgccaagcacagggatggctgtcctacgcaagttagctcatttaattctgacaaccactccacagtaggtgctattatccccagcatacagaaaagaaaactgaggcccaggggaacaggttcaaggtcacatagtgattgagttttggattcaaacctaggttgggccagttctaaagccctcataatctccatgacaccacacagttctgacttccactgatcttatgaactctgtcttaaaatattaagacaacaaaggtccagcccctttaagggtctagttggccagagaacccagactggagctggtatgcttaagtggcacaacaggacatgggcattccaaggaaggaaaacggaaaaaaagctggagggccacaggtcagctggcagcagccagagagtgccctgacaagaacgctaatatggtttaaagcaaaaaacctttaagctaacaatcacaaagaaaaaacaagccaaagtaagaaaccacttctgatctgtaatacaatttcccatcttgccaggcttcaattaacttttaaaaaattgagatgtgatttacatacagtgaaatacacagatcttaaatgtagttgtcatgagttttgccaaaagtttacactagtacaattcctatccttgtcaataccttccagtcccaacggcaaccgctgttctaatttctaccacattacttctgcctgttggagaacttcgtataaacagcatttaacagcatgtactctagtgtctggattcttttgctcagcataaagtttctgagatgtggccaggcatggtggctcacacctgtaatcctagcactttgggaggctgaggtggttggatcacttgaggtcaggagttcaagaccagcctggccaacatggtgaaactccacctctactaaaaatacaaaaattagccacgcatggtgatgtgtgcctgtagacccagctactcgggaggctgaggcaggaaaatcacttgaacctgggaggcggaggctgcagtgagccgagatcatgccactgcactccagcctgggcaacagcgagactctactccgtctcaaaaacaaagaaaagtttctgagatgtatccatgttgttgcgtggatcagtctgtttcagtgtatttgcacactactcaacacaatagtattccacggtaaggaggcaccccaatttgtttattcattttcgtgttcgtggacgttcggttcattatcagtcttcagctattacaaataaagcctctgtgatgttttcatttctcttgggcaaatacctaggagtggaatggttgggttatagggtaagtgtatgtttaactttacaagtcactgccaaatcatgttccaaaggttgcatgcacccttcaaaaaaagagttaaggctaaaagtcatcatgttgtcatgtggaatgtggaagacactacatgattaactaaatcacagcttatctactctcagctggaattttagcaacttattctggttccctcatgctgataaggagctcaacttacttagtaagtgaaaatcttacttatcttagtaagagagtatggtggaatatgaatatatctacattcattcatgttgggggaagaggagtggagaagacaagaaccactcacattgctgcaatagttctttgggtgctctctcctcaaacaccttctctgacccctctccaggtctctccacctgagccggggttccagccaaggccctgtgctccctctcctctgtggccgccaccttctgtctggattccccttcacctcatcctctccacttctaaggtctttcttagcttttcttccctccaagctcagtgcaaatgtcaactttaagaactgagaggctgcccattcctcatccttttcctaccatctgtacccacagtgatctatctcttccttcctcccaccctcccttccgcaccccactctcccttcctcccacagtccttagcgtttatctggtaacttcctgagctatataattcagaggtgggactgtgcagtacacatcttgcctactccagccgattctctacagctcagccagtgacatacttttcaatgcaagcatgatgatgctccgctacttaaatctggccagtggtttctacttcccttgggattaggaacaaattcaggcctcctctccagcctcgcctcttgctccccatccttcctacattttgtcttttctggtgcgatatccatttagccattttctatacagcaaaaagagtctccaatttttccattttcatttatgctgtactaagattattttcattgggattcgtccatgtcagttttaattttacaacaaaggttagatttagtttttttttacataacttttattgcttgtatgattttttttcctttatagtcatcatatttctaccaggtacctgtactctgggagacccagtctgataaggaagatttgattctcccatcacatttcatcagtaacgaacattaccttgtgcagttttagccagctgtcaatgttattttgcactgactatttgtaagagtaacatctagtatatattgtatatatgattgatagtttagacaacacaacagcagctttatgatacacgcagggaacaacagatcagaagaaagggggacaaggagagaggggtagattcagagagtgaggatacacagagggctcaaaacatgctgctttacttcatagttcagcctctgtccctgcttctaacccagtgcctagcacagagtaggtaccaaataatgagtgattcattgattaactgatcaatgttaaggaacaagacagggtggtatgactgaatgccagcatcagcactggagatgtatatgctcagaagctccttacaaggaagcatctctggctgggatgcagtggccaaacacacaggaaggataacttggaaagaaacaactgagtgtggttacctgcaggggcagaggggaacatagtggaatggagagggagatgggaaggaaatagaagagagtaaatcttctctgagtatagctttttgtagagttttgactttttgaaccatgttaaggtttcatatacttgaaaaaataaataataaaatcaacaaggatgcggcaggggataaaaaatagaattttaaaaaccctgtaaacacaaattcacttgtgtttcaaataacataaccacactgaagtggaggcaagggagaaataacctgagtaactatgaatatggtattttgactatgtaatccaaggttaaaggccaaaaagaaccatacatagttggtaagtttgtttctcacaggggcacatgttaataattctgaaactactttatgtgtattctaagatacatagcaaatgtagaaaagcaaataagaaaagggggaaggccagaatgagtgctgtggaattggattgaaactagaggttatcaatatgagctcacagttttcagtatacaggcagataattacagaaatacatagagaggtgtgggtagtgcaggtatacacacacatatatttcctagctctgtgcactgagaagactggaaacaatgaacaataggcaaagcaacattcagatcatcctttctaaatacaatcagccctccatatagaggagttctgcatccatggattcaagcaaccacagacagaagacatttggtgggggaaaaatgcatcttgactaaacatgtacaaacttttttccttgtcattattccctaaactgtacaatataacaactatttacatggcatttacattgcattacctattataagtaatctagacgtggttgaagtatacaggaggatgtgcacaaattatatgcaacactatgctactttatttatatcagggacttgaggttccatggattttggtacccataggaggtcctggaaccaatccagcacatatactgagagacaagtgtattattctctaagaaccagtgatccatgaagaaatggctgactctagggctggagcaggaaagtataagactagaacatcttgtggtgtcagaaagaaagcacttgtgtcagtttattcagagtgctgtaacagaataccatagattgggtggcttatatgatagaaatttattttctccagttctggaggctagaagtccaagaacaacgtgttgacaagtttggtttctcctgaggctgtgtgcacccctggagtctctccctcttcttataacggcaccagtcatccaggattagggcccacccagacgacctcatttaatcttaattacctccctgaagtccctatctccagaatgtaactgaggtatactaggggtcaggacaaaataataaatactgggggcatgggggtaccaaaacttagtccataacagcacccaaaaaatgataggggcaaactaaaggacacgggagccagtttgaagaggctcctactggaccaatttcaaaaacttaagcaacaaaccagtatatacataaatccagaatatatgaagaactctacaactcaacaacaaaaagacaattcaatttttaaaagggcaaagaatttcttcaaagaagatatacaaacagccagtaagcacgtgaaaagatgctcaacatcactagtcattagggaaatgtaaatcaaaatcacaatgaaattccagtgcacactcactaggatggttacaatcaaagacaataacacatattggcaaagatgtgaagaaactggaaccctcatacattgctggtaagaacgtaaaatggtgcaaaaacaccattaaaaaaaaaacacaattgggaagtttctcaaaatgttaaccacagaattatcatatgacccaataatttaacttctaggtatacactcaaagagaatgaaaaacatatgtccatgcaaaaacttgtacacaaatattcatagcagcattattcataattgccaaaaggcataaacaacctaaatgtccatcagctgatgaagagataaaatgtggcagggccaagcacaggaactcatgcctgtaatcccaacactttgggaggctgaggcaggaggactgcttgaggccaagagttcaaaagtggcctaggcaacatggcaagaccctttctctacaaaaaataaaataaaaaagtaaccagttgtggtggcacttgcctgtagtcccagctactccagaggctgaggcaagttcaggagttcaaggttacagtatgctatgattgtgccactgccttccagcatgggcagcagagtgagcccctgtctctaaaagaaataaaaaataaaacacaaaatgtagtatgtccataaaatgtaatattattcaatcacaaaaagaaatggcattctgattcatgctctgtcacggataaatcttgaaaaaaattacactaacaaaaagaagccagacacaaaaggccacatattgtataattccatttatatgagatacgtagtcacattcagagacagaaagtagatcagtggttgccaggggctggcagaacaggggaatggaaagtgactgcttatgggtaatgagtttctctttggggtaacaggaatatcctaaaattagataggatattgtgagggttgcacaactcagtgaatatactataaaccactaaattatacactttaaaagggtgaattttatagtatgtgaattatatctcagtaaagctactacagataaacttataaaagaaggaatgaataaagctagtagtggattataacccatataataaaataaaaatccatgacataaatactgattttaaaaaatgaataaatggcctgttgtagttctggttactcgggagactgagaagggaggatcacttgaacccaggaggctgcactgcgctatgattgtgtctggcaatagccactgcattccagcccaggcaacatagcaatacccaatttcttaaaaaaaaaaaaaaaaaaaaaaaaattttaataggaaaaaaagaatgaatggaagagaagagaaagctgttgctcacaataggattctaattaataaatctaaaaggaatgaagattcaaattaggaaatcactacttgtcaaccaccacaataataactatttcaagcaaaagctatcaatggatattaaaagtcactggcaaagtatgaaataaaataggctatttatagtctcaaagtatcttcccacaagatacttcaatacaaacatgaaaagaataactttacattggagaaacctggcagataccaccttactaagtgctcaaatctaacatcattagtaatttgacatcaagtgccacaacaggatgcactgagaagatagcattacttctctatttttgccaaaaatatataactcaaatctaaccatgaggaaatatcagacaggcccaaattgaggaatattctagaaaataagtggccagtactcttcaagtgtcaaggtcattgtgttagtccattttcatgctgctgatacagacatacctaagactgggtaaattataaagaaaaagaggtttaatggactcacatttccacgcggctggggaggcctcacaatcatggcggaaggcaagaggcacgtcttacgtggcagcaggcaagagagagaatgaaagccaagtgaaaggggtttccccttataaaaccatcagatttcctgagagttattcactaccatgagaacagcatgggggaaactgcccccatgattcaattatatcccaccgggttcctcccacaacatgtgggaattttgggagctacaattcaagatgagatttgggtgagggcacagccaaactatcattccgcccccggcccctcccaaatctcatgtcctcacatgttaaaatcaatcatgccttcccagcagtccctcaaagtcttaactcatttcagcattaactcaaaagtccacagtccaaagtctcatccgagacaaggcaagtcccttccaccaatgagcctgtaaaatcaaaagcaagttagttacttcctagatacaatgagggtacaggcattggataaatacacccattccaaataggagaaataggccaaaacaaaggggctacaggacccacaccaagtctgaaatccagcagggcagtcaaatcctaaagctccaaaatgatctcctttgactccatgtctcacatccaagtcacactgatgcaagaaatgggttcccatggtcttgggcagctctgcccctgtggctttgcagggtatagcctccctcctggctactttcacaggctggcgttgagtgtctgtgtcttttccagtcacacagtgcaagctgttggtggatctaccattccgggctctgaaggacggtggctctcttctcacagctccgctaggcagtttcccagtggggactctgtttgggggattcaactccacatttcccttcctcaatgtcctagtagaggttctctgtaagggccctgcccctgcagcaaactttggcctggacatccaggcatttccatacatcctctgaaatgtaggtggaggttcccaaacctcaattcttgacttctgtgcacccacaggctcaacactatgtggaaactggccaggcttggagcttgcactctctgcagccgtggcccaagctctaccttggccccttttaccatggctggagtggctggaacacagggcaccaagttcccaggctgcgcacagcagaggggtccctgggtcagtcacctgaaacctttttttcccactaggcactgggcctgtgatgggaggggctgccacaaaggtctctgacatgccctagagacattttccccattgtcttggtgattaacatttggctcctcactgcttatgcaaatttctgcagccagcttgaatttctcctcagaaaatgggtttttattctctatcacattgtcaggctgcaaattttctggacttttatgctctgtttcccttttaaaacggaatgcttttaacagcacccaagtcacctcttgaatgctttgctgcttagaaatttcttctgccagatacccgaaatcatctccctcaagttcaaagttccacatacctctagggcaggggcaaaatgctgtcagtctctttgctaaaacatagcaacaaccacctttactccagttcccaacaaattcctcatctctatctgagatcaccccaacctggatttcattgtccatatcattatcagcattttggtcaaagccattcaacaagtctctaggaggttccaaactttctcacattttcctgtcttcttctgagccctccaaaccgttccaacctctgcctgttacccagttccaaagttgcttccacattttcgggtatctttacatacagcagcaacccactctaccggtaccaatttattgtattagtccattttcatgctgctgataaagacatacctaagactgggtaaattataaagaaaaagagatttaatggactcacagttccacgtggctggggaggcctcacaatcatggtggaaggcgaaaggcacgtcttacatggcagcaggcaagagagagaatgagaaccaagtgaaaggggtttcccattacaaaaccatcagatgttgtgaggattattcactaccatgagaacagtatgggagaaactgcccccatgatttagttatatcacactgggttcctcccacaacacatgggaattatgggagctacaattcaagatgagatttgggcaggggcacagccaaaccatatcagtcataaaagataaaaagactaaggaagtgttctgattacaggagactaaaaagatatgacaactaaatacaacgtgtgatcctggattggattctgaaccagataagggacaagaataaagtctgtgtattaaatatcagtgttgtatcagagttaacttcctgaatttgataaaatttggaatgatctctcctcactaccttcccacactcctctccagggcctctgcatgtgggcatctgggccctcctctgttaacacccctcttctgtctggactgcccctcacttcatctttcccccatgcacggtctttcctaactgtccttatgtaagagaatgactttggttttaagaaattcacactgaaatatttagaggattaaaaaaaaaaaatacagtgaccaagtgaagcctccccaagaggcacacccagctgcgaatgagccagaggtcatgactcctggttcctgagaaggaaggtggagctggcatgcagggcaggaagggtgacaagtgatcgctctttcaggaggtggtggtacaaaggcaaaggagaaagcccaggcccactggaaggaacatggggtgagccggtccaaggagacccgccagcattagcagaaggaaagcaaccattctcccaatcatctaaccattcatagagtgtgccacaggactactcaatgccctggactgtcaggagactgggcctacgagtggcctaaattaaattagcaggagagataaccctgagagctatccagtaagcaccacgtcaaaagaaaaacaaaacacccccactagggacaacttcaggtctaattcagggtaaacaggctatgaaagagatttcctggggccagatatgctttaagtttcaactttatcgtttgagtttctcataaagaatatgactactgatataatactgttgccatcagggaggaaaaaaccaatctgaactgttaaagagcaaaaaggacacactaaagggaaagggaaaatgcagtccccaaagcttccaacagcgattacagaaccatccacatacctgccagctcccagggtcctatcctcaggcagtggagttcgctttttcttccactccagagatgttcaaaaactgcatttctttttttattattttgttgttgttgttgagatagggtctcgctctgtcacccacgctgcagtgcagtggcacaatcacagatcactgcagcctcaacctcctgggctcaagccatcttctcacctcagcccccactcatgagtagctaggactacgggtgcacactactatgcccagctaacttttgtatttttgtagagacaaggtttcaccatgttgcccacagtggtctcgaactcctggactcaagtggtctgcccacctgggcctcccaaagtgctgggattccaggtgtgagccactgcgcctggccaaatactgttatttctccttttcagtttattccacttccccaatcccagtgaggaagctcaaaggtgctgtgtgcccaatgaaaggaaagcaatacagggggattcttctgacataggcgtttagttccaaggccccagggagacaggggagaaaaatgccagacaggggccctcgttagattcaggcagacaagcacgtctgctgagagtaaggagagggtggtaatgaagagaggaccagaggtctaagtcagccattccaggcagcaagctagagaagagtcaagaagaggatgaaaatgacacacggaagcactggtttttgaaagggacccctcctgccggcttgctcactccatcctctgccagacccccgctgggaagtcaggctgaagagagggcagagaaaggaagccaccctggagtgaactgagccacatcataccagtgctgcctcctgcttctgagattgtggcaggctcccttccttctctaaccagagacacccctgccccaggccagagctggttttatgcttcactttcctctcccccgacccccacattactacacccttagcctagctgagactcctgtgtctactaacaacaggatgagagggagacagacctttagtcaaagggaagatcaagtctgtgaggcttggatgcaataagataaaattaaaatgatgcatcatttccatattactaaagcactattatcactaaggactttacaagatgaactgtcccgccccaagatatgaacaccctaagaggagaggaaggaacgcctagcactaaggggcgccccctctttgcagcactaacagagctgatgtaagtctcagggaagagaaatccagcctgctactcaggaaacacacgcctatgctaatagactggagttcacaaggcctgggtctcgccctgctctgctctgcccaactgaagaacccaaatcaatggcttcatctctccagacagtagtgtgcttgactctgaatcagactaaaggataatttggacattctgtctgtggttacaaagaaaggagaaaaatatcctttgtcttattactgaaaagtcaaatgtcaagttatatctatgtcatagaattatagatgcaaatagctgaccctggtctaaaactgcaaggttactatagggttacttaaaacagcaaaaattcaaaatgcaacctcaatatccaataataaagtcaattaaatatgagtagttaattccttggaatataatgcagtcaatagtcataaaagactatttgacttttaaaagtctaattgagaagactatcaacacatagaaatgttcacaaaataatgctaagtgaaaaacggggcacgtaatactatataccaaatataatgatgaaaaactgtatctacatgtagaaaacacaaattataatagttgttggggaaggagattgggtgactttttatgtcaattttaaaaatgaaaaaaaaggtaattttaaaaatagaaaagaataacttttaagacttaaaattatcaggatttgttgaatttttacttttgtgttttacaaaagttgaatagtaggatgactattttttcaatgaataaaccaaatcagtccagcattatctggctgcccctccaattacagaagattctctcattatctgccctatcctcctaaagatgcaactactgcctctccactttagatgttttattagctgcttcacaaatgaagaggctattaagtaactctcagtctataggttaattagatttctcagtacattttatcaactttaatacacatttgaaaagcctaaattaccctatattgattcagtaaaactgttgccaaaagcatttctctgtaccatgaatttggttataccagagatctaattaataatcttctaatatacaaagtaacagagtgatatcaagagaggcagttaagaaaaaagaatgtagactctggacggcatgcctgggttcgaatcccgacactaacactgtgtgagcttgggcaagttacacagtctctctatgctcttggcgtttttatctgtaaaatgaagtgatcaattcacagagggtcgtttggagaattaaatgacatagtacttagaaagtacatagaacagtgcctggcatgtagtaaatgcttgataaatattaattactattatttatccttattcctttcactttaacagttatctgttccccaacccaccaaaattaatcccttcaaagtaacaaccagagtgaatggaagactgcactttcataacattattaatcaacaactgttatagtgaaaatataaatccacagaattgtgattctaagatgatttgtaccaccccttagcaagcatgaacattagtagtaatttctgctgaactagagagagccatcttgatgaaatgataaaacaaagttgtttttgtactactaaattatttaatagtatttcctaacactgatgtaaagaaggcttctataaatgcttttctcagaatacttttagctgaaaaatattcccttcaactcctcaggacttctaagcatctaaatttctaaacttctttaaatttcaactaagcactcaattttactttagaaacagcaagcatatttcaggaaagttaaacccaccttaagaatccatgataattcaagttatctttaacaatctcaaaaggcactctaatgtcctacacgtaaatgtgctttgtaaattttaaaattccatgaaagttttacatactttgcctttacttaagaatcaaaatagctaaaattactgacgtagggaaatttacgtgatgaaagacctataaaatctcctctaactcaagaaatacaatcatttatagaaaaacactcacttccccactaagggaaccttgggcaacctgggttaatctcacaatgagcacagctctgaacctggaatgccttctccagcaaacctctccaagccaacttcaagtccctctgcctccctacctctcctttgagtaccatcaccagcactgaggaatcatcctcctgtgtctcaccacaatagggcaccaacacctataattacctataattagctttggctcaaggttagacattactatatcttcctaatggtttcatttgtgtgataggtagaattccagtacacccctgctaccttgcaagtactctgcccctggtgtgcacacaatttctccgagttattcaagcagacactaatctaggtgcagctacaaaggggttttgcagatgtaattaaggtctcaaatcagctgacttttaaaaaaggtgattatccaagtaggcctgcctaatcacataaatcttttaaatctgagtccaggggtcagcaataaaagaagtctgaaatatctgaagcatgagaagaattggacacaagggagattctccatagctggctctgaaaatggaaaacgccatgtggcaaggaacacgggcagcagctgacagccagcaagaagacaggggccctgcagtcctgccgccccaaaagaacagaattctgccaacaacctgaattcacctgcatgcaaatttctccccagagccttcagacaagaactcggctaacactttgatttcagctttgtgatacccagagcagagagtcaacccagttgcattgtgtcaggacttctgacctacagaaccatgagctactaaatgagtgttatttaagccactaaatttgtgataatttgtaatgacagcagtagaaaactaaacacaatgtatatacgtcattctctcctgggatgtttttggtagtgtggggacaagctataatcctttgaaatgtcttaagcatactgctggggatggaacagaaacagtacaataaattactgctacatgaactgaactgaaacagaacagaaaggttgggcaagtgacacagatgagggtgacctcaagaagattcctggcagccctcaggggtactgtgcttatgcctgcttatttcctatacgctgtgaaaagggaactagaatgaaaggatcacagcaaggcaaaaatctaagacaaccgggcacagtggctcatgcctgtaatccctaaactttgggaggccaatgtgggcagattgcttgaccccaggagtttgagacgagcttgggttatgtggtgaaattccacctctaccaaaaatacaatggtggcatgcacctgtcgtcccagctacttgggaggctgaggtgggaggatccactgagccaggaggtcgaggctgcagtgagccatgattgtgccactgtcctccagcctgggtgacagaagaagaccctgtcttctttagtaaatatcagttgggaaaaggagagtcaggacaaaagaaggcactatttcatgaaatgctctgccctttccagcttctcctgaggctgctgcttggatacaaaaaaggcccagagggaatagagagttaagatttccaccatattggattactgggaatttccagtctcctgaaggcatttgaccactttcagaagcttgtggtagtggaagttgatcaacaatccctttggggtcaaaacaattattcctacccatatgtcctagtgacactccttggtcctggcacaactggttatcaaaacgcaccagtcgcaggctgggagcaattactcacaatacatacatctggcaaaggagtctaatcaagaaagataatgtaatgaacttctacacatcaatataatttttttttaaaagccaattagaaaaaaataattaggcactccacaaaagatctggaatgtccaacaagctcatgaaaagtgattgatatcattagccatcagagaaacaaattaaaacaaggagatactactacacactcaacaaaatggctaaaagttaaagactgacaatgaaagactgacaatactctgtattgttgaggatttcgagcaactggcactctcatactttgccggtaagaatgcaaaaacagtgcaactactttgagaaatactgtttaacagttactgagttaaatgtatgcctaccttctgactcagcaattccactacttctcaagagaaatgaaagcatctatctacacaaagacttgtacaagaatgttcagagcagcttctgcacaaagccaaaaactgtaaacgttcaaatattcatcgggtgtatgtttatacaatgcaacagatgtactaaacgactctcaaaaacattgtctcaaaaaggaacctagacagatgcaaaagaatatgttccctattgtcctgtattattccatttatattatgttccaacccaaagtcagtctattgtgaagggtggctgaacagtgggtaactgttaggaaggaaagacagtactgacaggaaaatgtcacctgctcttagaaatgctatcttgatccaggcagtggccataggtgtatacaaatgtaaaagggcactggatctgtagttttgttttgttttgttttgtttgcgataggctcactctgttgcccaagctggactgcaatggcacgatcatagctcgctgtaaccttgaaatcttgggcttaagtgatgctcttgtagttgggactaaaggcgtgcaccatcacgcccagctatttgtaaatttggatgggggttggggagcaggtctcgaactcctgtcctcaagcaatcctctcaccttggcctctcaaagtgctgggatacaggcgtgagacaggattcttgaagatctgtggttcagccagtattcttgaaaatttgtgcattgtactctgtgtaaatcttactatagcaaagtatttaatattaaaaggttaaaataaaaagcactaccaatcacctacagaagaaggaacaagatttctagaacagccactgactgactgggtgaacggtggtgtcacaccatatgctgaggagcacaaagtaacacactctatctctgcttttttgctttgaataaaatgcaggagccagagaaaacactaatcaagccactccctgctgaaaattcattgctggaattacggaacctagattgttcagaggccctgacgtctgagccaggcgctgagctcagtgcctttacactcattacttcataaccttaacaagcccatgagttaagaccaaacctgcctttggattgggaaacccagggtcaaaaaagcacttttctcaggatgagagaaagcatacttatcaatacatcttgtattcatccatgcaggacattacagcgctatgcgcctcaaagacactgggtagatgtctgcagaatggacgaggggaagacacgcaaatttctgaatgactgacactcattagtcctgaacctcatgctaaaggcgacctcgaggggaagaggcagtccttctattaatactaagtcagtaataacctccctacttcttcttctctccttacaacacaaggcgttgtaagcccatgtgtccaaacgaagggaaagagtagtcattcactccgcggggcagcgtctttcaaccccaacggagaccgcacgcgcagcgccccacattacgcacgcgccctggctcggctccgccccgccaagtcccgtttcgcgacgcgcacgcgcagcctgggagcgcgactgcgtacctgcgcaaagctggaagcggacgcttttttcttcttactggcgccatagcccccgccgctgctgccattgtgggaagggctggccggcctcttcttgctgttccggactattccgggagtggaagtggtggccacaattggaatttgcgccgccatcgcactccgagtcttcccctggtccccccacctttttcccagcgcgggccttggaacttcctttccgctgttacttccgtcttgatgcttgaaaacccggcctggactccaagctgtagctggcttctctcggtgcaatctaaaaggcggagctcggagtagcctgtgccgtcgggacgggaagatgtcagcgggcgttgtcctgccactcgggcgctctgggcgtgggccttgggtggggcacgtgcctggaaatccccattgatagaggaatagaaaatctcccaatctttttaagtaactacgttttaaaaaattaatgagcgtgttgtcttttctcatatagaagagtgattacttttgatgtctgtaagcctaaagctggggtcgttctcagtagaccgccaagctactggcttctccctctatccctccctgccttcccacgcggaaaaggtttgtatataaatagcgcccaaatggacatgaagggtagagtggttcttaatctctccctttttttttttcttttatttgagacggagtttcgctcttgttgtccaggctggagtgcaatggcgcgatctcggctcactgcaaactccgcctcccgggttcaagcgattctcctgcctcagcctcccgagtagctgggatcacaggcatgtgccaccatgcccggctaattttgtatttttagtagagacggggtttctccatgttggtcaggctggtctcgagctcccgacctcaggtgatctgcccgcctcggcctccctaagtgctgggattacaggcgtaagccaccacgcccggccggttcttaatctcttaggattcacagactcttgagcatggaatctgtgcttcctatccctgccgcacacccccacctccccaccaccccattaaatgtatacagacacagacaaaattttacagatttcagggaggtcacagatctactaaaacctatttaggaacctgagtccccctacccgccttgttctttgcctcattctaccctatatttttacagaacctttgcgacatcatataactaaatgatttataatcggatggttaatgtcttttttggctcctgctagaatgtaatctgtatgagggaagggtcagttatgtcttgttaacttatcagtccccccaatcacagtaccttgcaagtcattggtgcattataagtatttttaatgatgtatttaacgaatgaactaactccctgcagtgattggtggaagctactatgtttgaatacaggaagttgatgtatatgagtcttgatatttgaaataaacaggctgcacaatgacttagaggtgagagagaaggagcagttagggaaacttgcaatattgttactgacatattttttcctttagagaaaggaataagcctaccagtgttgaaatgttctttcccacaccccatctccatccctatcctcatctaaagctagtcttttcctcattccttaactcaaggactcacctccaacaagccagtcacctaagcaaactctactgtccccacctcctcccattcctcacctcctcagctcgcttctctccttcacggctcctgccctggtgaatctgtatcccatgtctacatctcagcaacagcctccagatggacgtttcggccgccatctttcccttatccattcctgaccccagaccatccttcacactggctgccagaatgggatttctaaattacaaatataatcataccacttactttcttacattcttcagggcccttttgccttcagggtaaaattttttttttaccttcagggtaagaacgttttggcttgtcatacaaggtccttaatgactgggctctgggccgggcgcggtggctcacacctgtaatcccaacactttgagaggctgaggcgggcagatcacaaggtcaggagataaaggccatcctgtccaacacggtgaaacctcgtctctactaaaaatacaaaaattagctgagtatggtggcatgcgcctgtaatcccagctactcagaaggctgaggcaggagaatcgcttgaacccgggagattgcagtgagcagagatcgtgccactgcactccagcctggcaacagagcaagactccgcctcaaaacgacaacaacaacaacaacaacaacaactgggctgtgccccattctgttgcttggttcccaacacttaattccttgtgttccagccaaggactaactctatttcctagaatgtatatgttttcttagcttgtcatatttttgtttctattatttcctctcctgggaatgcttagctccttgcctgattaccatccattttgcctcagttcagatgctacttccaatgaaaagctttctgccatctgacacaccttccttccccttccctttccctgtcctcacgctgtgcacgtgagcacagggggacctgctgggctgcttcctgtcatcccttattgagttcaaacaccaactccctacttttaaggagtcagacaagtggatgcaccgccatctggtttcctgttactaaattcaggcctgatcttgtctgattcctttctttctgaaattcttcccttggtatctgaaacatcaccatctttttgttttcctctttcctggccagtcttctgttaccaaatggtctctaatgctactacaggtttttcaaaatatatagtcacatgctcctgtagattcacattttaaaagtttcccaagtgattctaatgatcagccaggtttgaaaccagactcttgcacagaatccttacatattgagagttccttggtgcttggtccaaggccctctgctcttctcagttgatactctccccagccattgcaccatttcttgcggattcagttaccacctaaatgcagaccactttcagatttgcatcctttatctggctctttctccaaagatgcatacccaaggccaggtatggtggctcatgtctgtaatcccaacactttgggaagccgaggcgagtggatcacttgaggtcaggagttcaagtccagcctggccaacatgggtgaaacctcgtctctactaaaaaaatacaaaaattagccaagcatggtggggcctgcctgtagccccagctacttgggagactgaggcacaagaatcacttgaactcggagggtggaggtttcagtgagcctgggcgacagaggaagactccgtctcaaaaaaaaaaaaaaaaaagcatacctggacgtaaaattcctttccctagtataaactcagatgcttacacgcatctttcactccgcatggcaaaaacagaattcatcatcctctctgctcctctaaaacagattcctccttcagtgtttcctgtctcagcaaatgccacgattagccaccagttcttcagaccaaaacttgggagtcatccttgactcctccccttcctccactccacaccataaccgtattccagccaccatctctctctggacttgcaaagtggccttatgcgttctctttctgcctccacctttggtccgtgcaacccagttccaacatgcgattccagatgatttctttaaagatacaaatgtgcatttttcagatcacaccgcctgcttgaaaccattcagtggcttcctgtggtccctagaatgaagcccattgtccacgaggtggttccaaaggtccttagagacctgccatctctccagcttgcctctgtcccaggtccctgcactcctgctcagttttcacttttgttagttccaacaaccagctgtgcccctcctccctcaggccttgacacactgctcctcctgcctggaagctgcttttctcccgaccccaccctcctctggtctcactaaattccacgcacccttcctatcttggctgacatgctacattttcagtgttccctctcctctggtctggttccacattcccatcagtctctctcagttatttaatccctgttgattacctttttttctttttttttgggaggatctttctatgtagcccagtacatacatttctagtagggaaggaaagatattatatttgtcttctcagctggacttaagcttcctataggcagttgccagagtcatcagggattgagtggcagagcatcaacagatgacagcaacaaggagagtgggagaaatgctggaggacattggcttgagaaacctgccccatgatcaccgtggtagtgccagttactaccagtgttggcacataccaggatcccatatacttgctgcatatgtaactcatgggtttccttgtccattggtaaagataaattaatactgatgactcaacattctgctagcttatgtgttgagacagggcctaaggctgccctaagttccctcctcagttattcctgaaaacttgcagggtgtgtctcacccctgccgtagtgtgcgccctctcttgcacttcctcttcagcttccttcctggtacttgcagctcctgtttccctcaccaatgccacacttcctttggcaaaggctgctggggctttctctgggatattgatgccctgactgcggtgtaccagttaagcagcctcagccagagtcttgatcccagttaagacaatgattaagaatgaataatgtgcctgctaagctactatgtatgacttgagacacagagtgccgaatttactgtctctcaaagatctcagcaaacacagtagatatttgggatcatgctgctattgcatggaagacacactgctcttctcttgacaccttgtgtgaagtgtgctagtcatgctcactgtatgaaaaatggctgttccagttgatatgggactccttgatgaagggaagaaaccttgaagctgttgcagtcaagatgctcaaaatcccccaactcccagatactgaaagaggcagcttagtgtgcactgtctactctgagctctggggacgtgcagttgaaaacaaacccattgcagtgagaagctgatggaatcctcagagaccagtggcagtcctctcaggagtgtgagagcagcactcattcctggaacaccatctctgaggaaccttcctaaagtagcctgtgttttctccatcacagaccaaagtatatcgtttggtaagtgcttgtgggtcacaggctcacttgagcagacacagtttcttctttgtcgctgttttcagagtattgcagtccctcggtggcaatctgctatgtgcctcattgtaaacaatcagtattaatagagagagcagaagagagctcgggcccagtggatgctggggacaggcctttgctcacttcattgcctgctatttcttgcctgacagccgcatggaaatatttaaaagctggaaagagtaattgaaaataggcctgactgtgacatttccagggttcagggcaagagtacaaatggaggcctacctaccatatgccttgatatttaagtgtacaaagcaagctaataacatgtaaaataaaatatgttctacccttctatcttggcaaatgtatctttataacccagaaggccagagttgaatttagaatgctcagatttcttggagttctgctcagaatgtggtagggtgggaagagctgttccagccctgagccccccttttcccccctactcctcagggcatctggaggaaacatgtgtgtacacctgtggaaacctcttgactaccccctcaagcctttggggatatacatcaagtgcaaggacaaggtccacaggggccctcccagggggcacagggccgtttgagcatgaggttctggggtcccaagcaccagagcatgttctaaaaggagggagccatggacttgggttgacacatttccctgtgtccctattcactctgctcagtgtggaaaggcagagccagaaagaggggcttcttgcccaggctgtgcgtcacaggcctgtgctcagagtgttaagtaggaagacaccagatgaggagcagaagccaggtgcatggagctccagcctcctttaaactggagtgggagaggggaaggcaggtccaggaggagatccagttgagatggcagaaagttgatgtgatttccatctctaagcctgggttttctcagtaacaggagaggtaacaggtagcaacccctgcaaggtggagggagagtggtagaggcttaggaagggtcgtaggaagatttggaaaagccacactttaaaggtaccattagagagagagctgagaagggacctgtgagaaacctcctggcagtgccgagtggcacatctgcttgggcaggttgggcacagctgaagtccagaagcaccctttattgtggttactgtgtgtatgtatggcaaccctcgagttgggcactgcacatcttacacagtaggaagacatacttggtgcatccaaactcatgcaatctactctctgaattttgacctcaacagataatactgctttgcaaagtctgaaggagagaaaatagttttaagggccattttgcttactggaattacttcttaaatccatgcctgttaagtaaacaccaatttaacattacaaatatggcccagaaaggctgacacaggactttccaaatagtggggtgcttgccttccattgtgaaaggcaggattctgctcccaggatggtatttttctgtcttttgttgcccacctctgtgaatccccttctgggcactggtcgtccctttctctcttaccagaggtcccacccattatttaaaatgaattattgttttaacacttactgtttgtgcataccatagagaaagaaaacaattataattactataattctcccatctctgatatttttttccctgttttctctctcataacctcaaatttgctaatccccaggctgtgacaacacctgccttcttaaattgtcagcctgctttgattattttccccagcatcatggttcctaacccccactgctgtgttgcttgttttggttgtttttattcacatgtgacaccttgtttctgtcagctgtacattaagatagtatcagagaagatcaatccacaagctttgggcacattcactaatggaataaaacagagacaatatggaagcttagagatgttcattgtctaagttcaccaagaaatccccaaagactgagaaattgaggcctcctccaggtatcccatatgtacccctctctagacattgctgctgttgctgctccaaagtaggtgagctaaccagtccagctcccaggtgtgacccagccctgggaacaggggcagggcgagaagagggtatggccaagggagggagacccattctgggcaaaggacctgtgacaggcagggctgtcagcggtcttcttccttggcatggcactggacagaacccaaaggatagtgggacagtccccatccctcactttgtcgaaagacgatggccattgtttggaagaacaagagaggaaatgtgctcacagttttttagagaatcttcattctatagagaaagactcaaactacttaggatgccctatgacctatctgtttatctcgcctttcatctctcacatttgggctcccaaatgttgactgggttctgacccagtccagccaccctgccctccatcccagttctctcagggatcttggggtcccagcctggctcagcgtctgccctgcctctttcgatctcaatccctggacttgtgtgtaaagtggcttctagcccctttccttatcccatgttcacttttgcaattccctgacgctgttgtgaagcactttccgaagagttctagttcattctccatctacttgcactgaggatttgaactttttgtaaggattggggattgtcagtgtgaactgaacatcagtttttgtgctctgctataatgcaaggaacctctcatgagcaggtcgataaggcatttctccctatgctaaatggccctgcactagtatgcagtttgagtttttgccttctgatttcatttctgccattaaagggctggcttcagacatctcccgtagcacacccataaacataatagattttctgtttttaatatgttgtggactgaagtgatcaaccaccacaggtgttagaaatatgtctaaaataatcacagaaacccacgagtgaggccttggtggggacagggtgggtgtcccaagaccagaggcatgtgcttcagtgtgtggacttttgagaatttagtttagctgatctgattaatggcctttttgggtaatttttaacctctttttggcttcagtttccttatctctaaaatgagctaaccaattttgtttatctgagttgtcagacatttttaagtaaacatttttttaaggcataacacataaaaaatgtgcacaaatcatttgtggacagccacgtgaatttttacaaagtaaacatacttggtaatccagcttacgaaacagaatgttatcagcacctaaaagcccctgcttcatgcccattgccaatccccaaggttaccactttcctggcttcaaccaccagagattagttctgagctttatagaaatgtaatcagtcgtgtactgtatgtattcttgtgtgtctgccttggaggagattccttttgcagcatgtagcagtacttcattgtcgtggctgtatggttttccactgtgagaacaagccacagtgtaactattcatctgctggacatttaggttgtttccagggtcttctggctcttttgaatgaagctgctttgaacattgtgcatacatatctttcagcctacataggtaaacttctgttggattatatcaagaatgaaattgttgggtcacagagtatactttaatagatacttccatttgacaagtggttgtaccaatttaccttcccaccagcagcaaacgagagttccactcatctacaccaaggattttttcattgcacttgatactacataactatatttgccaaacaaatgccccgagcaagcggagaggcagtgggatatagcagaaatcacactcaggtaaaacctcaagtgaaggatgcaatagttctggacgaggaagttattacttgtaaagcagtgatgatctataagactactttcatctatgaaagtcttggctttttttgtgattttcatgagaagtgctacctttgtcacatactttctggtgtctccctgtgacaggcccaggacagctctgggtggaccctaaacaacagacatatacacatttgccatagatgtactgcttcaagtgcagagatttaattggtgcagggacactgacgacctaaagggctttggaaacaagtgtgggaaagaacaagagaaatttgcaagaagagttcttggtcccagagtggagtcattttgttctggagagtaaggctgagctggcaggatggtcagagtgtgaaagagctagtggcagaggcagtgctacaaccaccgtggatgacacgcacctactctttcatgcctggccaaggcaggtgggatgctgctgcctgtgcctgcctcctctcacaaagctctcctgcatgaaatttgaggtgggccactgggtgggtgggtggagcctgtagcctgtgctcaggccctcacagcaagagagacttgaaaaatttctatcttacatttttggctttttagaacgatgaagtcttcaaacctaaaaatgggtgcaaatattggaccgctagggctatggctactgatgatactaagagctaaagtgattgccagttgtttacccttcctggagttttaaaaaaatcacaactaaagagcatcagaacattattttgttccttattgttttctatagttaaagctcccaggatccacaccttcaacccaccccgcccccaaagtacacaattgtcacatgtccagaagtgacacaacttctcaaaaccatgcaaaatatgcgggaggacttgtcaaaccaagaggtggccagagcaagccactatagtttcccattatctgaagtagccatctgcaaggcaagggcttgttcctagtcccagaacgtaatggttcatgattcctcaattaaagatttgaatgctttcactctatccttcaagcaaagatctcaccaggtacttattctgagagcaaaggaaatctccttcctcccacccgtccagatgcccagccacacactaacaaatgcacacacatcacaaacaccggtgttgtcctccttagcccttggccctcctggccattccctgtggggctggcccgatgagctggcttttgtgtcactgggtgctcttcctgaggccagctatgggcagattatgaaactgccgcatctgccctttctctccccagcctcacctcatgcctatacggtccttcctcctgtacctccttctgtcatgagggcttttcttccacttcccctaccccctgctatagggcaagcaatgaattaactcagtatgggaggaggggactccttacagaagaataagaccaaaaatatcttatatataggagccccagcacctctccaaactcctggagagccaccgtaggcacggctttgaccctgaggcctcttaaaaggcagatgcttcccccagaaaggttgagtgtttaatcaccaatccctggtgtctcactttgagttattttgtcagatcactttcctctgagccaggagaagtctttaggatggaaagagcttgtaaaagtcaacagagagagaacagaataataaggagggtacccctgctaagagagctgatccaggatcctcttgtcccgtgccccttcctcttgctaaccagcatgcctctgccccacccgagagaaggagagatgcaacccaagctggctgcctgcacagcgtgctccagggtcctgctacagcttagcaggtatcagtccccatcttcagcctgacccccagcccctcttcgagcacctagtctagaccttggtcttcaaatcccaaatcctcaaacctccctgttacattcctaatggatcccattgcttccctggtcactcaatatgaatgtagcaaatccaaacgctggaatagcgctttccagtttgaaagcactttgacacaatcttactccatttaagcgtcacaacaaatctgccagtgggctactattatgctcactccatcacttaggaaacagattccaagagattaaaggatgttttaaggtcacacagctacatagtggtcctgctggtttgcatcagcaatgtatctgatgtcccgttgtgtgctggagaacatcagaggcattcctggcagacctctcccctcttctcagtgccaggcctgagccaatcaaagccctgctgcttctttcttgctcactgcactggccagactgttcagtacaatgctgaatagaagccatgagcacagacatccctatctccctcccagtcttagagggaaagcattcatctttgacccttaagtatgatgttagctgcaggtgttctgtagatgttctttatcaagtgaggaagttcccttttatttctgaaagtcttaaatatggaatggaggttggatttcttcaaatgcttattctgcatctagtaaggatatcatatactttttcctttcattctgttaatatggcaaattcgattggtttttgaatgttaaaccaaccctgaattcctgggttaaatctcactttattataatgtattacccttgtagtaacattggatttaatttgctacaaatttgtcatgagtttttgcttttggtattagggtaatgctgtcctcataggctgagttgaaaagtattccctcctctttgattttctggaagacttataatattatgtattatttcttccataagtgtttggtcgaattttccagtgcagatatctatggctgttttgaggctctctggttgttatttaaaaataaccataataatccaggaaatgtcaacaactgacaattccaattgctgttgtcagcatcaacatccttaccaacagtatttagtgtcattatttttaatcatccctgctagctcacaagaagaatgaagctggcatctgaataatgttctagtggtgggctgagttcataaagagcctctgtcacatttaacccgaatctttcagaaaccagcagattctgagaatgagtactactccagatgccttagtgatgttttcagctccctcactcgggacccttggccaggcaggagtcctcagcacagctggttctcaccccttcctctgccactcatggtctccacccctcaaacaacatattctctcttttgcactcttcagttttgctccatccttccaggcccagctggcatccatctaacttccctgagactctgtcaacacctcacagacctttctccaaattcctgtcaccctgacagccagaactacgccactgagcctcttgttaagcactaccttatgctattttctcattggttcttgaatgtttttctaattagattataaactgcttttctcatattgcctcagagcacctgatatgtggttgactgctttaagagcagcattatagcacattgcataggaattcccgatgcaatttcctgatgcctgcttattctgcagcagctccactggaaagcaaataccagggaggatgtctttttatttacgactttctcttctaagtgattgcccatgttatatgtcaggtctgtgtatctcttaaacattacttggctttcttaatggcaaaatgactgacctgatttttcaatgaaaaatctaaaagcatatatgacaaaagtcagtgtctcctaatatccaaagcatttttacttacatttcattatactctgccatgaggcagagaaagcaaatatcatgttcacattttatgaggctcatctttccagccttgtcactgcccatgcttcctctgggcccaggtttggactcactgctgtcttgactgagccctgactaccttccatgctccaggcctcatgctgttcccttggcctggaaattccgcagggtccaattcagatatacctccaagtgaatgttatctgcccccaggcagaattactcctacttgaatataaattgcaaaaaaaaaaaaaaacccacactttgatttgctttatcacatactattaaaaacatctttagaactcattaataaaatatgccttgatttcaagaataaatatagagtttgaaagtcattttttttctttctaaaattttactgtagacatggggtgttgctatgttgcccagactagtctcaaactcctggcctcaagcaatcctcccacctcaacctcccaaagaaaagttatttttattgttgatgagttggtcagtattgcaaaaggcagtgagcatctattctgatggcctaaacccaagctatcagcagctattaaaatatacgtttatcatcaaaatccatgaagtctcttcatctcatctctctgttttccagttccttatgtttctgattcttattatttcatgtacatatccttgaacgtctatttgtgtgtgcttgtgggcctgccttggctgaggtctctgaggtatttggtttctcttctctttctctccttttcctattgccttcttgatctttttttagtgttgttgtgacctggactggctcagcattgggtcacaccaggtcttggcaatcaggagtcaaaaaggacggtgagtattttgggcacagagaatgggcaagatggaaactctctcagccacagagcccagccctaatgagggtgttggggaagacatcacagtttcacttcttgccccagagaaagccagctcaaccatgtgcctgcatggttatccccttcttactgagtccctggaggccaactcttagcctaagtctgattaggctagttgtgcttagatctgcctagcatgaaacacaggttatttttttggttttcctttaggagttatcccttatatttttcctatcctagagagctcattcaattctctatcccagatgtgcatatctgaaattggtaaacactccttcccccatcaaatgacgttctcccctgttttctgcccaagaactgtccagatgaagagaccaagggctctgttgccctctggtgcccaggtaggttcagccaatggggaaactcagcaggaaataggtgagggagagtaggttcaagatatttggtcccctagctcccttgtgatctcctgacacccagcccaaaccttgctaaactgttacttcattgaactctccacagattttcataatttgagtgtgccattgatttcctgctgatggactttgaggtgtttaaatcatccagaagcaatgcaggttgaaatgttataccaccttagggtatagacacttgaagtaatctcacaacaaaggagaacaaccaactcaaatgggagccttggggagaaatcctgtgatttcactcaaggcagctgtatcttattaataaatgtatcacttatttaatgtaaaactcccataacgaccaagctcaatgtcctataactacaactcccatattggaattgcttaaagtcttaagattgtaagattattaggaaaggagtaaataatgtcaaaattattctaaaacacacctgaaatttaggatcatgagcattcttaaattcatttcctcctccttcacaaagagtaggggaagtcatgtttttgtgccactggcataagcaactctactattatgatggctcagcaggctgattaagtttaggtgaggccaaggttcagctggagaaacaagtctgcaaaattgcccaggcattctatgtcccgagtatgtcctatgtgccaagccgtttgcccaagatgtcacatgcactgccacattcatcctcaggtcagttttgtagaggggcccatagtccccatgttatggaggggtcttttcttctcactagctcccacaccccagctgtgctatgggctccccagttccataacaggctacaaaggcaaatagacaggcctttacttcgaaggagatgcacaggggacaccacaaataactcacataggccttcccaccatcaccttgcctgacctgggtcaccaagtgtgaacccaggactgccccatgacactggggtgctcatatcatgaggtaccccccagagaccagaatgtcccatctggacagtctcacagagggaaactggtctctgtcaaaatatgtattccttttactcacctctcacagggtgacatctgagcaaataggaagttggttcttattgtctgtcattcacaaaggctttggggtggctctgggactcctatgtcatagataatcatggtagtcttatggcagcctcttgacaagctaagcttcctgcccctcccagaccagacatcccacgcaccttccaggatgtggaaatgttaacctctcctcgaagcaggaatgcaccctgcataaacttgagccaagttcaacctgtctgttggctgcacgagccactcctgactactcagtcatttcctcataacttgaccctgtattttatagccctgaattttaggtgctccccttcactctacccagcgttatggcagttgttcttgtgttccctttattgactaggagccagacagtttcagacagtatcccaaggaaggaggagcaaagtttgaggtcccagcagccccagggttcctttgccccactgggtgaaagccttttgaggcctgcaatgctttcggaaccctcccttcttgccctgggttcatggccccacgcatgggagtgacttcgtcatgcttctggaatgggcagcctgtctcagccagggtttccagcccaggttccctgctgtgccttacagaatgcagacagctcaggctcagccaggcccaggccctccaggagagccaagagctgatctcagctatcagggacacttactgcatagtgagaaggaatccattttcacagcccccctgggaaatgttgctcctgtcagtgtggctccagtcttgaccattggccacaatgcccacagccccacctctgactgcaattttgtgctgtgggactaagaagcatttagctctcggctccccctgcttgtcccaagacttggcatcatatcttacacaggtgtacacacacacagaatacacatacacacatacgcacaaaatacatgcacacctctatatacgtagcacacatgcatgtatacacatgtacacagtcacacataaaaaaatcacactcactctcctacatctacacatacataacacaaatatatacatatacgtttttacacacatacatattcatatacacacacagccaccttttcaagtggctctctctgttgtccaggcagagacgcaccagttctgattcaaacctccccatcctccatctccctttgatggggagttgggggtgcagaggacagtggccactggaccagtgtatccacaccacattgaggtgctattaaataaataagttccagtttaagaagcagaaggccatgatttagggtgtgtctgcttgtggtggcagcaagtgtgtttctgaagatcataccttctctttcctccagctatagacttgtccagggcagagacactgtctgactttttatttttgtattttgttggtttgtctgtttttgtcctaagttcccatcacacacaggcggtggccacctggttttagtgaatggctgaaagaatgaatggacaaacacatccagttatttaaaggcagtgactgtgcataatgatgaagacgacagcaaaaatagatgtttgaaaggacagttgagagataatgtgagaaataagataacttgacaaattgttaattttaccttctaaattttttttttgtctcactaactgaagaaaagtttactgcaaagaaaagttgcttgattctttcaaatgaatagctagctcctagccccagatcttctgagttgctgaatgacatgagctgtccttgctggaatgttcttcccctccccaggttacacagtgccagggtatgtgtatgtactgagggagaaccagctcttgtccttgctctcaaatggcctcttcaggtcccaggttccttggcagcctctgtgccccaggtacccctaggagtgggaatctgggccaaggcagcctgtggtctaagttcccatgcagggtcacaggatccaggctgtgaatggacatcagtggagcccatggaggcccaggatctaagaagcactgctcaatgacaaactggggtgacattcgaattgtttataacaacgtgctaaacaagacattggtctcgacaaccaaattcggcttatggtcttcggttggcagcctctcctctctggggtccatccagctctctggaggctgccaagcagctcagcgcagatctcgcaggtgtcaggactccacagagcactgtggggtgtgtgtctgtgtgtgtctgtgtgtgtgtgtgtgtgtgtgtatctctatttattccttcttcccttccacaccctgacatcctaaaaagcatccccacataactgaggagactaaactggtccactaccttcagctctatgctcaggttaaagagaaggaaagaaattcaaaagggggagccctttgaagagttgtcagtgactggagagggatgtggcctctcgctgctggggcacactgagaggtggaggagggaaagcaaagaggactgcccacactcctgcctccacgctgtgatgagtgccctgtgcagggaagatggaaagagttaggattaaattgggggtgacattttaagttaaatgctactggaagtttataaactaaaagtaaaagttagcctgacatgttaaggagtcaggaatggaaattcaactaaaaatgtttcaagacagacaaagaaagtaaaatgaagccatttcctgttcgcacccccgctggttcagcctactcaacagaccatctttctccagccccgggagattctgtctagcctggggaaaattcttctcccttcgtgcttcttccagaactactgggactgacctaagagcatagattttggaaagataaaagtcagtcacatttagaagttactccactcacttgcctgccacattcctgctgagggaaaatgaagacagggtgaactccagctcagatgaaaaggcaggaaaaaatatttagagagtcttctcataaaacatgagcccagacacaccagtcaaaaacaaaacatcagagaccagagcggtaaagaggagggcagctcaaagcaggaggctccctggccttgcttcctaaaatcctcccgtgcaatggctccttcagctcatacgcaccctctgcctttagatcagccaggcagtctctgtctgaggccccgggtttcctggctgtcaaaatagataccaagagctggttccagacacctcacagagtggcattgagtcaaatacggtttcatggacttaaacaaaaaagaaactctgcaaactctgcaaatgtccccagacatcatcactgcatatgactgaggcccttatggagaccagttccctctgtaattctcctaaggatatatatagtgcattcatgctgtgtcactctcattgggactttgcaatccagtattctcctaattttaaacatgcatggccccagcttacaaacaagttgtgttccaaaagtgcatttacagtttggttagttggcacccaaaattcggtttcacatgaaaacctcgctaaaactaatccataatgcatgtgcaatcacactggtagaaaacaatgctgttatactgtggtaatgaagtcaaacggaaaaatacgtgtaccgtatatttaaactaaccaagtaatagtacattcactagcttaaagccaggtacttgacattctctcctaatgcttgaatgttgctgtttcctgcatcttgaggcctaatgtggggcacgaagccagtctattataatatgaagggatatggaaaattgtgatggaattcctgacaaatcagaaccacccacacatttctcctctaggacttccctgagccacctctggcctcctccaccgtcactgtctgcccactgcccacttcctggctccaccccactcttaacacatttcccatcttcctcctgcaactccagcatggatgagagccacacacaaggtgctaaggtttagaggaagaaagagttgacatttctacttttaaatttactaaaaacaattcaattgcaaagaaaaacaatttcaggggctcagttgctgtggtctaacccagactgacctgaggtagccaggggtgccctggtggcaccacacctggactcgggggactcatgggtccactctagaatcagtctctttctctacatctagaatgggtgtcaccatttagggctgcagaccacatgtccaggactggctacacaatttgtgggttccagtacaagatacaaatgcagagtcccttgttcaaagatattaaaaatttcaggacagtgacaacaaagcctgggcccctgtacatagactctgtgtgactacccaggtggcataaccctgaaactggccctgaaaatgacaccaacttgatggacaaccttgacacatctgggtcatgtccaaattcttggaaaagaatggtcatttcctgttcagatttcccaaatgactccccctttagcctcctttcattctgtggactgtgcccagggccctcaagaaactggactctgattcctggccacagagactccctttgcctccaaggccccaagtctatgtggtagagcagataacgctccaaaccagcacttacatgccacctctcactgtggtcctgtacaaaattccttctatttacaaactttcaaaaataagaacacagtgttccagggccaaggcaacagacataggctgcagaggtcacctgggtccttttcatctcagcatctgtttgttcactgtccacaccttcagcatgctggctgcatccaggtctttctttaggtctttggccaacatcaaaccacagtgtgatggctaattttatgtgtcaatttgattgggccccagggtgcccagacatttggtccaacattattccggatgtgtccatgagggtgtttttggatcagattaacatccacattggtagactgagtaaagcagattgtccttcctaatgtgagccttatccaatcagctgaagcctgaatagaacaaaagattgaccctcctgtgagtaagggggttaaaaactcctcctgctgcctgccttgagctgagatatgactcttctcccgcctttgaactcattgggaaacattggctcttcatgggtctcaagtctgccggcttttggacgagaacttacatcattagctctcctggttctccggcctttgaacccagactgaaaccacaccatcggctctcctgggtctccagcttgctaactacagatcttgggacttctctgcttcaacaatggtatgagctgattccttattttatttatatcatgtatataaacattacaatatattagttcatataataaatgtgaatttcatatatatatatatgtgtgtgtatatatatcctattggttctgtttttctggagaatcacaatgaatacactcagtctcaggattcagagtgctcatggccaggtaagtactagtatatttgtaaccaaggtacacatagacttaaaaaacaaaaaaaacaaaacatagcaattataacaaaggcccaccctccacccatcactgaaaggcccttcttgtgcttgatctcgtatactttaggcaagtgtgatgttgtgtctgtatactgtggcaaaatcagccacatggttggtggcttatgcctgtaatctcagcactttggcaggccaaggcaggaggattgcttaaagccaagagttcaagactagcctgggcaacaaagcaagacccagcctttataaaaattagcctggtgcagtggtgcatatctgtagtcccagctactcaggaggcttaggcaggaggatcccttgagcccaggagttcaaggctgcagcaagctgtgagggtgccactgtacaccagcctgggtgacagagtgagaccgtatctccaaaagaaattcaaaaagaaaaaggaaaagaaagtgcccatggtcaacagtgtataaatgccctccaaccaaagtccaccaagaacacacctgtagctgacgaggtgttgggtgtacttctcatagtgagatagaactacaccaggggaaccatggggcatctcaataacagtgtgttagaaaaattctattatggggttggggcttggggggttattaaagaggaaccaggaaggcagaggctttccctggattgcacaatatcagaaagtgaggacaattctgtgattggttatgtcgagaaaacttatctatgagagggctcgctagagcaggaataaagctataattggtaaagaaacagcagtcactcatattagccaagggaggaatgcttataattttgtgggtgacacaataactacttttgtctgtgcctaagcaaaattatgaagtggccttgttttgtctaagtgaccttgtctgatgttggtgttctgaaagatcgtttgtctctctgcttcatgttctcagtcgtttctactcccctggttccctttgttctacccccacaccctgaccagccctgctatcctggaagagagctaaaagctcaacttgtgaggtcagatgggctgggtctcccttgtgctagctggaagggctctgggaccttctgaagggagacactgcagtacacatggcttttctcttgcttaccgtgactccctttctttttttttttttcttttactttttcttttttttttttttgagacggagtctttccttgtcacccaggctggagtgcaatggcctgatctcagctcactgcaacctcagcctgccgggttcaagagattctcctgcctcagcctcctgagtagctaggattacaggcgcacaccaccatacctgtatttttgtatttttagtagagacagggtttcaccatgttggccaggctggtctcgaactcctgacctcatggtccacccgccttggcctcccaaagtgctgggattacaggtgtgagccaccgcgcccagcccaactgtgactccctttctaaaatccctctactctgaattaccaaaaaccaagtgctgtgctgaagcctttaatatatattcaccaattcaatccttactacaaccctagaaggtaagtactagtatatttgtaaccaaggtacacatagacttaaaaaacaaaaaaacaaaacatagcaattataacaaagactcaccctccacccatcactgaaaggcccttcttgtgcttgatctcgtatactttaggcaagtgtgatgttgtgtctgtatactgtggcaaaatcagagaacttccctttccagtctgggcactatttgcagagtaatcttcttattgcttgaccctggatcaaaaacccacactgtagctaggcacagtggctcacatctgtaatcctagcactttgggaggctgaggcagcatttctcttgagctcaggcatttgagaccagcctgggcaacatggcaaaatcctgtctctattaaaaatacaaatattagccgggcatggtggcgcatgactgtagtcccagctactcgggaggctgaggtgggaggatcacctgagcccgggaagtcaaggctgcagtgagctgacatccccccactgtgctccagcctgggcaacaggagtgagaccctgttctccaaaaagaaacaaaaacaaaaaacgaaccgaaaaaaccctacactgctccctactgcctagagaattaagctcaaattccttccatcaagacttcgcctaatttggctttcaactgctttattgtcctcagttccccttttccccctaagtgagctctctaccatggtcaaagccatacattcgtaggccccctgaacacatcaaatgcatttccacatctgcagtattctttcaaattgaaacattcccctgcctccatccaatctcaggctatctctcctgttcaactcaagtctgacttcagctgtaaagcttttctggcatgtatctggtgctatttcatatagttatttatgtttttatgcattacccgtgttgtcccaaagagacctggggtagatagtttgcaaaacggccacagtaatttctcccatgcctgtatgtatgtatgcccctttgccatttctatcctcaagaggtcttcactcgttgaatctgagcttgaatcggaatatgacctgttttggccattggtgtgttagaaacccctgagaccaccaaacagctggccaactaccaaatgtgtgagcaaagccaacctaaatcatccagcccctgctaagctggcctgatcggaaaagccattccaaccaatccatggaattgtaagcaaaataagaaatgtttgtttttatatgtcagtactttaggggatggcttgttatgcagccaaagctaacagatataagattcttagccccttcaggagctgagttactttacctgaatcctcagaatccagccttgcacatgggatcaagttctcaataaatatttgcttttgatgataacaactgaaatacagaaagctggaaactgaggtttgaaggatgagaggcctagccttcccatgcttaaagcctagaggtcaggagttcaagactagcctgaccaacatggtgaaaccccgtctcttctaaaaatgcaaaaaaaaaaaaaaaaaaaaattagccaggtgtggtggcacgtgcctgtaatcccagctactcaggaggctgaggcaggagaatcgcttgaacctgggaggcagagattgcagtgagctgagatcgcatcactgcactccagcctgggtgacagagcaagactccatctcaaaaaaaaaaaaaaaaaaaaaaaaatcccttatcttacacaacaacttacctgtgcactaacaggtaagttgtggattcagctgctggagtggcaggaaggggttgactttgggaagagataggcagcctgtggcagtgagctgttactcgttttatcattctttcatccattgatcaaatgtttattgaacacctaccatgtgcctggtgttgtgctggggactaagaacaaggaaatgaacaagccatgaccctggttctcaggggctctaggtctagaaggagacaagcatcagaacacatctgaccatccctggattaaattcaacaagaaaagaggttagccggaggacttctttgtgccaagtcccatgttccagggttcatttcctgaacaaattgatcatgttgttctttgatctcttccgctggtgaaaattcatacatattttcccaaagctataagttcctattttcttaaccagattacactgctcattaggaaaacaagtgaaaaaaatgagtccttaatgatataatcatctaattccttcagaggtaacaacactgtctgtgcagctgggtcctgagaaccacatgctctgacaatgtcaatacttcaaaccttgaggctgaagaacaaaagacagtgatacctgttgccctccacagctatggtgacaatctgcctgatggcctagggcctgagtgtggctcaccatatggattagagtaataacagttattgggtattgagtgcttactgtgtgctaatcattgtaaacactttatcttttttaatcctcccagcaacctcatgggacaggaacaattattatttcttctttacagttgaggaaactggagcaccaagaagttaagtaactttcccagggtcacatagctagtaatagcagatatgaggcttgaagccaagtgtttgggttttgtttttcctgaagcttgcacagctttagacctcatctgctaacagcacttgtctgttaggagatgattctgcctcctttcttttcctcctactcagtccagagcttcagggtccccgcagccaggcagttatttgggtgttaagtggccttatgctatttttagctcttagaggattgcaagtgctttatacatatctctttacttcttgtttactttatcttttctttttttgttgttgttggttttttgttgttgttgttgttggtttcctttcttcctttctttttttttttttttttttttttttgagacagagtcttgctctgttgcccaggctggaatgcagtggcacgatctcggctcactgaaacctccacctcccaggttcaagcaattcttgtgcctcagcctcccagggagctgggattacaggtgcacaccaccatgcctggctaattttttttttatttttgtatttttaatagagacaaggtttcaccattcaccgtgttagccaagctggtcttaaactcttggcctcaagtgattgtcccccgccctcccgccccttggcctcccaaagtgctgggattacaggtgtgagccactgcgcctggcctgtttgttttatcttttctaaagctcaaaacaaataggaaggagcttcacctgctccccccaggcagctaccgaatgagagtctctgcagagctgtcagccagcacttagttgacaccagcccagctccaggctgcaagtgacttgggggaggattggagacatgcctggcacactacatgcctggcacactacatgcttggcacactaaagcagtcctcatttatgagatggggaacaacctcacctgccagtcctgtttctgccttttttacttttagttatagaaatttctaaaaaagaagagaaaaccctagagagatcactccttgcctcaatatggtccccatccttgctcttcctgttctggagacaacttcctctttctcctctccttcccagcccagtacttcccccccttctcctccctgccatccccttcacacacaagctcttttttccctctggtgtagttcgaccctatagtaatttctttctaattcagatcagtgtgcctgtgttaccatggcaacctgctgctaccaaggcttcaacgaagtcacttctcccctatatttttaatagaaaatctgcactctacatcttgtcctatccgacctgctactgccagtttgaacaaaactccagccccagtttcccaaatgtctttaagtatttttatacatcatcaattgagttaattccaaatacatccatgcaattttctccatgggggtgtacctggctttctcagtgaggggtggacaagttgaatttgtacttatgcagtgggattgacaggagctgaacagtgaatactgaagagggaagcggctcgggcggaactgctgctgcctcacagggaaggcaggagcaaaccagaaacccaacccaaggaaattctccaggccacatgggtcaggcatgagcttgtgaaatctccagccatggaaatacccagaactcagcatactctccaggcccttctgagcagaaggtcgcaagtctggtgcagaggaaatgaagcagcacacactttggagtcaagcagatttgagtattattttcaagtctgtcgttgaactagctgtgctatgtgagcttgggctagttccttaacctctctgaccctcggcagtttatctttcagagttactgggagaaacacataggctaatgcatgtaaaatggtctaaaatagttctcagtcagcacatacttggtaaagagtaactgccattattacagttattataaggaaaaccctctgaggaagcatcgagatacaaagccagagcttgggctcaagaggcatataccaagattaccaaataatcaggctaactgcagcgctgataacccaacccgaaaacacagtccagacacaccaagattcaggatgtaagcagtaattgggagcaacagcaccaggtctcgttacaattacatgctgtcataagagcaataagctagagttgacccgcaaataaaccacatgttaactgcttccaggtcctctcctcttctccttggcctgtttgcagctgatatatgagttaggcaggccaagaactggaatggagcagtgtaagggagagagcttgcatttattccatatgggagagccaggtgtgacccaaagtcaggtccctgcttgggcccagaaaggaaggctgggtacacacagaaggagccatttgacctgagctggttccaaaggactcatgaatgtaggactgcttccaaggctttgaaactccacctcaaaaaatatggcatgcagatgactattaaatagtcatctatttgtatcatctatacatcttacacctgtaatcccagtgctttggggagccaagacaggaggatcactttagaccaggagttcgagaccagcgtgggcaacatagcaagaccccatctctatagaaagtaataataaaataaaaaattagctgagcatggtggtgcacacctgtagtaccagctacttgggaggctgaggtgggaggacctattgagcccaggagttggaggctgcagtgagctatgagcatgtccctgcactccaggctgggtgacagagcaaaactctgtctcaaaaaataaaaagtcttaacggagtgcataatagaatgttaagacattttcaaatgtaaagagtaacagagaccagatcagcagtgctgtacatatgaagagtgtaagaaaacagccactagctcagtgaccccttctgagatgtgtaagaggagcttggagaagagcaagtcaaactagtggtggttccttctttggagagttgtttcctaggcagcaatgacaggaagcaggacaggaaacttggcatgtatctgttggaaggtcgtgggctgaaggtgagacattgtggctaacgctgcctcccatgatggaggaagaagaggcatgtctcggatcctcctccaagtcacgtgcagcctggagctgggctggtgtcaactaagtgctggctctgcggagactctcattcagtagctgcctggagggagcaagtgaagctctttcctatttgttttgagctttagaaaagataaagcaaacaggctgggtgcagtggctcatgccagtaatcctagcactttgggaggctgaggcgggcatatcacttgaggccaggagttcaggaccagcctggctagcatggcaaaaccccgtctctactaaaaatacaaaaaataaaaaaataaaaaattagccaggcatggtggtatgcgcctgtaatcacagctctccaggagcacaagaactgcttgaacctgggaggaggagcttgcagtgagttgagataacaccactgcactccagcctgggcaacagaacgagactctgtctcaaaacaaaaacaaaaacaaaaaacagcaacaacaaaaatgaaaagataaagcaaacaagaagtaaagagttgtgtataaagcacttgcaatcctctaagagctaaaaatagcataaggctacttaacacccaaataactgcctggctgctggggaccctgcaagctctgcactgagtaggaggaaaagaaaggaggcagaatcatctcctaacagacaagtgctgttagcagacgaggtctaaagctgtgcaagcttcaggaagaacaaaaaccaaacacttggcttcaagccccacgaacctgggaggcggaggttgcagtgagcagagattgcgccactgcactccagcctgggagacagagtgagactctgcctcaaaaaaaaaaaaaaagaagaaggtgaaggggagctaccatgtgcagagagtacatggtaagagatcagggaagtggggtgggaagatgtcatgttctttttaacaaccagctcatgcaggaactaataaatgcccaagggaaggcattaatatattcatgagggaaccactcccatgactcaatcacctcccattaggcccacctccagcattggggatcagatttcaacatgagatttggaggtgacaaacacccaaaccgaagcaagctccaagagaagctgtctccttctgacctgaggatgggaaagggagcccataagactcagagagagtgggagacattcccctttatttttagtcatttattttatctcccacccaaccctccaggaaaccccatggtggtgacagtgatagtaacagcagcagcaactgaagaggcacctaaaattctgagggagtagaacccttctctctgaccagagggactatagtccgaagagcatagagaaaatttgaattgttttttgtctgtgtctattctcccactgcttggctttggaggaaagatgcagtcagaagtatgctacagagttgggaagctaaattttcagtttctagacggaataccaggagaagcaatccctggaggccagaacatgtcacagagatcatggtaaagagaaaattcgagaaagcaaacccctaaagttatgtatgagcatgttggcttattccaggaatataaatgcattggtctgactctagacagcataccaaaagtttcaagaactgaactgtgaactaggcaaccacctggttcccagatcggtcactgggaggtagacagttgaggacatgtctgaatatcactgtaaaaacttggaaaactgaactgatattaaaaccacagcccactaaaggcaggtgagacatgggtcctaaccaagttcattgcctgctgaaacaaacaaacaaatcaactttctccataagaatcaattaagatcagagtctcaatacaatattcaaaatgtcccaaatgaagaaccagaagaatctcaacaattcataaggataaacataaccaaaagacatcaatcacaagaagacacatatattaaaattaccaaagattttagagcagctattacaacaatgcgccaataaataagaaagaacagtcttgaaatgattggaaagatacaaagtctaagcagagagagccatgatataaaagaagaaccaaatgcaaactttagaactgaaatatacaacaaccaaaacaaaaaatgtatgggtagtcctcaatagtagaacaaaaatgggaggaaagagtcagtcaacttgaaggtagatcaatagaaattattcaatctgaacaacaaagaaaaaaattattttaaaaaatggctgggcacagtggctcacacctgtaatcccagcactctgggaggccaaggcaggtggatcacttgaggtcaggagtttgagaccagcctggccaacatggtggaaccccacctctacaaaaaatataaaaattagctaggtgtggtggcgcacacctgtagtcccagctactcagtaggctgaggcaggagaatagcttgaacctgggaggcagaggttgcagtgagctgagatcccaccactgcactccagcctgggtgacagagtgagactcagactcacaaaaaaaaaaaaaaaaaaagaacagtgtcgtagggatctgaaggacaacaacaagaacaacaaactctaaatttgagtcatcagagtcctaaaaggaaaggaaaaagagtgtggtttataaaagtattgaaaggaataatggctgaaagctttcaaaacttagtgaaatacttaaacttacagattcaagaaactcagttgtattagttcattttcacactgctataaagacatacccgagactgggtaatttataaagaaaaaaggcttaatctgctcatggttctgcaggctatattggcttctgcttctggggaggcctctggaaacttacaattgtggtggaaggcaaaggcgaagtgggtacatggtcacatggctggcaggggagagcgagaacaaagtgggaggtgctacacactttaaatcaaccagatcttgtgagaactctgtcatgagacagcactaagcggacggtgctaagacattagaaaacaccctcatgatccaatcacctcccaccaagctcctcctccaacactgggaattgcaatttgacatgagattggggtggggacacagagccaaaccatagcactgagcataccataaggaagatgaacccaaagcaattcatacccagacacaaacagatgaaaactaagaacaaaggggaaaaaacagccagaggaaaataacacattacatgtaggaaaaaaatggctacaatgactggatttctcctcagaaatccaggtcagaaggcagtggaacattttaaactactgaaagaaaatcattgtcagttcagaattctgtaaccagcaaaaatatatttcaagaatacaggtgaaataaagacattctcagatgaaaaaaaaaacaaagaaaattcattgtcattagacctgccataaaagaaattcttcaaacagaaggcaaatgacaccagaggaaaacttggaacttcaagaatgaagagtagcagatgtgataaatacctaattcagtataataaattaggctttttccttgtgaattctttaaaatatgtgtgataattaaaaaaaaattaaaacattgtttaatggggttttctttagcaattggtgcaaaacatggagaaaatacaatataaggggcaggtaaaggaaaccatacaagctttctataatccactttaagtggttggatagtaattcaaaacagactgtaaaaagttaagtatgtatattataatctgtaaagaaaccactgaaaagaaaatatatacaaagagataagtaaaaaactcaaaaaattaaaatatgaaaaaatgttcaaagaaatcaaaataaggcaagaaaggggaatagatgaagaaatacggagggaaaaaagagaaaacaagtaataatgtggttgatctaaataaaaacataccaataattatttaaatataagttatctcaacacatcaattaaaagacagtgattctgaaaatggataaaaaatgaaagaacaacacacagctatgtgctgtcaacataattctcaaatgtcagtgaaaatataatgatacaagtagatcaagagtaaaagaacaaaagaaatatgccatgtaatcactaatcaaaacaaagctggaattactatactaattaatatcagacaaagtagacttaagagcaaggaaaagggataaaaagggacattataataataaaatgattgattattcaaaaacaaatattaatcctaaatgtgtatgcacaaagcaacagagcttcaaaatatatgaaacaacttacagattcaagaaactcagttgtattaactgacagaactgaaagaatagtgaaatatagaaataaacttggagactttaacactcctttctcagttattgataaagcaaaaaagacagaaaatcagcaaaaatatagaataacttaacatcatgaaactactagatctaattaacactgtaatatcattccacccaacagattctgcagtttttccaggtgtgcattaaaggttcataaagatataccacatccagagtcataaaacaaacattaacaaatataaaaattaaaatcatgcaacaatttgtccctattcataatggaattaaactggaagtaaacaacagggatatattaacaagtgggaaatttccaaatactaagaagttaaagcacttctaaattatccacgcatcaaataggaagtctcacgggaaactggaaaatattttaaaatggaggaaaatgaaaacattatatattaaaaatgtgtgagatgcagttacagcagtgcttagagggaaaattatagcataaaatgctatagctgcttttctattagaaaagaagaaatttttgaatcaacaatctagggtttcaccttaacaaactaaaacaaacaaggtaattgtaaacccaaagcaaggagaagtaaggaaatactaaggatgagaagaaattgattaaattaagaactgaaagacaatagagaaaatgaatgaaaacaaaagccagtcctttgaaaatataaataaaattgattagtctttagccagactgaccaggtaaaacagagagaaaatataatgtaccaatatcaggaatgagaaaggagacattaatacagaccttatggacatgaagaggaaaataaaggaatacgcccaacaactctacacatatagatccaataacttagatgaaatgaacaaattacttgaaagctacaatctacaaaacttacccaaggaaaaaaacacataacaggcatagttctttattaacaaaattgaattatagtttttttaagaacatttgaaaaaaaattccaagattaaatggtttcactggtgaattctaccaagtatttaaagaaaaatagcatagattttatacaatcacttccagaaaatagaaaataggaaatattttatggggccagtcttattttgataccaaaagcataggtattacaagagaagaaaactagagaccaaatccatcattaacatagatgtaggaaatctcagcaaaatatttgcaaattgattccagcaatacataaaaagaagaatactccatgatcgagaccatcctggctaacacggggaaaccctgtctctactaaaaatacaaaaacattagtcgggtgtggcagcctgcgcctgtagtcccagctacttcggaggctgaggcaggagaatggcaagaagccgggaggcggagcttgcagtgagccaagatcacgccactgaactccatcctgggcaagagagcgagactccctctcaaaaaaaaaaaaaaaaaaaaaaaaaaaaagaataatgctccacaagcatgtagggtttatttcaaggatgcaaggatggttttaacgctcgaaaatcaatgtagcctaccatatgaaagactaaagaagaaaagccacataactatatccgttaatgcagaaaataatttgacattcttttatgataaaaactcttagtaaagtcgggatagaaggaaaattaacctgacaaagggcatttaccaaaattttttttaaaagccaatatcacagccaggcatgatggcttacgcctgcagtcccagcactttgagaggctgaggcagacggatcatgaggtcaggagatggagaccattctggccaacatggtgaaaccccgtctctactgaaatacaaaaaattagccaggcgtgatggctcgcacctgtagtcccagctactcgggaggctgaggcagaggaatcgcttgaacctgggcggcggaggttacagtgagccgaaattgcgccactacaccccagcctggtgatggagcaagacaccatctcaaaaaaaaaacaacaacaaaattagccgggtgtggtggcgggcgcctgtaatcccagctactcgggaggctgaggcaggagaattgcttgaacccagaaggtggagattgcagtgagcctaacggaggagaccaccgttcatattgtcttatgcccaatttctgcctccaaagaaagaaaaagtaaaaactaaaaggcagaaatgaaatccacaagcagacagcctggggccacaccctggtcctcctagttaaagatagacccctgacctaatcggttatgttatctacagattacagacattgtatagaaatgcaccgtgaaaatccctatcctgtttggttctgatctaattactggtgcatgcagcccccagtgacataccccctgcttgctcaatcaatcacgaccctctcacacgcacccccttagagctgtgagccctcaaaagggacaggaattgctcacttggggagctcagctcttgagacaggagtcttgcgatgcccccggccaaataaacctcttccttctttaactcagtgtctgaggagttttgtctgtggctcgtcctgctacaagccgagatcatggcaaaagccaatatcacacttaatgacaaaagactgactgctttcctgctaagatctagaacaaaacaaaaagacactctcacagctcctactcaacaataaaaggtatttggattggaaaggaagaaataatactaaccgtatcacagacaaaatgattatctgtctatgtagaaaattccaaagaatctacccaaggaatctagagctaatgagtttagcaaggttgtgattataattcaacgttttaaaaatcagtgatatttttagatactcataatgaataattggaaactgaaatttaataaagcaataccattaacaagaactcaaaaatgaaatacttacatataaatctaacaaaacatatgcaggatctatatgctgaggaccacaaactactgatgaaaaaataaagaaaacttaaagaaacagaaaggcatactttgcagtttgaaagattcaagagttaagatgtcaacaagattttcaaattggtctatagatttaatgcaaattcaatcaaaagctcagaaatcctttttcagtattaacaaacaagttttaaaaattttatggaaataccaaagaactggaatggccaaagcaatattgaaaaagaacaaagttgaaagactcacagtacccagttttaacacctattataaagctccagtaatcaagacagtgtagtactggcaaatgggaaaaacacataaactaatggaatgggatagagaggccaagaatagtcccacacaaatagggccagttgactttttacaaaactgcaaaagtaattcaattaagagaggagagtctattgaacaaattagtcttaattggattaaattgtttaatttgtcaatcattggattgaattaattttgtcaaccatatgaaaaaagggaaccttcacctaaactctgtatcttataccagaactaactcaaaatgtatcataaatctaaaagtaaagtgtacaactgtaaaacatttagaaaagagaaaatttttatcttgggttaggcaaataagttttagatacaacaccagaaacatgatacataaaagaaaaaattaatatattatacttcatcaagattaaaacattttaggattggggagtttcttttgagggtgctgaaaatgtcccgaaattgattatgtgatgattgcacaactctgtgaatacagtaaaatacattacgttgtacactttaaatgggtgaaatgtatggtatttgagttatgtcacaataattctctcttaagagtataaaaaggcaagttagaggcttgaagaaaatattttcaaatcatgcatctgacaaaagaactattttcagaatgtttttttaaactctcaaaactcaacaataagaagaaacaacccaattaaaaaatagacaaaaagacttgaacagacactttactgaagaggatgtaaggatggcaaataagcacaggaaaagatgttcaacatcattggccattaaagaaatgggaattaaaaccacaacaagatatcactacacacctgttgaatggctaaccaacaacaacaaaaagataatgctaagtgctggcaataaaaaggattagctgctaataataaggattagcaaaaaacttttattctttgctggtaggaatgcaaaatggtacagctactttggaaaacagtgtgacagtttcttgtaaagttaaacttacacttattttatggaccagcaatcatattcctaggtatttgttccaaagaaataaaactctatgtttatacaaacatctgtatacaaatgtatatagtagttctagacataactgctgaaaactagaaataactcaaatgtcctttaacaaataaatggataaacaaacagtggtccctgtatataataaaattccacatggcaacaaaaagatgtactattgatacacgaaacactatgggcaaatcacaaaagtatcacaaggagtgaaaaaagctagcctggcaggatgtggtggctcatgtctgtaatcccagccctttgggaggccaagctgggaggttcacttgagcccaggagttcaagaccaacctgggaaacagcaaaaccccatctctaaaaaaaaaaagaaaaagaaaagaaaagaaaaggaaaagagagaaaagaaaataaaagagagaaaaaagaaaaaagctagtcttgtatgtttatatgcatgtgattccgtttatatgacatctggaaaaggcagagctctagggaggtatattcattttctcttgatgcacagcaaatttccacaaacttaatggcctaaaataatacacatttgttatctcaaagtttctgtggattaggagtcaggatttggcttaactgggtcttgctcagggtctcacaaggctgcaatcaacatgtcaagcaggctgcgttctcatctgaaggctcaaccagggaagaattgacttctgagctaattcaggctattggcagaatttattttcttgcagctatgtgactgagggcaccagcttctcatgggctgttggctggagagtgctttcaggtgctagaagctgcccacagtttcctgccacatagccctcctcacacatggcagtttgcttcttcacagcaaacaggggagagtctcttgctccagtcttctaagagagagtcttatataagacagtgtaattgtgagagtagcaactcataaactttaccatataacaacctaatcaggaaagtgacatcccataatctttaccatattctattggctagaattaagtcataggttgtgcccacactcaagatgtgaggaattaaataggggataacagaacaggacaaaggtcatggggtccattttataattcggcttacctcagtaggagaagagatgttgcaagaagttaggggcaggggaagggtttcactacaaaggagcagcagagcaagtcttcagaggtcatggagctgtttgcatcctgattgtttttgtggttatgtgtgtctatacatgtgttaaaactcatagaactgtaaacatgcacacacgtgtacatacacacacgcacaccaatttgactgaattaaaatgttaaaaaaaggagaatacatttttaaaagacattttcccattgattcccattttaacgtgctattggtattagtttcactcttttctcatcatcaatgtacagtttgaatacatttctcctctccttgcctatggaggatccccaaacaagtgcctcaaaaccagggtttaatggcattcatctacagtcagggaatttcacagcatagggaaggctgcagatatgatagtagagaaatccattttcataaaacatttaagaaccccttcttattatttcactcaggtgtcatgggagtaggatggggggccaggcaccaaaaacaaccttttccaaactgcaggtttaagtaaaattggtgttgtactttttcggttctatattcttaacaacatgccattctgttgtttaaaatccagcaataatctttcaccttattgcaataaaatccaaactcatcctgacttctaaagctctgcatctcctgctttcttcccaattctcccatcatccctgcattcagtaggcttcagtaacactggctcccctcctctgtctccttcacatttttctttggcaaattttttactgaattagagcacatgtatagagcacagatatatcatatgtgcatatgttgatgaattttcacaaagtgaacacagacataatcagcacccaaataaaaagacaaaaaccagaacatgattaaagcttcataattcttcttcttccacttactgtccccaaaaatgaccgtatcctgaagctagccaatttttttttttttttatttattccttgaacatctcaaactatttaattcaggacttttgcatatgaggttttccctgcctggattattaagtctacctccagacacattcattctttacatgcctgcttctcttaatatctcatcttaaaaagtcacttcctccaatagactttccttgttcctctccagctaaagaagctctccccacaccctcactctgtcacctattcattctcattcccctcctggaaattatgagctgaattcattcatttatctattatgtttacttgtttattttctctctcaaaagttagcttactgtactctaaacattaagagaaaaaagaccaataacctcatagaaaaaatgctctggaagatgtgaaggcagttaacaaaaagaaaaacgcaaatggttcttaaacatttgaaaaactatttgaatttacagtaggagaatcaccagttaaaaccatgataacttttctccctgtcagaatgacaaaaaaaatccaaaagttggacaaaatattctgttgctaaggctgtggaagaattgacacattcatacattgctagtgggaatgcaaaataaaggcataacctccatagaagggattgggaatttgaaatatacagcaaaactacatatacatttaccccatgacatagcaattcctcttataagaatttattatacagatatgctaacaaaaatatcaaatatatgcatacatttgttaattatagcactgcttataataaatagcaagagcctggaaacagcccaattttctatcaagagaagattggaatgaactcaatattgtacattcatgcaatggagtattatgcagctataaaaaggaatggagaagatcttttaaacttctcataatcaccagggtatattgttaggtaaatcaaggtgcagaacaatgtgtgtttttacgtatgtttacatggttccaaagttaaaaccataagacacattcagtcaagtctgttttcacctccacatttcttcaccttgcttccttcctcccctatgaggaatcaatttctatagattttaattaattctttattttggaaattatgagcatgtatatttttgctacacacacacacacacacacacacacacacacacacatttagtttcctaatgctgctgtaaaaatttgccacaaacttagtggcttaaaacaacaaatttatttcctttcaattctagtgtctagaaggctgaaatgagttttatgagactaaaattaaggtattggcaaggctggttccttttagaggctttgaggagaacatctatttctttgtctttttgaacttcttggtggccacctgtattccttggcttgtaacctttttcttcatcttcaaagtgcatcacaccaatctctgcttccatcaccacatcaccttctcttctttgacagtcaaatctcccactgcctccctctcataaagatacttatgattacatttagggctcacctggatgatcatccaggataatctccccatctcaaaatccttgacttaatcacacctgcaaaattacttttgctataaaggtaacttccacggtttccagagattaggacctggatagctttggggtcatcattcagcctaccaatatacatattcttttttgcttataatgtttaaataaaagataaattaaaatctattggaaaatttttacttatagaagagaaagaaaacaggatgaagagagacagggatagaaactagatttgactgaatgcatcttgttttatggctttggcatcagaaccatgtaaatgttctgtacaagtataaaacaaaatgcaaaaaaaaaatgaaaattaaaaataaaatttagaaaataaatctaaccacacatcctattggtactttaaccacacacctctctcaggtaataatgtgactttaaaacatagtagtttgactgtatatatccctggtgaagtagatcctaatgtcaaagaattgcaaaaacaaaacaaaacaaaacccgtagtattcaataagcgtacttaagcatacttttaataaaaatattgtgttatttgtaaactattatgtacatacatagtaaaataatcaaataattggatatgttaatattgttaaaaattgagatttttagcatacaaaaaagagacatataaaattaaagaagttgagtaaaagttgtacatcttagatttggatataccaatatggaatctcaatgtattttactcttaaaaaaatagttcccagttctgtccaccaaaaggtatagaagcaatgagcaaccccatctcagtgagcacctctaacacccagactggagtctctaaagaccatttctcactacagggaactaggtatccatggagaaatgtttgatttcaggtctgagacatgaaatgtacaagatgaacctgaaacatctttcataacagaaaacaaggctactagggtcatatcagaggattcaagagataacttagtttcattggtcaaagactgggtaataatgcctatagtacattgaaatatatgaaaacactaaaatccatgtgcttataccaatactttttaaaaatctcattgattgcctttgaaggatgctaggacactaacacattctaaaattggtaaatgaattaaatgaataattcctgcattccctatatgaaatatatttcagagcagccacatagtaaatgagataaatttcttttttataagaaattcaagctattaaatgcaaaataaaagatacaattcgaatattactattttgcagctcctaatgaaataatgattgtaggcaatgatcacaaatagctgttagaaatcacaaggtacaaggccaatagaggattgttaggctctttgttttcagctttattggggtataattgacaaaaattgtgtataattaaaatgtactacttgttgttttgatatatgcacacattgtgaaatggttaccacagtcaaactagctcacatatccttcagatcacatagttgtgtgtgtgtgtgtgtgtgtgtgtgtgtgtgtgttgagaacacttagaatctatccccttagcaaatttcaagtatacaatacagtattattaactatagtcactatgctgtacattacatcccagaatttattcatcttccataactgaaactttatagcctccgaccaacatctcccaaattcccccaaccatcaggccctggcaaccaccattctactctgcacttctatgaatttgactattttagattccaaaaataaatgagatcatgacatatttgtctttatttgtttggcttattttacttagcataatgtcctctgggttcttcagtgtcgcaaatggcaggatttccttctttttctaaagctaaataatattctattgtgtgtgtttgtgtgcgtgtgtcatacacacaagtatatacaccacattttccttattcattcacctgttgacagaaatttaggttgaaacaacatttaagttgtttccgtatcttcgctattgtgaataatgctgcaataaacatgggagggcagacatctcttcaacacactgatttcatttcctttggatatatacccagaagtgggattgctggatccatatggtagttctatttttaattttctgaggaacctccatattgttttccacaatgactgtgccaatttatggtttataacagcttacagggttctctttcctctacaactttaccaacactttatcttttatctttttgataaaaaccattctaacaggtgtgagataatatctctatgatttagatttgtatttccctgatgattagtgatgttgaacaccttttctatatacgtgttgaccatttgtatgtcttcttataagaaatttctgttcaagtctttagcccgtttttaaatagggttatttgctttttttttgctattgagttattcgcagtttcatatatattttggatattaacgtcttatcagatatatcgtttgcaaatatcttctccaattccatatgttgccttttcaatctgttgattatttcctttgcaattgttaggctttaaatattcatttttattaatgttttctgattatacacatcaggtttttggaccagagacagatttctttttacactcacagaaagatcaacagccaaagtaacattgcagcattggtccccctcacccagcctgcctgcagagtaccatgtgagtgccagatggaataaatgccctgtacaagtggtaggttgactctataagtgagatatagagaaatatggattttgttttgtttataaaaagcaaagacatcactctccccctcaccttctgagaatccttagagatcagatggagggatctttaccctaaccctttggtaggaaagtaaacctctgagggaaaagaagagcgcagtgtcttcagtttgacaactcagagatggctccaaggccctgagcctcttactgccagagttaggtcaatctctttggaatgtgttcactatctgatcagtcataaattgccttctaagcttgctctcaggccaggaaacacactttagtaatatctattcagaaagccctaactgtgcagaaacatattctctacaatcttataactttataataaatgggtgaagataatatcacttgaactcatggattaatcttacatcatcaaaaaacagataatcagatagtatatgcatcatgatatgatataataggaagctcacagtgctgcctttgaagtagtcttgtcaaataattaacctgaatctaatcaaatatctagacgcaactattagtttaaaagaagtacagaaaagaagaacatattaaatgatgccacaggaatgcaatcagccaaagcagaatctaggaaattctacaaaataaatggcttgattttttacaacaaataagttgcaagaagaaaggagggaggagaaatttagaaattaaaagagacttaaaagacttaccaacaaattaaggtacaaagacttggtttggatcttgattccaacatatcagctggggcggggggaaaggctatttatagacaatagggaaatttgaacactggctggatattagaggacagccaatgaattactattaatgaattactattaatttttaaagatatgataatgttattattgttctgttttaaaaatagagttcttatctctatttggaaatatttacagatggaagttatatgataattgggatttactttaaaataataggtagagatccagacggaatgagggagaatagaaggaacaagattggccatattttgttaattgttgaagctgggtcatgtgtaacttagggttcattattctattatttctacttttatatatatttgaaaatgtccataataaaacgtttttgtttttaaaaagtaaggtcctgaaccctcccctctccttaatgtcttctccctgctgtagttttaagttgggggagaagggtccttcccctctagcctgtgagcctgagtctgtggcagtggggtgggggtgggggcagttagcaggaaagcaatggagaaccaaccagcagagggttgggtatggccaccacaggtctgactggctcttttatatgtgctaattacctgggaatgtggtcttaataagaagcaagataatcagacaagactgaatacattgcctcaggtagggtccaacagggcctgacaggcttctgctttcccccaaccacaatgaccacttaacctcaaactaatgagtactcagaacccatcccctgcaaggtaaggggagacaggagtggtcatgcataggcagagctctgctgaaatgtctgaaagtcaataaagaatgctattttgtcaggctatttcttttctttccatttcatttctggcctgcaaatctcagaaaagcactttaatttttaaaaatatttgttcttaattatgaaggtagtgcatattcattgaagaaaattttaaagaaacaaaaaagcattaagaaaacatttaatcccactctcaaagagatcaactgttaaaccttagattattttcttcctgttattcatttgaatatttacggtaatgctgtgctcattctctatacagtattttgattgtttcccatttagcattatataaaaattttccacatgccatcacggctcactgcagcctcaacctcccagctcacgtaaccctctggccttagcctcatgagtagctgggactacaggcacacaccaccacgcccagctaattttttgtattttttgtagagacagggtttcactatgttgcccaggttggtgtcgaacttctggactcaagtgatccacccacctcagcatcccaaagtgctgggattagaggtgtgagcaatcgcaccgtgcccaattttgcctattcttgagctggatttcaatggagccatatcacaagtactcttttatagttgactctttaattaaatatcagctctgtagtatctgtctgttctttagtgtcctagtacttcattcttttttactgctgtgcagtatcccatggtataaagatatcaacatttatttattctactatgatggacatctgggctgtttccaatttggagctattatgagtaaaactgttatgaacattcttgcatctgcctctttttagacgtaagcatatgtatctcttggatatgtatccaggagtaggattgctacagcatatgataaatgtatgtttagctttggtagatattgccaaaccattttgcaaagtagtgcaccaatttacccccctaccagcatcatatgagagttctagctattcccattctcaccaacacttggtattgccagtctttttattttagtcattcttctgagtataatggtttctccttgtggttttaatttgcatttacctgctgacaaatgatgttgagcacctttttacttggacattctttttgtagagtgcctgttttgactattttttcattaggttgtctacctttttaagttgatttgcaggagttctttatatattatatcctggatatgggtgtcccactctgtggtttgccttttcactctcttaatgatgtctattgatgagtaagagtttttaattttaatgaagtttttatatccaactgttctggtttaagttttttgtgtcctaaaaaataatatcttaattacctttgtctacaaggtaatgaagatgttatcctaaagcatcattttaatggctgcataatattttgtttcataaattcaccattttcctattttttagatacttaagttgtaccttattttccactactgtaaataaaagtgcgaatattgttgagtgtcttatatgactcaggttctgtgctacatttttacattcctagaagaactatctaccagtactattttcatctccgctttatagaaagatagaggagggctgagagaagttgaggaatttgctcaaagccgtatcactatttagtgacaaagctggaatttctgtctagatttctctgcctgcagaaccaagggtataggccacctcattatctgcttttcaaatgattattttcttagcataaattcctagatgtggaccttactggactgaaagtataaaagtataatatccttggtaaatgctcggagtgtttctcttattttaacctcactattcattcacatttgaggatgccattctctctggcattgtcacactgtgagaggttgacatttccataaacgcatggttattcttatgtatatgtgtgtgtgtgtgtgtatgtgtatgtgtatatacatatacatatatatgtatgtatatatatattttaaaagatcccagttattgagagctaattatgggccaggcacttcacacacatagcttatctcatttaaaacccacatcctacaagtgatgctatgctcccaacatttataaacccaaaaacaggaccagagagaggagtcagcctgaagtcatatggttagtaagaagcaggttccaaactcaaaatttgatctaattcctatgcttttcggctgtcccttacccgccagcctggcaggtgttatggataacttctgctggctcctctcctcactcggccccaccctgtcctccatgctgtgtgcctcaggcggcagcctggttagaccacaccacccagctccctggctgtctgggttcagccaaagggagggggctgcagtgtaaccacaggaccagcccaaactaggcctactcttttgataacagaacatcgagttaccttgtaggtataacagagccaaaattgcaagtcacgtagcctgggcatttgtaatagaaaaactttgacctctaacaacaataagccaatgaatcctccctgtggaacgaaaaagactgggacatgagcagaacgtgaattc

SEQ ID NO: 170 - protein, 357 aa, Homo sapiens
MQSVQSTSFCLRKQCLCLTFLLLHLLGQVAATQRCPPQCPGRCPATPPTCAPGVRAVLDGCSCCLVCARQRGESCSDLEPCDESSGLYCDRSADPSNQTGICTAVEGDNCVFDGVIYRSGEKFQPSCKFQCTCRDGQIGCVPRCQLDVLLPEPNCPAPRKVEVPGECCEKWICGPDEEDSLGGLTLAAYRPEATLGVEVSDSSVNCIEQTTEWTACSKSCGMGFSTRVTNRNRQCEMLKQTRLCMVRPCEQEPEQPTDKKGKKCLRTKKSLKAIHLQFKNCTSLHTYKPRFCGVCSDGRCCTPHNTKTIQAEFQCSPGQIVKKPVMVIGTCTCHTNCPKNNEAFLQELELKTTRGKM

SEQ ID NO: 171 - DNA, 3744 bp, Homo sapiens
atgtcactttttttaagggtagtatttagtttcacaatgtttggggacctgtttgaagaggagtattccactgtgtctaataatcagtatggaaaagggaagaaattaaagactaaagctttggagccacctgctcctagagaattcaccaatttaagcggaatcagaaatcagggtggaacctgttacctcaattcccttcttcagactcttcatttcacacctgaattcagagaagctctattttctcttggcccagaagagcttggtttgtttgaagataaggataaacccgatgcaaaggttcgaatcatccctttacagttacagcgcttgtttgctcagcttctgctcttagaccaggaagctgcatccacagcagacctcactgacagctttgggtggaccagtaatgaggaaatgaggcaacatgatgtgcaggaactgaatcgaatcctcttcagcgctttggaaacttctttagttgggacctccggtcatgacctcatctatcgtctgtaccatggaaccattgttaaccagattgtttgtaaagaatgtaagaacgttagcgagaggcaggaagacttcttagatctaacagtagcagtcaaaaatgtatccggtttggaagatgctctctggaacatgtatgtagaagaggaagtttttgattgtgacaacttgtaccactgtggaacttgtgacaggctggttaaagcagcaaagtcggccaaattacgtaagctgcctccttttcttactgtttcattactaagatttaattttgattttgtgaaatgcgaacgctacaaggaaactagctgttatacattccctctccggattaatctcaagcccttttgtgaacagagtgaattggatgacttagaatatatatatgacctcttctcagttattatacacaaaggtggctgctacggaggccattaccatgtatatattaaagatgttgatcatttgggaaactggcagtttcaagaggaaaaaagtaaaccagatgtgaatctgaaagatctccagagtgaagaagagattgatcatccactgatgattctaaaagcaatcttattagaggagaataatctaattcctgttgatcagctgggccagaaacttttgaaaaagataggaatatcttggaacaagaagtacagaaaacagcatggaccattgcggaagttcttacagctccattctcagatatttctactcagttcagatgaaagtacagttcgtctcttgaagaatagttctctccaggctgagtctgatttccaaaggaatgaccagcaaattttcaagatgcttcctccagaatccccaggtttaaacaatagcatctcctgtccccactggtttgatataaatgattctaaagtccagccaatcagggaaaaggatattgaacagcaatttcagggtaaagaaagtgcctacatgttgttttatcggaaatcccagttgcagagaccccctgaagctcgagctaatccaagatatggggttccatgtcatttactgaatgaaatggatgcagctaacattgaactgcaaaccaaaagggcagaatgtgattctgcaaacaatacttttgaattgcatcttcacctgggccctcagtatcatttcttcaatggggctctgcacccagtagtctctcaaacagaaagcgtgtgggatttgacctttgataaaagaaaaactttaggagatctccggcagtcaatatttcagctgttagaattttgggaaggagacatggttcttagtgttgcaaagcttgtaccagcaggacttcacatttaccagtcacttggcggggatgaactgacactgtgtgaaactgaaattgctgatggggaagacatctttgtgtggaatggggtggaggttggtggagtccacattcaaactggtattgactgcgaacctctacttttaaatgttcttcatctagacacaagcagtgatggagaaaagtgttgtcaggtgatagaatctccacatgtctttccagctaatgcagaagtgggcactgtcctcacagccttagcaatcccagcaggtgtcatcttcatcaacagtgctggatgtccaggtggggagggttggacggccatccccaaggaagacatgaggaagacgttcagggagcaagggctcagaaatggaagctcaattttaattcaggattctcatgatgataacagcttgttgaccaaggaagagaaatgggtcactagtatgaatgagattgactggctccacgttaaaaatttatgccagttagaatctgaagagaagcaagttaaaatatcagcaactgttaacacaatggtgtttgatattcgaattaaagccataaaggaattaaaattaatgaaggaactagctgacaacagctgtttgagacctattgatagaaatgggaagcttctttgtccagtgccggacagctatactttgaaggaagcagaattgaagatgggaagttcattgggactgtgtcttggaaaagcaccaagttcgtctcagttgttcctgttttttgcaatggggagtgacgttcaacctgggacagaaatggaaatcgtagtagaagaaacaatatctgtgagagattgtttaaagttaatgctgaagaaatctggcctacaaggagatgcctggcatttacgaaaaatggattggtgctatgaagctggagagcctttatgtgaagaagatgcaacactgaaagaacttctgatatgttctggagatactttgcttttaattgaaggacaacttcctcctctgggtttcctgaaggtgcccatctggtggtaccagcttcagggtccctcaggacactgggagagtcatcaggaccagaccaactgtacttcgtcttggggcagagtttggagagccacttccagccaaggtgcttctgggaacgagcctgcgcaagtttctctcctctacttgggagacatagagatctcagaagatgccacgctggcggagctgaagtctcaggccatgaccttgcctcctttcctggagttcggtgtcccgtccccagcccacctcagagcctggacggtggagaggaagcgcccaggcaggcttttacgaactgaccggcagccactcagggaatataaactaggacggagaattgagatctgcttagagccccttcagaaaggcgaaaacttgggcccccaggacgtgctgctgaggacacaggtgcgcatccctggtgagaggacctatgcccctgccctggacctggtgtggaacgcggcccagggtgggactgccggctccctgaggcagagagttgccgatttctatcgtcttcccgtggagaagattgaaattgccaaatactttcccgaaaagttcgagtggcttccgatatctagctggaaccaacaaataaccaagaggaaaaagaaaaaaaaacaagattatttgcaaggggcaccgtattacttgaaagacggagatactattggtgttaagaatctcctgattgacgacgatgatgatttcagtacaatcagagatgacactggaaaagaaaagcagaaacaacgggccctggggagaaggaaaagccaagaagccctccatgagcagagcagctacatcctctccagtgcagagacgcctgcccggccccgagccccggaaacttctctctccatccacgtggggagcttcagataa

SEQ ID NO: 172 - protein, 298 aa, Homo sapiens
MGPKDSAKCLHRGPQPSHWAAGDGPTQERCGPRSLGSPVLGLDTCRAWDHVDGQILGQLRPLTEEEEEEGAGATLSRGPAFPGMGSEELRLASFYDWPLTAEVPPELLAAAGFFHTGHQDKVRCFFCYGGLQSWKRGDDPWTEHAKWFPSCQFLLRSKGRDFVHSVQETHSQLLGSWDPWEEPEDAAPVAPSVPASGYPELPTPRREVQSESAQEPGGVSPAEAQRAWWVLEPPGARDVEAQLRRLQEERTCKVCLDRAVSIVFVPCGHLVCAECAPGLQLCPICRAPVRSRVRTFLS

SEQ ID NO: 173 - DNA, 162820 bp, Homo sapiens
agacagcagcatgttctgcagggggtctgagtgattcattcaaggtcacatagtgagtcatttggcagagtgaagactcaagtccaggaccactcataacaatggtgtctgaaccagcagggcccacatgtatctgggagccaaggatggaaacccctgcgtggaaggaagaagaaactgcccttgatactctaaataaaccaaaggctgctgtgggaacctagactcctgacacaatgcgttcttcatagcagaggtccttccattacatgaaatgtgtgtcttcagagagaagagcagggcactaaggggtaagttcaaaaccaacatagcccaggaacagcaaagagcgctgtgactaattgtgatgtgtgccatgggcatgagtgcatagggcaaccctcatggcacacatttgccatccttgccttcctcattaagaaggaaatcagggtaatgctgctgcaggagagaaaccaggagtttggtatcaaagcagctgctctcctagataacctaaaagaataaactgaagtgatcccaagccaggtgcagtggctcacctgtaatcccagcactttgggaggccaaggtgggaacatcacctgagcacgggagtttgagaccagcctgggcaacaacgtgagacccctgtctctaccaaaaaatcaaaacattagctgggcatggtggcacacaccagtggccccaggtacatgggaggctgaggcaggaggatcacttgaatccgggaggttgaggctgcagtgagccatgatggtgtcagtccactccagcctgggcaacagagcaaaaccttgtcgaaagaaagaagaaagagagagagagagaaagaaagaaagcgatcccatcaacatggtacccgctaaccacatgtggttattgggcactgaaatgtgattatatgattgaggaactgaattttacattttatttccttttaattaatttaagtttaaattgccacatgtggctagctatatataagcataacataaataatacaaattgtaaatgatacaatacaaacaactatatgttacttataaaataaaataatgtaaaaattctattcaaaataacatatctcagccgggtgcagtggctcacgcctgtaatcctagcactttgggaggccaaggcaggtggattacgtgaggtcaggagttcgagaccagcctggccaacatggtgacacctgtctctactaaaaatacaaaaattagccaggcgtggttgtgcgcgcctgtagtcccagctacttgggaggctgaggcaggagaatcacttgaacccaggaggtggaggttacagtgacctgagatttgcaccactgcactccagcctgggtgacagagtgagactctgtctcaaaaaaaaataaaaacaattggaaaaaaattaaaataatatagctaggaacaaccttgatgacaaaaatgtgttactaagtcaggaaatgtaaaattctactaaaagctataaaaagtgactgacgagacatgtttctggtaagaaagactatagtaaagaaccgttaactctttccaaatgaatgtgtgcgtttaatacacttcaatcaaaatcccaattttttttattactggcaagatgatattaatgttaatctgcacaatcaggtgagaacagcggagaaaaagagtaccaaaggaggactggcttcattagacagcctgcaatgtagaatcgtttgaaagcagcccttaggttttatctaagaaaacttacataggataaaacaggtcttgcacatttgtgaaaagtagggaactaagcaatgaatgacgttgaagcaaatgggttagctatttgaggaaaagtcagttggctttgaaccttatactatacaccaaaattaatttcaaataaataaaaaattaaatcaacaagtggactgaactatacttagaagcaaatgagttatgtctatggattcgacacacaaagctattgaattcttactgaaaggcaaagagaagactttcaaagtattcccatcacctcttccactaccaatcccagctattcaaggtgtaatccatagaccagcagcatcaacattatcttggagctcaacagaaatacagaatttcagagcccacctcagacctgctcagtcaaaatctgcatgttaacaacatccctcaaggaaatcgggtgcaccctggagtttgagaagcactgaccgaaggcaccagggactctgtttccaactatgaccctggggtcatgggctcccctccacctctctgtgttcgacatggctgtagtgaagagggtaggcagggcaattcctcacagagatgtagagcttgaacatatgggccgcaggaagcatttaaaatgcacatccggctgggcgcggtggctttcgcctataatcctagaactttgggaggctggggcaggcggatcgcctgaggttaggagttcaagaccagcctggccaaaacggtgaaaccccatctctactaaaaatacaaaaaattagctgggcgtggtggcgggcatctgtaatcctggctactcgggaggctgaggcaggaaaatcgcttgaatccaggaggcggaggttgcagtgagctgagattgcaccattgcactctagcctgagcaacaagagcaaaactctgtctcaaaaaaaaaaaaaaaagaaaagaaaagaaaagaaaaaaagcacatccacgaaaatgccctcagctccagtcttgactgaccccactagaccttcaacctgcaactgagggactcatcaccaggtggtagtgtttccttatgaagctctggctagtaaatgtttcaggaatagattatgaagtgcaataggaaaaatgttttttggaaatcaaaaattgaaatctttataaattagtcaaatacagttttaaagctgttatgtaataaatttggaaatgtaaaaggtctagctttaaagacacgctttctaatgatatctaatccgtcagtggtgtgctgctatttaacaattggctggggtaggggagagccttggtttgtggtgtttgctgatttccctgtgtaaatgctcccactgtggctgatttcaggtcactgaacatggagttgggaaaagatgtgcacagttgggcgtcgcaaggaggtaacagccagctccgggccactgcagtaatgacagtaagtacctgtaaagtacctcacagtttctgaagttctgttatgttccccatctgatgccatgtgtgtgcctgattttgggggctgcaaaagataaccatgatctgagccttgcagggcaaggctcatctctgcagctcccacccaggatttgcacagcacagatcttgccctggctatcttttctccattgacagcagaagcaagcagcactcactgtgtccctgggaccaggccgaatgccctctacatattaccacaatccgtcctctcaccagtttcaagaggaggccattttgtcccctttctatagaagggagaggaaaaaaaaaaaaaaggccatgagggaggtaggaattggccaaggtcatgcaggcaggaagaagctgcacaggttttctgagtcaatacaagtctctctaattccaaaatcagatccctgctaggcgccgtggctcacgcctctaatcccagcactttgggaggccgaggtgggtgggtcacctgaggtcaggggtttgagaccagcctgaccaacatggtgaaaacccgtctctactaaaaatactaaaattagctgggcatggtggcgggcacctgtaatcccagctattcgggaggctgaggcagtaaaattgcttgaacccaggaggcagaggttgcagtgagccaagatcgctccaatgcactccagcctgggcaacaagagcaaaactccgtcttaaacaaacaaacaaaaatcagatctcttatccaattctccccaaagttccacattctaaaagttactaagaaatgctgttaaaccaccttctttaccgcaggacttcccagaccctttacaattctaacaaatatcacggctctccaagagaaagactgggaatgcggcatttcccaacatagttgcttctgagatctcctttcactgggtctcctgacctaaggaacacattttggagactgttgcactgctccacagtcctccaggaatgacaaacttctaggacttgaaggggccatacaggtcactgggtccaacactctatccagagacagggagctcacgcccttccatcacgtccccattgatctttgaacaccaatctctatttcttccaaatctggtgttttagatctcctctcaggaccagtgcactgaagagaaagggactgatggttctgcagcacccacaccgtgcaggctcctctcgctcctctagccctcaggacagcaaacccgtgcaatgtgcatcatcatacccagtgtcaggtgaggactgtaggcacagagagatttaggcaacttcctccaggccccctctcaattctaactcttaactgccatgcgtctttggctccctttgtaagatggaagcatggagaggaggaatgactaacttacagccttggaaatgtagaatcaggaaagcctcacaaaggggatgagtgggaggatgatgagtgagctgcagtttggcaggtggataacaagaggaaagggcatgctggctaaagggacagcatgtgcaaaggccctggggtgagaaagagcaaggcactgtcagggcaggagcaggaggggtgcagtgagggcaagccagctggagtggggggcccagccatgcggactgctgtagacagtgagggtaaggcaggacaggaggccaggggatctgagaggctcagcatgggcaaaaagggaggctgagaattggggaacgggatcctgaggctgttagagcacccagggtggagagggtaatcaggagtccctcattctggtatagcactttacagtatgctaccccttccatgcacacatcctcctctcctgcaaacaccccccacacccaaaacaccagcatccagcgcagggcctggcactgaccttcagaacattctcatccccgaatccgtgagtgaacaaatacctccttgcagaaggcctagaagaaggcaggaaggccaccagcccaatcttatgggggaaagtgagacttcagaaagttaacgactagcccaagttgacaatccgtaagaaggggacagggcttgaactcagaccttttggctccaagactcagagctcggttcactgccctgcacaggatgctggtcccagcattgggattcaaggtgaggactgacctcagggtcagcaggaagtgctctgccaacagaggagccaccagcctggccagccggggacagcccgggcggctgctttcaagggacagagtgcaggaggggttgggcctggaggagtcctcacacccctccgcactgaagattccaagagtctggtggggggattttaggggtggtgaacggcccctgagttggggtctgcagagctggggagacttcgagccaggcagcagccagccagtcagagggagacccctccactccgctgccacctcctatcaccaactgcactatccccaagactctgttccctggctctcagagaatggcaggcccagggcagccccctgaccttcctggtccatcctggccatatgccctgccctgccccagggcttgctccaaaccaacaaacacccgggttttatccgaggagagtggcctgcaggcccaccttacctcatctcaccttcatcaaccaggacacttcctgattttcatttctacacttagacctcagggctacactaaggcatggtttattgttcagtcagcttcctacccgtggacctaatcacaaatattctgcagtggctctgtatcttgggacatgaagcatggtctacacgggggaagagacgaggtctgcatctccacagtctgtactggaagctgtgtgcttcccctttgaagcgttttcttctctcacacaatgagacagctgaaccagctcagtgtttctggaggcatggcccacaaaccacttacatcagaagtgtcaaaggagagtgttgacatgcggatccccaggccccaacccagatctatgaaatcagaatctctgaagtcagcacccaggaatacgcactttaattcatgccctgccccacccactcaggtgactcacatggacactgcagtttggaaaccaatggagtccatggtcactgaccttacgtttgatttcactacattttcttttagagaaacatagggtatttgcttggggcctgctgtttgtccactccaataacaagccactccaataacttcctcactcaggaagtgaggaagacttcatagatgttccataagatagtcacctagagataagcccaggttattggaggaactaaatatgtagaattcaaaccattggaattcctctcaggaaacaggctgaggtggggtggaggggccagaggcggggagcgttacagggaaatcctacccacagatgcatttagttcattgcaagtttccagcggagggatttaacaggtttaaagcagttttctgtgaatctttgtcaagggagtgtatgtacaaacaaacagggagggtttttttagtaaaaagttaatcggcttaaagtgtgcaactaaataagcaaagcttacattaaagtgacccacagagaaaggacccctagaaagaaagttctaggaaatacaatatggcctctatgttcttttgtagttccacgctataaatattcatgggatggtgttaatggggtctacagctctatgcaaccacaatagtttttttgtttattctcaggaccatgaactttgaaaccatgaccctaaatttcaggactctgcattcaggcgcgtttgcagaacaggaggggagaggttcgggctcttggaggagaggaaacaggcgagatgtgaatcacgcctcctggatcttttggttgagattaaagggtagggtctgtttagtatgagaagcctcctgtctccagggtccccagctgctcctgcctggggagatggccttctccaggaatagatggctcagttgctcaagcatacggcagagaggagtggagagatgtaaatgttttaatgggatcaaacagatttggtgcaagttttacattgaagacttggaaaactttaaaactgaagaatttctaagacagagaatttgaaagtcatctaagcaatgtccttgttttccatatgaggaaactggggtccaagaaggtcaaatgacttgcttaaaatattgcatctagaagccatgtctgggactcccaaccatgggcttttcctacaccagaaaaggcaaataagagacaagcatgtgcctccccttacccactcttgctcaggatagatattcctaattgatcacagctctcctgtccattgagcctggacacagtctctgaatccatctcaacacagtgttacagagggtcaacagaaatggacagaaatggtgcatgagttgagacctatttgccacctatgccctacagcatgctggtaacattcataatccattacccatttgttccagctaagggttttccattttctaactctccatgttaaaggtcagtcaggacctaggagagcgccctacacagctaggtcctccacagccgctctgaaagctgactgcttctcaagagaacacacagccctgccctctgccttggctggcatcatcctacttgacagatgagccaagggggtctggctggtacctgggctggcgaccaccttgcttaaagcagatacagtctcctgcctcgcctcctcatctatatcataatatggttgcatcaatacattacagaaatgtcacagcttggctttcccagcagggctcagttgaatcaacaaacacacctgctcagctaatttccaaaaaagaaaaattagccacaagattggtttgggcaggccggccatatctgcaaggctgtttaagttttacagctccaaataggtttcatctcacatgccaccccactcaatgggtggtgcttctttgagcactgtaaggtgacttcttggacccataggaaagagagccacgatcaattagtaatatctgccattagcaggaggtgtggagtggggagggggttgcctgtgccacacatttgccattcacatattacattgtaaggatactaaaaatggccgggtgcagtggctcatgcctgtaatcccagcactttgggaggccaaggccagtggatcacttgagatcaggagtttaaaactagcctgggaaacatagcgaaaccctgtctctgctaaaaaaaaaaaaaatacaaaaattagcccagcgttgtggtgcacgcctgtaatcccagctactcgggaagctgaggcaggagaattgcttgaacctgtgaggcagaggttgcagtaagctaagatcgcactccagtctgggcaacagaatgagactctgtctcaaaaaacaaaaacaaaacaaaacaacagcaacaacaaaaaaatacagatactaaaaatatttcagtccaggtaatagctggggcaaggcctgaactacgactaacgttatactttgtacacttattcttcaccctctccactctgctctgtgtccaggaagcgtgcttctgtggacggcatcctccagtttcccctcgggtttcctccagcttctggttgctttcaaccaggaagagatcttggcagaccctagggaagaggagagaggctgtgcatttcttccctgctagatgctacaggtctagccatagacacatccctccgcaacttcccctcctacccagttccagctccagtagcactgctccctcccctgcccctcaccacagggataatgggctcatctctgtgtgtctcacctctcctgtttgttcccttaaccctgcatctctaattggccccttcgtgaaggtctcttcatctgaaacatctgggataaattttgtttcctgctgggactctgacttatagagctttgctaagaaaatctttccattatttccatagccaaataggaagatgggattctggctggtaatagggatgactactttggcctatgccaacacctttcactgcttaattgggcagaatatgacttactgctatctcatgcctgctgcgttcccacagcatgagctcacacgggctccattaggtaatggagagaggatgcagtttaggtcctaataacccaaagcttcttgggctctaattttacatcttatgtgcttgatttgaggaccaggcacatctcataagccctaatagcttcactgtgaaatgatcttttgcagagccataagttgcaatttaattatgcaggactcattctgaagacaatggccatgggagaccctaagtcgcagaggatggaaagacacgctaggcggagagggaaggaggactgggatccacctacggccatgccaagagctattcagatggccttggacaagttactgcccctcccaggccttcagggttctcacgggaaatattaaaagcttagaataaataatccttaagattccttccagctttaacattctagaagatttgactcaaagatcttgcttggtgtagctggataactttcagtcatggtagtgggcctgttgccattttgactacattttcctcataaaggtccagccagtttagcttattgtggcagagattgctcattgtccaccaatacttctctcccttcttccattttaagagaacccctgatttttagctccaggtcctccaaaataaagcttttccagactcccaaatagctgtctgtggccaagtgactaagttctgtccaatgagatgaagcacaagtgacaaatggcagctcccaagaagctggttctcacacattctttgtctcttttacttttccaccccttccatatccaaaccatgcccgtgatgatttgagctctgcataccgtcttgaccatgaggacaaggacctcaactgagggagagtggagtggcagactggaaggagcttggatcttagatcttgaaggactttctgaagcagaactgccatatcagcccagaatggagacctccagattttgatgtgagaaaaaaatagacttctagcttgtttaagccaatgtctgagataccaatatattgcctcttggctccaaatctatccttctttgtcttgctttgtgacactggaactggaccctgtaaacattgctccttcaccacttgacaccatgttaggctttatcagtaaaagacattggaaggataccgcaaatagaagaggggattgctcttcctggttccagtggtctcaccttgcacccatgggaagggctgccagcagtgttcaggaaaaccactggcaccaaccctccagagttttgccaatttccactgggtaattccctgctggtcagtatctcagtgaactccccagttccagtgggccatagccactctctcttaagaagtcagaatttcagcccgggatgggtggaggtgggggtggcttcctccttccctagtagttgctccttgcatctgctatttttgttttctttagtgttccctttacctcttttggtagtcaacccccttttcctagttgataattatattacattttctaattactgttcaaattactggtgtggtttcagtctcctaactggaccctgatggacacagcaaattaacttgggtctgttactagcagtttaacttaatctgaactgatacaaccatacaaacatctctatgggaaagtcaatgatatggtgcagaatgagccctctgctttttaaaaatcctctctccaaaaatttgtttgtggcaaatatgacagaaaaataatgaaagtccttaatttagtaggaaaagggttcccactaaatgtttttaacaattctctaattagaaaaatgagcaggaacagaagaaaaggtgcatgaataggaatctcaattagcagaagaaatacaaacaatcaaaaacgtattttaaaagggtcaaaattactgaaaaaaatacaaattacaatacaagtgcaagttgaagaaatagaaaaatacttttctccaaccagcaacggttttttaaaactagaatataaactattaatcctaatgggagtgtaaaggtataaaaatcttttagctgggtacgatgcctcacacctgtaatcccagcactttgggaggctgaagtaggtaagtcacttgagcccaggagtttgagaccagcctggccaacatgatttaaaaaaaaaaaaaaaaagaaaaagaaaaaaaaatctctaccaaaaaaaaaaaaaaaatacaaaaattagcccggtgttgtggtgcacacctatagtcccagctactcagtaggccaaggtgggaggatcacttgagccctagagttcaaggctgcagtgagctgtgattgcgccactgcactttagcctgggtgacagtgagaccctgtctcaaaacacaaaaacaaaaaacaaacaaaaaaaacttttgaagggttgtttgaaaaggagaatcagaaggcctaaacgcattggtacttttgacccagcaattctacttctagaaatttattctaaagagataactcacgatgtatataaacatctagctacagagatgattccagcatcattgtttataaaagcaaaacaaaaagattgaggttcatgcctgtaatcccagcacattgggaggccaaggcgggtggatcacctgaggtcaggagctcgggaccagcctaggcaaaatggcgaaaccctgtctctacgacacatacaaaaattaggtggtgcatgtgcctatagtcccaggtactcaggaggttaagtgggaggatcacctgagcccgggaggcggaggctgcagtgagtagtagttgtgccattgcactccagtctgggtgacaaagcaagataaggaaggaaggaagggagggagggacggagggagggagggaggggagagattgagaaaaaaatctgtatgtccaacaataggagattgcttaaataaattatggtgcatctatacaacagtgtataaagcaacttaaattggttttgtataagaatgtttattacataagcatctttattgtcatagagagaggttcatggtactaagtgaaattcaaacagaagcaggttcaagccagtaggtacagcattttcaggagaagaaaaatgttgcaaacatgcctagaaaaggtgtgggaatatcatacaacagaatgttcacaacaattacttctaggcaatgggattactggacatttttacttctacttgctgtatgcattttctaaatgttttccagtggatgggaattagctgtgtagttaaggaaaacatttcatgttaaaccattatctccctttccaccacctcaagggcaccccagtgcctgctgaatatgtttgagtgaactcatacatgtttcaaccacgaccttggggtacatctcagctccggacccctcccacccacagagccactatctcttcccactttccctcccttcccattctcaaggccatagcctgcatcctcatgctccaggactcgaactctgagaggtcctcctgcttcctgcttctacagatcctaagcatcacaggtcttcactgtaacagtcctctgctgagaaactatcaatagctccccatttccttagggatatgtttcaaatgtttcagcttgacttccactgttccaagcttatttcaatcctgtcattaccattctgcaaagtaaaccagagtaaatctccaactccagacacatcacaaacattcctcacctttgctgacactgttcattctacctgaaataccttctcttgcatcccagcatctgcaaatccaaggcatccttccagacccgcctcagagcttaccaactccctcaccaggaagtcttccttgagttgactgctaccctttctgaatccctctggtatctcattgactgagttttccatttgacaaataccggttgggcacccaccatgtgctggcactatgctcctgactgtgaagcaaaatcagtctcgtttatactccttggagctcattgtccaatgcagagacagtcattgaacaataatactcacatcagtaatagacccagttacagattgtaaagagtgcttttcagaaaaacaaaggcgatgagaaacttgaaaggggacctgattgagactggggactgggaaggcctcatgggggaaatgacatgtaagctgagtcctggaggatgagtcagagttgaccacacatagagtccagagacatttccaggcaggaagaagaaccgatgtgagctggaacctggcaggtaaggggagggaggctgagtcatagggacaagcaatgaccagagcaccccggggcctgctgattgctcttatcccaagtgcaatggggtgacattaaaggatcctaagcaggtctgatcttgcaaacgtgatcacacatgagtttgagaaagatcactctgcaatgtggaaaacagattttgggaggcaagagtagcgtcaaggaggccagttcagccactactgcagcagcccaggtgtgagcttggaccagtggcagtggggatggagagaagtggacgggctcaatttggaaacagaattgacagcacttgtgttgggcggggtgagaagaagagggaagtcaggtgtccaggtagcaactgggtttctggtttagggacctgggtggactctggtaccagtgtggtatctgcacccatgaggcccagtccttagtgagccaaggaggacaggacaggaaaccagccctgactccacagggaggagaggcgaccctgcgacctgaaaaagagttaagaaggaaggtagcttgaggctgttgctgtgggaagccagcttacaggactcacatcgactccaggccagtaacctgggtgggaggcagggaaagaggctgggtgcaaattgcaggatgagacagaagataagtggcccagctggcagagcaggcaaagactcagggctgaacatctccactcaagtgctcatgcgggcgagcttgagaatatttattggtaattggcagaagtggttagaggtggcgtgatcacagataggtctgtaaccaatcagcaggaaagctctgttcctgttgctatgtttgcatccaggcagaaccgtattatgagcaggctgagagggtaccatgagaaacctgcttctacacatttggtttatgtgtcatcctctccctgcttcatgggtgagagcaagtgagctgtggagcaataaattatcacttgccacatgctatgtatcccaggagaactcttagcagccctgagagggagagattagcattcacaggccagtgaggttgttacttataaggaaattctaaaatagggaataatactatgagtaataataataatagcaagcagaagagccagcagttaatgactgcttgctaaacacttcgtgttcactgcctcatttaatcctcaaacaagattatatgatgggtttcaatatcgttattttccaaatgaggaaactgaggctcaaagagattaagagacttggtcaaaactacacaggaaataaggggggcagaggcaggtttaaagccatgggctgcgtgataccaaaaagaatctctacaacaggatgctcactgcttctgctctttatcagccaagcctccttgggaaagattggccatcgaagtcttctccctgtggaggtgaggagagtggttggacccatcaccctcaactgacctgatacccatgcactgaccctgggccttctggaagaggggtagaggaacagagacggggacaggtgcattttgacacctggtattattcatttattcttccctatgctttaggacagagtacttggaaagccagaattctctcgtccttgtcagattcctagacaaggataaagaaaaagatagggagacggtcatgggctttggtgctcagggaacatatacacaaatgtgaccttcagactgggcagcatggagaagctcgttcactgggggtggaggcagccaggcaaagctggaggccccagggttgaagaggtcacatggcgtagaggggaaaacagggattagaggtctcaatgtcgtgtgcaggtcttagcccaggctctcccctatgcaagcaacctgaccatggcctgtaatgcccctgagatcatgtgagcccaggccatctcctgcgagtgctcccatcaactcctaggggttgggagaagccaccagctgaatggaggctcaggcccaaagccacttatatgtctccaaatagccaggggctggtttcttcggtagggctcagacatctggttggcttgcagggaaccaaatgccttagcctaatgccatcctcagtgaggccactgagattcatggaagatttaagttttaggtcaaagtctctgggtatagctgggcatggtagctcaggcctgtaatcacagcactttgggtggctgaggtgggcagatcacttgaggccaggagttcaaaaccagcctggctgatatggcgaaactccatctctactaaaaatacaaaaattaccctgatgtggtggtgcctgcctataatcccagctactcaggaggctgaggcacaggaatcacttgaacccaggaggcagaggttgcagtgagctgggatcccaccactgcacacacacaaaaagtctctgagtatagatgagctatcagaattggcaccattagaaaacacaaatcccttaaaatcccataaatcccttaaaaatcaccaggctttgagtattagtccattctcacactactgtaaagatactgcctgagggccaggagcagtggctcacacctgtaatcccagcactttgggaggccgaagtgagcagatcacgaggtcaggagattgagaccatcctggctaacacgtttcaccgtgtcatctctactaaaaatacaaaaaattagccaggcgtggtggcgggcgcctgtagcgccagctactcgggaggctgaggcaggagaatggcgtgaacctgggaggcagagcgttcagtgagccgagatcgcaccgctgcactccagcctgggcgacagagcgagactccgtctcaaaaaaataaaaaataaataaataaataaataaataaataaaagatactacctgcgactgggtaatttataagcaaaagaggcttaattgactcgcagttctgcatggagtctgatggagaagcctcaggaaacttacaatcatggtggaaggtaaaggggaagcaggcacatcctacatgggaacaggagagagagaatgcacagaggaaacagccacttttaaaccatcaggtcttgtgagaactcgctcaccatcacgagaacagcatgaaggaaaccacccccatgatccaatcacctcccaccaggtctctcccttgacacgtggggattacaattccagatgaggtttaggtggggacacaaagccagatcactttggttgttcagatatttagtttcctgccacttggaaaccttgctggatttctgtgggatgacaataattttaaaaatagtatttactggatgcttaccatgttcagacatgattctaagtgctttctctgtattaatcactaaatcctcataataaccctatgtgggtagatattagtaaccacattcatagataaggacagtgtcccagcaagcctaggcaggtttgcctacagccgtggagtggtagagccagtatttgaacccaggaaatttgcctctagcacctgctgctttgcccacaggctgtctcagaagtatggaaagcagtgctgttcatacaattcagttcactccacacacttgttggggcataacaagttcttcaagggccacataactctagcactgtatatttcatatttattgagtgcttctgttttctaggcatggtaccaagtgccttcatatacaagcctgttaatcagagtttctattaacggcatgatacacaaacggacactgaggctttgaaggctgagggacttgctccaggtctcaccgttagaaagtgacagagctgaggctgggcgcggtggcttgtgcctgtaatcctaacactttgggaggctgaggcgggtggatcatgaagtcaggagtttgagaccagcctagccaacctggggaaaccctgtctctactaaaaatacaaaaattagccaggcatggtggcgggcgtctgtaatcccagctactcaggaggctgaggcaggacaatcaattgaatccgggaagtggaggttgtagcgagctgagatcgtgccactgcactcaggcctggatgacagagcgagaccccatctcaaaaaaaaaaaaaagaaaaaaaaaaaagaaaaaaggaaagtgacaaagctgagaagaaaaacctaagtcagcccaattccaaagcatgggtacagaaccacaacatgtcagcaaggtctttgttctccacagtctggggaggggccaggtgctcaaataaccatagtccaggctggggagtgccctgagaatggctggagaaccagtggtcagctggatggccagagctgaggtgctgctgcatgagatgccctgctgacctgtctataatcagcttccatctaggagcctcttctgctgagcaggctgagcctagcactgggtaggaggctccccaagggcagggttgagtctaaccagcacttagaccctcagcacccatgccaggcccacatgccaggtgcactgcatatctggggctgtgtggatggctcggtggcatcatgcctgtccccactcctctcctctcgctgtgtgggacagcagaggaaaggatgctctcccaacacacatgccaccctgagggaagggtgtgctgcactgatcactacactactgggcgggagagaaaaggaaaaaacaagttccactgatgtaagacttggagacctacctttgattatgttgttgtggacttttctgtctaccaaatatgggctctgtccacagaggcatcaaaggatgagcaaggtcagggagaaaatctaggcctgaagctcagtttcctcatatacaaaatggcagccattgcagctgcttgtctgctctgggggctgtgctgagggtcagtgggtggtgttcttgctgtcattcagctcccagagcagccccctccaagaggggcctgatacgtcttccttcctggtcccccctttcccagactctggcaccccagtgtgagacctggccactattgagaactctaggctctgcttggcattggatggccacacactccacacctgcttggctgagctgaattctcagctcgagcagctgtgccagccagccaactgttcctcaggggctaaggccatgagctgcctccccccagctctgcccctggccctgccctcatctgcatttacttaaaatctttattgagatataactcacatgccataaaattcacccttcactacttttgagactctgtttaaccacaatgatcaggtctgaaattaagaatctctaaccctaactatactagatgaaataaattactcatttattgcaaaaattcaatttcctctacagcatttcaacaaaagagttcaagaagtgctgtgagcacctgctctgtactctgataatgtatatatcattatatacttgccttgtgccagatactgtgctcagcacttgacaaacattgtattatttaatccttatagcaatcctgaaaagtggatattactagttctttttttccctgaggctcagggaagttgagtaacatactcaaggtcacacaggcttgcctaggtggcagatttggaatctaggtctggcctgcatcagagcctgtgctcttaactggctcacaccctgccccattgcatgctggtgtgtgaaattgtgtagagaaggtggactagattctgcacctgtatcatctggagaaacaaaaaagacaaacatttaactccaatattgccctgaaatattttaattccatcaaatcagcacctgcccatcagcaaggacatcataacaagttagaatggaaataaagatgtaaaaatatcagccacccttacctaggtgtggcccatggtgtgggagtctgatgggcaggtggagtaccagagagatggcagctcacattctggggatgggtcatgccagggagacaagcttccaggaggcaccatgtgagcctcatctctgcttaaaaaccaggatgcccgccctgccatgaaggttggcgactccagaggagcactgcccaggtctctacaatcttcccaatgccactctgggcacttttaggagtccctggcacactggcccagagctgcttcagtttctaggctgacagtaacatgagggctgctggcaacagctgccccagagagggctcttggtgagccccaaaatgaaacctgattggtaggatgtcttggagagaatggcagagtgaggtgaaacaccaaattccaggcagaagtaaagtctgaagtgtgggcttaccctcactactggttcctgagccataagacaagagggaccaccagctatatttatcctatcctaacatgggacccacagctgtgaagaaggccctggtatttaccaagccatccactgaaaagtgaagctggctatcaggcagttcccttagatttaataaacccaaaatgctatacagcattttcatatcatttgagcctcatgtagacaatttttgagtcacataccctcagctcacctctgggcagttccatgcctctgccacatgtctccccacctttctgcttgagaactttttctaaatctgtagagccctctattcctggatattcagggaagttaatgcctcggggaatgtggcaagtcatcttttccaaaactggccgcaatgacatctctcatttcatgtgcccttttaacaacatgatattgacatgcctcccactggagaggtgggtctgtgctctcccaccttgaatctgggagggcttgtggccgtgatggaagtgataatgtgtgactctgaggcaaagccatcaaaggtcacacagtttccatttggttctcttgggatgcttgcacttagaatccagctgccatgcttcgaggacacccacatagagagaccacatggagaagccacctataagtgttctggccaacaggtcccaggcaacagacagcctcaacagccagacacatgagcgaatgagccttcagataacttcagaacccacttgttgagtcaccccagcctgtaagtcttcctagctgaggcttagccatcatggaacaaagacaagcctcccctgctgtgtcttttctacattcctaatcaacagaatcatgaacataataaaacagaggttgttctaccccactggtctggaatgctttcttacagaggaatagaaactagagcaaggagcagacagtgaagggcagcaggctttggataaatgctgcagcctcctattctctgggcagataatttgggaggcattctgtaagctcctcaaaggcgctcccagtggggtcaggggcccattgcctaaagcagctaccttgattccactcccttcattggatttccttcctccctgtctcattcctcctgctcccttaaccctgcttcctgggatcaccttccacatgaactatctacaccaaagtccttgtgtaaggctcttctttctgaagaatccaactaaaactggccttggccgggcacggtggctcacgcctgtaatcccagcactttgggaggccgaggcgggcagatcacgaggtcaggagattgagatcatccaggataacacggtgaaaccccgtctctactaaaaatacaaaaaaatagctgggcatagtggcaggcgcctgtagtcccagctactcgggaggctgaggcaggagaatggcgtgaacccgggaggcggagcttgcagtgagccgagatcaggccactgcactccagcctgggcgacagagcgagactccgtctcaaaaaagtaaataaataaataaataaataagtaaataaaactggccttttgtctaccctgcaaggcaagcatttttgctcccactcccattttgtagatgagcagactgagacatggaaaggtaaaatgacttgctcaaggccacacggtgagtaaggcggggcagggtcaagataagaacctaggccttctgacttgaaatcagcttaaaacttgtgggtgaggataggcaggcaggcaggaacagtcctcccaagctttgctgtcagaggcatggtggttggaagaatgccttgtgatttactgccagttgaacccttagctgtattgacagcatcagaagaaaaacaactggcagagctatggatgaccagacagagaacaccccccagaagccccatgcccctcaccagccccaggccaggagggcttcacagactaacttccactcccccgtcacttgatttaaaagtcatccctttttacagcatcaaatagattgtctattagcaaatttaaattttccagcttaaaacctgctttaaggtcagcatgaagatattctttccatcagtttctagaaaatccatttataaaaagtatctaactatatttcaagcactgttctaagtactttatcaggaatcatccccatttacaaatgaggaagctaatgcccagagaaatcaagtgatttgcccaaggatacacagcttgtaagtggcagagtaaatggtaaaaatggtattaaaaattgcaaaagtagtgaaatggtaaaattagaaatggtaaaattaccagtttgttcagcttctaagaggttgggctagaaccaaagatcatagactcatagaacactggataggaagcagccagggggctcacactgaagtgcttgcaaggtatgaagtaggcccagggcaagacggttgatgaggaccaagagcacaagctctctggacatgtcactttgtaattctaacaaggcagacattttcattctgcaggtaaggaactgaggcccagagaggaggggagtcgtcccggtaacacagatcctgaaaagccaggaacagattcaagaccctcccctctgcattctgagtccacagtaggaatggagacccacaccaagaagggacagtgggaggtgttttagctttgcagccctgaggcaggtcctaaaaggagagcttctggccagaagagtcagggagttaggatttcactgagatagaatgggaggctgcccctaaaggtttgccttaaatatgcaaccaggaaatgcagtgtcccgctagccaagaggcaagtcctttctctgagacttcagtacactgatgaactgcttgctggccttccagacagctgttctccaggtcaggcaatttccaagaggatgggcggactgagatgttaccttttcccccaggttgtccttatcatcgccctcttctggccactcttagcatcagtgtagcccagggagaggccaatgagttgggagaattcaaggagtctgaggagggtgcctgcagctggctgaagccacactggccatatcctctgccttccagccctgcctgtgcatcccattctgtctgtgaagaatcacagaatatgcgtgcccctgattatcttgcattttctctaaaattactggggaaaatgaggctgtaacaggcaagcctgcctcagggttatcctccaaggctgagacggggagctggcatgcctctttcacatctggattcacaagtgcccagaccagcacccagcatactggagatgcacaatacattcctgagcaaatcaatcacttccccactccgggcctcagcggcccacactgcctcccagagtccccaggtcacacccagcagggtctaggatctgacaagtgggggaggtggtccagccactccctttatcccacacctattttcccagcttcagtggccctcttttcagggccaggctgccattccaatagtgctctggagcctcttctccctggccttgaattaggtcccataaggaactcatggtacctgggccaggcatgctacctgctgaggttttctccagttgtccaggaaccaactcctctgcccaccttcctaactcagaagccccaagagatacagcagtaggtagatattctgcaggaaacttcccttactaagaccaggcccctcaagactagtttgatctcaaaccttcacaagattctcaagtctcacaaactcctcctgcctcctagtaacctggtcttccccagactttacccagttctgaccctcccaacccccagcctagacccgagccactgcagtgatagaaacaataaaaaataacgacaatgccatcatttcacttgcagagaattttcccacaaatcacctgagtcctcctataattactgccaccaatttagagatgagtaacctggaactgatagaggtttccagggcgtgaaggggcaaccactggcccacaggccccgcagagacctggccggccacagccccgggaaggagcacctgcctcgccgagggtggaggtcgcgctcttccctccccattcttctctgccgaccgccaagtgaaacggggccccacaaagccggagataaacaccactactcgcgggacactggccatgggccaggagcgtctgtgcgagcctctgagcccagcatctccctgggagcgtgagcgtgagcacccctctgtccgtgctggaactgccccacactcatcagcttgctggaacatgcgcttggcccttcggaggctaacgcttcaacgactccagctcggaagccgctcccctcaggactcacgagccgatcagtggccccgaggaagcgggagctgcagcgcccgggcggcgattgcgcccgaaaggcccgtacgtcctggggcgccgcttcctggagggattagagcacctgccggcttccatctccgcccgcccagagcgaccctcaggccggtaccgctacagggaagtttccggctattcgagtcttgctcattctccctcggcgacccctttccttttgcccgctgtgacgcttttctttttaaaatctcccaagagtaaccacagatcttgggaaactttgcgcgaaacttaaaaatgctgtgaaatcggagccaggaactccatctgagcctcggagcgccgcgcccagtccagctcttctgctccggcccggagcgtctggcggtggccagtgctgcccactcgctgtcaggcggccctggcacccaccccggcccctgggcgccctctcggcctctggcacccgctctgattcgctttgggaacgcgccagctgtcgccccccggtgcgcaccgcaaacctggggccgggacatcccagcctcggagtggtttttaagcaattcctcggaggcattgtcttccgggggagccggggatctcaggggaggggaggggagacccgccccatagacggtagtgcaggcttgcccaccacctcatttgcatttcaaaggcaaacttctgcgggacttccccagcggcggcacctaccggctttgcaagggtcgtggtaatgctccagctgctgctccgtgccctcctcgccgtccagctctgagtagtctgcggtggcgtccgggcgctccccgagtcccccggcgccgcgaggcagcggcagcagcagcagcagtgacaccagggccccaagtgcagtcgcccggggcatggtggcgcggggccggctggggcagagggagttgcgtgcacgaaagctcagctcggccgaaagacggcgcacactgggtcggtcggctccggccgggactcggtggttacacagggctgctgggcatggctcaggcgcggagcaagcggagcgcggcgccccctgtcttcgtcgaggcaaccgggaagcagccgctcggagctacttgcccggcggccgaggctgcggcggctgcgagtgtggcggtggcggcggtggttggagcagtggccgctccgcccctctccaccagggctggaccacacagccttcgcccggggccctaagcagccaatcactcgggcgcccgaggcgaggcccctcctcttcccggcaccttcgcaacttcggaggcaggcgagcgaggtgaagatgctggagccaaaggccggggccagctccgcacccacccagcctaaggcgcctgcccggggcgccacctcggcctctggctcccgagaatgctgctcctgaagatcgggactgggcttctcgccttgttttatttccataactcactttacaactccccgatgcacacgtggccagagtggttagaactcggagcgctggaccaggagccctgtgtacggattcatgtcactaccaactggctatgtgcattcgggcagctgcttctttgcagggatgagtgaatgtctctcaggtccctctcagcaaagaaaaaaaaatcgaggatttcgattctctcagctctctccacattccctagtcgagccatgaagggcgcttgctggcggcaactaacctaacctagtggccggcgataggtaatgaaaaaagatttaagtccacagatttcccctctcggtgaccctatctttcagtaaaaccgtctaagatgcttcacacagtcaaaaagacacaaatgaacagctgtacgtgctacttgtgttaaattacagacatgtttttattaaataagccactcaccgttaacttgatggaataaaaatgaccaatttctgaagtctgttttttttttgccaattaaaaacatatgcccaaataatgacactaatcaagagctatttgaaacccacttctattttgtacctaaaatgtaaaaattctcagaactgagccattttgatttagagatataaaaagtattattactgtgaggcttttcaaagatctttttatgcaagtaaaatggccctgtcaactataacacacaaatgtgtatgtgtagaaatgttttgcatcatgcccagtagaatcttttttcaatttaaactgcaagcagaaaaatggacaactttccttttggatttccacatggtttcacatacatcaatgacaaaatagtcaacagggagcccagagctgggcttcacatcaaactctgaatttcttgcacttatggtcatctgtcttctcatctatcaactgggataacaagtccttcacacaagtaaagggctaaaagttaactattggaaggatgctactcatattttgtcctcgttcttagaaagaaatgcaatgttgaccctgcctcatgctgttttcatcaaatgggcacataacatacagaatggagccagacagggcaagatctggttagaaactggcaggtggaaggaaggaatttgaagaggataaatgccaccaaatggcaggaaggccaagtggccagcgcataggcaaaggagtgggagggggttgaatggcatgcatttctgcctgaaagccaggagtcaaacccaacgccatagctctctgcattcacccccatgaaggtcatcacctctcagtagacgagtccaaagagtcaacatctaaaaggcctaacaaacttctgtgacacttccaggtctccagatggcactaggcaaaccaccaactggcttccttattagaagggaattcctctggaaaatagacatgagaggccacctcttgtgcaagcaatgaggttgtgagcttttatgacctctaatgcccagctggtgagtagtggccaggtcttctcaccaacaccctttgtccaaatattttgaagacagtggtgttgaagaatgaacaagctgcacagttttatgttattaaagtagaaggccagtttagttgctactttggctatcaaccaataaatggcaacaaaatatttggttcactagaaagatcagaaaagaataattgaaaagggacaccataagatagaactataaaagctaaactctaatctgggtttagatgatttttataatgtatttttctttaatttaaaaaccatgaaaaaactggaggtagagtaacaggctttatgacataaaactgctcaacttagctccattattacattaataattacttcagggtttcctctgccatatctctgggtcctctgtgaacctgaacaagtgtttttctcctcttagatgtccatctcccacccagagtaactgggttctcttgccccttcaagtctactgagttttatccacctgggccactttctcattttgcctttccaagcgactatacatgataatttgttccaggccagctcattccttcatttacattgctcaccactgagaagatactcagttttctggagaatgtaattaaagatactacaatttttagcagctgcttaaaacccttcctggctctccaaaacctttattcaagttcttcagggtggcataacaggtcctccgtccatcatcaagccttcctttcacctttccagtcttggctccttacaactcccacattccagtcttctggcattaaaacaccctgcagtcatcctaacaaggctgcttcacaccctccatgtctctgcctgggacacactgataatcgcatatcccacatcctcatgccagcattgcagctaccctatctgtgacacttacctatccaggactgccctttctggtctataactgcagcagacctctctgaccaaccccaacttagaatcaccttccatgtctcactttctagactctcccttttcttcactgaccttcaatattaagtcttgcaatcctagtggcttagactgagacactaagaataaccataacattggccagccccacttatatcaattttcccctgcaaccatctcccacatttttttcctttgaaatcgctgtcaagcaaagtaatcgtgcaaactttgaaaatcatttcaaataatcaagtaatttaaaatacatttgtaaactacactgattccacatgtcccaattaggcttattccccccttttctaatgttatattgcagagtaacagttccacaaaaatagttcacttgaaatcaagaagctggctgcatacgagtcccttctgtccttagttttccaaccagacaaaaagtgttcattaaagaaataaaaagtaatccaaatttgtaccaatgatgtggctaacgggaattgccaagtacaggtgttgactgaggcacctaataaaactaggggaaaagaaccaaggaggttggtcaggatttttaaaaactagtcagaaacggaaaaacaaaacatacaaatagacatggagaaattaaccactgatttcaatgtggcacaataaaaataatctcttccattcgtatagaacactaattttcaatgtgacttctacatatattacctgcctcccaggctagagagggtgacacccccattttacagttacaatagtcaagacaacagggccctgaatcttgatgacttctgggctaaacataagagcacctttagctgtggtttcttatccataaaacacagctatctactctaccagcttcacaggatggttgtgaaggaacaagtgaaactgctttgaaaaagtagtaaatgctaaacaaatgcaaagaatcatcaatcagaggatggcaggcaaatagatggtaaagtctgagtgtaagagtcagaataggtatacaaaaaagtcaaaagaatggcaataaaagaaaaatcattcttaagaaagaccaatcttattcactggaccattctctcaactttactgtatattacagttcacttttgaaatacaaatttaaaccttaaattttaaatacatcattccaggggttagcggactatggcctgtgggccatttttgtgaagttatactggaacatagccatgctcattagtttatgtagtctactatggctgctttggtgctacaacgatagtttcaacagagactgcatagccctcaaagctgaaagtatttactatctagaccttcacagaaaaagtctgcagacccctgctttaattgtggaaaactattactaagttattcatttgcctgtcaataatgggttatcccttatgcttggttcatgtttcaaaaaggaaagaaataaggaatccaaaggaagtacatttaactttttattactttttaaaaatccaaattcagataaattaacacactaggttagaacctcaattgtatttgatacattatatactggatttctattactaaaaagccagttggaatatggcctatacgaaccaaagagtgtatacaaaatggaagtggtcatcaggcaataattgtttccttggaactctgcaccgactgtccatgctctgtggggacttacacattcaagtttgacagttgaaaaaccaactggagctgcttttccaagaatgttctgttgtccttcaaatagaattccatgttatttctttcttgccttaagctcttatatctttcaaatgacctaagctgatgaactggagtaaacacaaactgctgcagttatcaattagcaagcctagttcaccaatacttcaaaataaacagacttcacaagtttatttccattcctaacagtggaataataacttaattttgtttacttttgtctttgtagatttctgtctgcagctccagtaagaatgccaaatcagatggcttttaggaaatgctcataggagagaactagagttattcctcacactgaatttaagtcttaccagatttctgcaggttcatatgttaacgttctgatctagcctacctgtaagtctagtttatttctgtacacacttccaaatactcttcataaattttcacttctgactgaaatataacaccttgattgatagtttcataactatagaattttagtgaagatataaaacattaatgaatacttgtgttttaatacatcactactcctatttattacatgttccaataaaccaatagaatgaagcactaagacacggtgaaatctaaacttaaaacccagatggaactgccatatagattacaaatgggtctccccaccacagaattcatatacaaaagcccttcggtatgtagcttttcctgaacaaatacattaatacactttttgttttttacatttgtaaaaattcaaggttttaataacatttctttgcaagacatttggtataaggtggttaataaatattaggaaacaaacactgtaccaaaatggatatgacttgtgaataaaccctaaataaagtggcttttggaagaactggattttgcagcaaccaactttataaagaggtccatccactctcaatggaaaacacccaagcataccattcactaggttcggatatcaccataatataatgaattctaagagtatggggtttgatttatgggcaaccccagtacaatctaggagcccaacatgatgaaaaatactaaaagaatgcttcaccatccctcaggccattacatttccaccttatcctactcttgtattaggatatatgtatacaaatgtcaactactaatgtagttaaatttcaggagaagcatgcttaaagatacacaaggaatgtttagccttagtttttgatagtattatccaaagtgtgagttgaaagaaattaagcaaataatgttaacaaacgaaagacagatacacagcattagtgggggtataaaaacctcacctttcaattaacttgaataatgttctattttctattctacaactgagcgctagggagctaaactatttgtgaattacatcttctttaagaagacacacacacacgcacacacatacatacacttattcaacccctctatgcagccaaaaaccaatacaagtccttttctaaaagactttaaaggtgattaatattcatttaatgctcttaatgtatttggaaatcagaaaattatttttcaccacagattccaaagaacttcaaatagagctcaatttagtagaaagaattggtgtacctgaaagcatttaacccacacattttcaataaaccctacatcttacctgcaagattcatatcatgagaaacaaatttcattttattaagacaaaaccttactgtccaatttatactcccatcagacagactatgtattggtatgttaaaagtacttttgaataaaagtggtgagaaagaaaccaaaaaagtactttatatatagttaaaaggttacataatataggcaactaaatattaacttttagtttcttttttataagatcttaaaggcaagtaagaaggaagagaaaatggaagtaccaataaattatatttaatataccattttggcttcagaagaggatttacctacagcttctgatcaaatttgttggatcatatcaatcatacttaagtggtaagaaatcatacttttcaccttttaaaggacttacatgtcacaatataggatgtagagtccatcaatagataggtacatattttgtaatgaaaacatcttgtgtaactattaattgcatgattttcatattaaggtttaaatacaggtgttttgagtctttctaaaaataacaatataaagtattgttttaggtggtcatttgcatagcaaactattaaactagaaactcagtggttctaggaaaacttcatattatgaatagttccagaaaaatgtattcaaatcacttctcttacaaaactgtaacctttatttgttgatccaacagtacgttaaccacttttaccccatccccactttacacggtacaccaacctgaacagattttgtgccacaatttcattcaaagggtttgtcattcactttatgattgtgctggataatctagatgtaagcaagtctggagattttaaaatacgggtcccctgtatgagagtagcatagtttatagcatacttttaaaaatggcattcggtaattttgccttctggacagaaagatatcttcaaattgcaaacacatctatttccacaaaacaatttggtcaggaaattttatttgaacattctaaagcaataatgctttagatgttacttaagtgtcccagacaggattaacaaaattaagtgtctctaaattacaaatttggctcctgtaggagtctcagaaaataaacagaagaaaacaacccccctcccaaaagaagtatgacacacacattttgaagaaaccccaatgtttcatgcaatggtaggcaagatgtaaaagcccacccaaatcacacatttctacaccaatcatcataagaaaaaagtactctgtagtcgatctgtacatccaaatgcatttgggaatctacacctacgttacattatttaatgttatatacatttattacccaccccccttgtttttaataatttcttatgtaaaaccttcattcaaacccaaaagatttaagactaacttggggggaaaaaagataatcactttagacattcagttaaaatgtagtttatctaaatctcaaaatgtttaataaaaacaagtatcttctccatttaacactttgctttctaactgtacagtaaattgcattgtagagagtacacttctgtcttcaaactgtatcttctttggatggaattaagatgtaactgtatagttttaagataaataaatgggaagttggtccaactaagatgacagcagatatattacatgcaggatttaatattttctaattctctcttttaaaaaaaaggatgctgttggattgggaaaaaaaaaaagtcaaaaaagaacccagattcaatatataaaaatgtcccacaataggtcgacaatggcagtaaaaataagaggaaaaaagtaatctttctggaacatcatttttcaataacatagaaacactaagtgccaggaagattcctattcatgtaattttagcatccaagtttccctctatttattttattggaacaaatgctttaaataaactatttgtcctcttcactgaagagagctggtctatttcatctttaatgagctagtttttgggaagattagccatgtactgtagtaatgcctactgcataaaatccaagcatttgctgtgaacagttggagaaagcagtcaggaagaacctaggatcaatggaaatagatgttactttaagccaccgacgaaagagagacccacaaagtacccagtgtgttaaagcccaaatctcttcttgcgtttgtttgtttttgctgtgcaagttccacccctatgaaaaagaaattgatccaaagttccaggttttcttgggtctctagtcaattttcacattagtatagatttttcggacaaaggcacttgttcccatgtaaccaatcgctcctgcaaagataaaataagatgttttgaaacaaatacatacagagcagtatccatcatttaaaaacactaaatactctatgctctggaaagttattcttttttaaagaaaatatccttatgttagtattctctctgaacttactaaaactgtatcatttgctttgcaaatcacctgataccataatacactgagtctgaccatcatacgccaagtctaatcaagtagcaattatttcttgtataatcagtaactacagaattaaaatacatctcttataaagcaagaataatttgataatggcaaaaggttgttaaatcaaaaaacatgccttctttgatttgaagatatactattctaggtcattaaagtaaaaatcaatatatcttcccaaaatccaatagataaatagttagaagtgactgaaaattctcttaaggaaggacagggaaccatgtcccaatagcagttgaagctctagagaagaggcattttctgacagcttcttttttatttttaagttgtagaagctgtgtagttggtagtagggatgacatatttgcgggaatagacaggacagagaggtaagtgggtcagaagttttgaaatgttgttttttaacaattagcctcaaccagagcttaaaacaccagaaatcagggatgtttgttttgttaagtaaaatatttatctcctgtgtctaaaagagtgcctggcatataagatacttggtaaatatttgttgaatgaatgaatgaactagatggttctttattgcaaatataggttggtgcaaaagtatttgcagctttacaattacttttgtaccaacctactaagggctctttaggacaatgcagttggttattgaactgtcagagaagaaatctccattggcctcaggaatttatgatgtagcccaatattattgaaagcttaaaagaaaaccttccattaattagtaatattaagtgcacacacaaatgcctagtcatccttgaacgaatcttttagtgaatcttttattcactaaactggtgaatgaaaggcaagaatcaagcatctctcctgtttctcctatgtatgaactataccccaaggctaccaactggttgatgaaaggaaggttatccttatggaagtattccagctaacaaatataaaaggaacaacagaattagaatattataaccactaatgaattatttgagctaggcaataactatcaatggctgctaacttcacaaagaaatagaaccagaaattatgtgctttcctgataaaagcttacaaaccacctgttaaacattcttggacaagtattcttgagtatgatcaagcctacagatctaactaccacttgaagaaactttaaatgacacttcagcaatataatcagcaaaatccagagtctggaaaattctacagaaattgtttaagttttaaaaataaactgcaagtgagagagagaatatctatagactaaaagagccttaagagacatttcagccaagcaattcatgaatcttaattgatctcaaagcaaacaaactatatttaaaaagaagtcattgcaagtgtggtaaatctgaacattaactgaattattccatcatattaagaaattacatttatctttcagggagagacatatactgaaatatttacacttgaaatgacataaggtctaagattcatgtcagaataaaagggggggatacaaagtgagaatataaataaaacaagataggccatgagttgataattactgacactgggtgttagtacatggggactcactatatatagtattgtccctatttttgtatgtatttcaaagtttccctttattaaatattaaaatacaaaaaaccaaagtgacaaagcaacactatttccacttatttttgcaatgacatttcttttataataggaaataacaatattacattttaaaatattgataatgcattttagaatagttacaatacaattctttacaggataagagaaaaatcattcaattttgtgaaaatatacctgaatccttacgacacgaaaagatgtataaaattttaattagcatcaaaaattttaatggtataatactagtccaataaccaaatccaattttccagacgtacaaaacattgttcccctttgagcagaaatatgcttaaaatcaaaacagtttcaacctagagaatcatttttcctaatcttatgagtacctcaagaataaacttacaagggcatgactttataaaaagagaatactgaatatgccctctagaaaagtaaatatcttaggaataatagaggtgcacttttaaacttaattcctcaaaacaaaaatgctatgctcataatatcccaccttaatgtagtcattttttcctacattaaaaaaaatcaacaaatatttttgttttaattactgacaagcattttagcaacataaattgatggatatatataatttttgtattatgatgacattctaatgacttccagtctaaacagtttctccccacctgcccctgaaaaatgaagtactgaaggcatataaacccattaaagaataaatgctgggacattgccagaacagcagggaactgtaaatgtgccaaggttttcaggcagcaagatgaaatttcagcaggaaaagcactcaaaaaatttagctagattcattccattttctttgtaaatgtcaagatgttacctctctgggtcttcctaagatcacatatagaaaaagtcaagtcaagaaaaatttttttaactctctgcataatcgattctatacctcactgaatgctggtgataatcaagaaaaatctcagataaaataaagaggagtccagtgaacaatactctgaagaaaggatggcaaataataaggaaccttctgactgtccaagaatagggatgtttccacctgacacaatgtagttttaaccttcagtccctctcatctttctctcaaagttggttactaattatcacagggaatggctatcacagcagctataaataaaacatgtgactataacatagagaatgatctttccttgtggaatgtttcattcactactttacggacaatctcatttgtgtgtgcgcacacacatgatcacatacatagtgtatatgaactgaacaggctcttttgatggagaaacaaagcaatcttggtaccccaaaggtgtccataaatgtcataccaagacttagcttttaataagattaccatatcttatatatatcttatatagccaaaggtggaattatcaaatacacacatacatacataaatagccaatggcaagtaacagaaaaaggaggaaaattatccactctctggaaatgtttccaccatgattagtcccgcagccttacatcattcctacaaagtaaccaagggatcagtctcatttatcaagtaaaacacatcattcctacaaagtaattaagggaccagtctcatttatcaagtaaaacactgagcccaaaaaaaagtgagttacttgtatgagtttcccttaagttacctctgccagaacttagagtcataaagttgttctgagatgaaaacacaaggtgtagaatcccacagagactgtgcagaaacacagacacaattccagagcagaaggaagcccaaggactttcagccttcatcaatagcagcagcagctacccctcactgagcatctaccagccacgtgatgtttatccacatttaatcactgaatcctctttatagccctatgaggtaggtattatttctattttgcaaatgagtaaagttgaggaagaaaggttaaataatttggccagagtaacatggctattaagtggggagttcacacccagaacagactgaccccaaaaggccagctctttccatatctcaccatgtaaatggctatcgttactacctaataacagtcccaacactacacttggtgctttacacacatgacactattcctcacaaccactctgaaagatatgcccattttacagataaaaatgagacttagaaaggttaatgtgacctccatggccataaaaaaagctgagcaacagcatggacatttattccagtgctttcaggctctcatgcttatgcctttcccatttatcatactgtttccaaaagttctttattttctagctatttcacacattctagagattctatcacatggtgaaaactattacctcttccttttaatagatgattatgatagatccataaatagtggttttatccccactttacagaagcttagagagcttggggaactagatcaaggtggaaagcatacatatggtacagctagaacttaagtccagtctgtagatacccaagtatgcaatcataacaagtaaactgtgctgtctcctaggtgtctcctggtttctccaagaatactctgagaagtttccaaacaggaatcattcaggcaacaccttaacatgcctacatcatgatcttccattgaacctaagctttaaaaaatgccaattctcaagccaggcacagtggcatgtgcctgtagtcccagctagttaagaagctgagtctctaaaaacaataaataaaatgaaaaagccaattctcaacatgaatgaaaaactgtgatatgaaattctgtgctatacagaattactagaatttctataaaaatagaaattaataaggtaataaattatgttgtggggaagagtcaaaaggactgaaatcagactcgggtttattttggtgtttctgatcaaacaacagataaaatttcttaatttccaattactgtatttttcggatttagagaaactcagatttactcatgatgttcaaagaatttcaaaacttaccacacattatccccaaggctgtgctaaataccgccatatatccaaagtaaaatgatgtttgaaataagccatacatcctgaaataaaacaaaatatatataggatatccagttttactttcaacttaaggccttaaatattagtatttaaaggacaaatttagtttcctaaataaaaggtaaaaaaatgtctccacttactttgttttgaaaaaatagtagtaaaaggaatacatgtaaacatagattgcagttgatgcagcagagagaaaacttgtccattgcctggtggggggagggggaaagaagataaatctcttttgaatgaatggcactaaaacaaagattttaaagcaaagaatttaataaaacatcctttaaagtcctttaaaacttatttaaaaaacaaatgcatagacatggtattcaaatttatcaacaaggaaaacatctaagaattagaaagctcaatcttgaattttgtcagattccctattaccagtgaccataaatacaccatttcctttttcatatctaagtttccttgtgtttagaatggagcaatgcttctcataaaactcttttcatatcaagcactttgtaaaaaatatttctaacacagtactccattaatacattaaaaatttgatattttttctctaaaatatgtatcatttttataactggaaaaaaatccctatgctattttaagtaacaacatttctatacagctctttactccacttgatagatttcaaaggaaatcttattttaaaatattatggttccccaaatttctatccacaaataggtacttaccaccggtaatcttctgcatttagtagaaaatatgtgcacacaatagtcacacagacagtcacaatgcacaggataaccagcaccagcatcatgaagccatagacataatagatcttatatgcccagaaagacgtgaagatgaaatacctaagtaaatgcaataaagacacaggtttccagtctttattcttaaagctcactctgctcttcgtgagtctcacattttagttctcatttttttctcacttaatgactttctttcaagtatcttccaacagcttctcttaccatgtcttcatcaattaaatccactagaattctctcaaaaaatattttcttggataatctttgaaaaacagattcttcagtagggcattcacctctacacaaactgaataaaacagaagcttcaagaagtataatgtagaaaagaacaaatgaaaatagctaaaaaatccgtatttgtatccatattgttttgtagatacaacacaattcaagcaatgtagtttgtattttattaaatagaaaataaaataataagtagaaaaataagttagagcaataatgtataaaattaggaaaagcaggcctgaagaagattcacactgtcttcagaggacagcaagggaaaaggctttaagatttttaattaagaaaaagatctttcactctaatccattatcaagtcatcactaaattacaacagagcctttcaccctctttttcttagtcactatggctaatactttaaatgaaggggaaagaactaagaaatgaagttggagaagtgaacagggccagttcttacgttataaagacccttaatggccatgttatggtgttgggacctcacctcaattaaaataagaagtgttaagtaaagaaatgacatgacaccttaaaaagaccactttggctaccaaatgggtaggagaatgggtttgaaggtggacaaaacagaagataagttgaagaaacagcagagaagttatctagtggaacacagtgcctggagaagcacaaagacatgtggttcagaagtactggggacaggggtagaagggaaaaagaagtcacaggtcaagtctgaataaaggcacaaagcattgtcagactggaactaaagaagttcctgaactgactttaataaaccacgagttacagagacacacactccaactcctaaggtactaatgcccatagcatatgcagagctggtaagtgacaaccaagagttggtccatatctatttatgtcagttgtacctgttagtaccattagactaaactgactaaattaaatgttacataaaccaataaacatcagagtaaaaaggatgtgtggttactataaaaattatgttgaatgctttggaaagattcaataaggtgagtcccttttaaaaagttataaaattcgatgtgattgagacggctatagactgggggacaaatgtacaaatctagaaggattctgcacttagaatgcttcagataggactttatgttcttgcttcactttaaaaaggctggaaaacacaggatctgtattaccaatgtcaaaggaaaaaaatgaaaaaatttcaatgaaaaaaaagaccatggctctatatttaaaaaaaaaaaaatcagtggacgtacatttacttgtcttaaaatattatgtatgtatcttttaaaataattatcttacatgagccaactttttcaattaaccaactaccaaatccaattacgtccgttaaggagactcctaccatacaggagacaatcagcagtggggcatctggaaacatgtaaggctattttaagttgtcacaatgactggtatttagtggacaggagccaagggtgtacagctgcaatacctgagaaagtcccatacggtgaactttcttgcctaaaataaccagagtattcccatcagggggcacggggacatagactaagaaaagaaagtcttttttattttgcaatggtgacaaaggatgcagatgtaaagcacagtaagtggcacaaggtggcatacctcttatctctaaatacatacacacttcctagcactcctgcaggcctctatggaaggaacctaggaaatgactatgcatcaaaagatgtcagggcctagacggactagtaggtattggtttacctagttccctagatcctcagaaatatttttaaaatacaataaaaaccaggaattccttaaatcatgcatatgatcaaaggctggtctaccattctttaacacatagttttgatttctaagatttcctcttaggtgagggaggtctagaatacaatacaaaaaggtataaacatcacttgaatatttaagaacacagccaacagctacctttatatagcctattccctttctggaatcatggaattaacagattattagatgttctcccaactgataactttacatgttccctaactcctaaattgtcttactataatcaaatccctcaaaacataaatacattatcaaaacttacatttcaataaagattgaaccaaaaggtaaaattccacccaggcaaacaataaccgcaggctccatgaacctggaaaatattaaaattaatagtaaacttctagtatgatttccatgttatataaacactgataacagaaagcaggtacttgacacttaaaaaatcatctctaaaggatagaaacaaaccagtaaaatgaaaagccaaaacccaaagaggcacaatacataggtgggacttcaaattagccataggttacaatcaatattctttctgcattaaagactgagacaagtatatgaagaacacaaattactgacactggcagaacttcaaaaagtctctaagtgttccctctggttctactagactcccataacttcttagaactctacaggcatttattcacaaaaagccaaagggaaagaaacgaagagtctagagacctccatttgaaataatgtttcccaaattgtggccttgccatctctttgctcactctctccttggttctataattccttttcctacaaattatacaattaaggtattatgagttcttatttataatggcaccaaagaaataaaaaataaaattgaaacttcattcattcattccacaaacatttactgactgtaattggtaattccccacctggatgccttctcttgtctcgtatttctctcctgaaagcattggctcaaatattctccctttaaaacctttgctgagtctcccaggaagaggtgggtccttctcccattcttccactgcctcttgaaaatacctccaccacagtacttaccacgctatactgtaactgtccaattccaaatacatgtgtgtacatatatataaaaaacctcactagattataaaccctggcaggcagaagctattcatctaggtatttccagtgcctagcacaatacctggcacaaaaaagatcctaaactaataactatgaaattaacaaactaaaaaactgagaagaaaatggtaaaatttgagagctgaaaaaaaaacttaaaaatcatttaatgtagtcttctttccttactttacaggaagccaagacacagaggttaaaagtgatctgcccaaggtgacacagtcaatgagaggcagatctagtattcagatttaggttcccaggattatactccccaaaacagaggcacacacaagccttcctatacctaattgcaatgcatctctggtgaggaagctctcaccagacctctccttcactggccctagtgacttagaggaacttttgtgacttctgactatgcttttcctttaaacttacccttcccagtaaggatattgatgggtcctaacatactgatttacaaaaaaaaaattactttaaaaaataaactacaggctgggcgtggtggcttacgcctgtaatcccagcactttgggagaccgaggtgggcagatcacgaggttagtagatcgagaccatcctggctaacacggtgaaaccccatctctactaaaaatacaaaaaattagccaggcgtggtggcgggcacctgtagtcccagttactcgggaggctgaggcggaagaatggcatgaatccaggaagtggagcttgcagtgagccgagatcacaccactgcactccagcctgggccacagagtgagacctcatctcaaaaataataataataataaaataaataaataaataaaataataaactacaaaagttctaactaaagtctctcataagcaccaatctaaggaaagaaaagaatatggccaattcaaactataggggctattttattcatcctccatttctataaatgtctacatgcctccatgtctagaagggacagagcaaaattatcacctatttgtataagcacctgaatatgctgtatttataatctggtaaaatatctagggacagagactttatatatatatatctccgttatcataaaaatgcagtctacttactatacaactattcctataaatagggaatgtaataaatgtacactaaattgtacagtactaaaatatctggaaagatagtaaatatttcaggttctgcatgtgatagtatctctgacattactgatctgccagctctgatgctgtactataaaagcagccacagagaatatgtaaacaaatgggcatggctgagttccaacaaaactttatagataaaaacagggagcaggccagatttggcctgcagattagtaaaactgcagctttagttcacacccacttctacaccatagaaaagcatttgacttaactctaaatggcacgatattcagaaagtggaataagggtataatttattattactcttaacaatgtaggttaaaggaaatagtaaaatgaacttcttaggctcaaacttaagattgtcattatcataaatacataccaattctaaagttacatgtacacaacagccttaagaacttatatattgtgtgaaacaatcgcataagatttagcattctctttaccattttttctccggtataggacgaggcacagcattgacacgacaaggaaagttgggctgacctgacagatttcggccaagtattgtaccaacaagatttagaggaagaataacaaaaaaacagatgcaacaaacggccacctgtaaattaaataaaaatgtgtgattactcagagaacaataacattaatataaacaaataaaagagacacaatttaaacacaatttgaccacaaaagaaaatgtttaagttcaatatgagctaaaattgtgcaagaagtacactaatgaaaacaaaaaggtgtgctttaaagtattagaactaaactgaatacaagttgaactagttcttatccaatttggttttccattctttcctattcttccagactatctctgccacaatccctttttctcctctttcactctcagctgtcatgcttttttaatatatttatccattgtctttcattattataaccaacttacttatctggctatgctttttgagctcataaaatgcactaagagctttatatgtgttattttcttattttgcaaatgaaggaaaggagactcagagaaggataagtaacttcccataattgcatagctagtggagagccagaccaaaatttcaactcagatctgccagcctcaaagcccacactcttttctatcctacactaccttggaatcctaatagaaggagatcgctatctatgtgtcactagtaaaatagtacaaatattttcctgcccattagtagtgcaaagtctaaaattacagagaagaccatacggagattttagaaccaaagtggccaattagaaacatttatttttgtgactttttttctttataaaatcagctcttttccggccaaccatctaattaagatcatttcactctgaacttctgtaaaatggagtagaattgaatcacctctaagatgtctttaaattatacactttaggttataataaatagaaagtaaaagtgagagaaaaactgaatgaaacatgtgaagacactgattgagagaaatgaagaggtatggggtaggaaatccacagtgattgcacaagaaggaaagatctctttgaaccaatattagtaaaaattcttcattagatccttttgtgtgtgtatatgtgtttttaaacaagccaaagggtactgtcatctccttttcagatcaaatataaatatgtgagaattacagagctccataataccattttaaacatcagactcaggaactcaatttatctgcgtttcagtttaggcctaggcctatgaataatatgaatttatgctcatattaaaatacgtgaaatgtgaaaaataagcaggtgtttttaagatagtttaagcattatgttatgaactatacatatgtcgtaaatatggggagtgataaattccatctcaatttttgcttttactttcttaataactacaagactcataaaccttaacacattgtaataaagacctatatatttttcccttagtttaccagaactctaatttcaaataagaattacagagaaaatgaagaaaacattcctatgttgaattacatggtctagaagaatggttttcaaactgttccaaagaactctcaggtcctactgaagagcttctgggattccacaagcatttgatttgagtatccttttgaaaatagtttctttttaaaacactttcaactgtaataagatatatatagctcaaaggagttctataccaaatatcagtatactggagatatcacagccaggttaactcattttcatgcaaatctcagaataaagtttctcctgcttatctctgtgtatatactgaactgaatgaattttgtcattgattaggaaggcttgtaatgctatattggtcttttattctatctccttcacctcatcccaattaaggcctgcacatatttgttcactaaaaattgtataagcaaaagtactactacagcacaatgtgtgtgacaggcaattgagtggcagctgaagtgagggcacatcttgccttctgtgcacataacagtcaataaaggaatctacagtctcaaaaagacattatcaattgcttagcatttgtcaatattttcccttttgttgtccaactttttaatatatgataaaaaatgtgagcagtttgttagaaatagtgattaagctgtgaaaccagttccctactcctttatgttcaagttctggatgaagttacttgaaaaatactctaagattgcaaggcaagctgttaaaaaaaaattcacatggaatgaactcatttgtgaagaatttttctcaatactgataactaaataaattgggtgctgaagataagtaatagcttactttattcaaaccccttgatattagatttgtattcatcacaactttattgctcttattaaattcagtgttaaaaatacttaatttgcaaaatatactaataaaatcatccttgtatctgttttctatctgggcttccacattattttggaatgaaatttagcagctaagagggtctaatatattggtgaaaaccctggaactcaaattaatatggggctctcctctattcctctagtcactgttcagaggagaatgaaagcaggcagtggggagaagaaagatttactccatgttgagggcctcccttatctacaacaataacaagttagaatcaagtactgcctattggtgcttaataccccaaagatctacatactgatcacatcttctcaatctcagacataaaccaagaatttggctattacttattctatctttgcttccagactggcctacaggccaatatctctcataaacttagatgtaaaaacaaattttagcaaatgtaatccaaccatatataaaacaaataatatatcatgacaaagtgaagttcatcaaatgaatgcaagactgattaaagattagaaaattaatactttcaccatattttcagaattaaaaaagaaaaatcacagatctcaaaagatacagaaaatgctgttctaagatcgaacacccattcaaaattaaaagaaaaaaaacttgcagcgaactacaaatagaagggaactttaacaagctgatgaagggcatctacaaataaaatagctattattttaattaatggcataaaactaaatgccttcctgccaagattgggaacaaagaaaggatgtctgctcttgacacttctattcaacattatactgcaggttttagccagtgcaatcagacaacaaaaagaaataacagacatacagatcaaaaaagagaagtgaaactgtttaaataatttgataatctatttttttaaataacactatgtacccacaaaaattaaaaataaaaaaacttttgatctatgtaaaaaactaaagtttttactttattgtaagaataaagtaaccctagctcacttattgtagaactaataagtgaatttggcagggttgtaggatacaaagccaatatcctaaaaaactgttttcctacatatagtcaacactcaaaaatagggtgtaaactgttcaagtccacttacaagtggattttcttctgcctctgccacccctgagacagcatccctgagacacccctccttcttcttcctcagcctactcgatgtgatgatgaaaatgaaaatctttattatgatccacgtctacttaaagaatagcaaatacatttttctcttccttatgattttctcttttgaagagacagggtctcactatattatccaggctgaaatgcagtggctattcacaggcacgatcatagagcactacagcctcaactcctgggcttaagtgatccttctgcctcagcctcctgaataactgggactacaggcacaaaccgcacacccagctaaccttacgattttcttaataacattttcttttccctagcttactttattgtaagaatgcagtatataatacatatacaaaatatgtgatcatcagtgaggcttccagtcaacagcaggcttattcgtagttaaggttttggggagattttcagttgtacgggcagggggtaggggtcagcaccccaaacctcatattgttcaaaagtcaactgtactctcatgtgccacataacaatttttttttggtcaatgatggaccacgtatctgacgttggtcccataagattataagactgtatttttactataccttttctatgtttacatacacaaacaccactgtgttacaattgcctacagtattcagtacaataatatgctgtacaggtctgtagccttgtaagattaggctataacatatagcctaggtttgtaggaggctataccatctaggtttgtgtaagtacactctgagatgttcacacaatgaaaaaattgtgtaacaactcatttcacagaacatatccctggcattaaatgatgcatgactgtaacagcaataaacgatcagaatttgaaatttaaaaatggccgggcatggtggctcatgcctgtaatcccagcactttgggaggccaaggcaggcggatcacctaaggtcaggagttcgaggcaagcctggccaacatggtgaaagcctatctctataaaaatacaaaaattagctgggcgtggtgacgtgcacctgtaatcctagctactggggaggctgaggtaggagaatcgcttgaacccgggagatggaggaacagaaatttaaaaaatatcattcaccaacagaataatatgaaatactggagaataaattcaacagaagataacaaaacctgaacactaaaatctatgaaacgttgctgagaaaaattaaaggtatctaaataagttgagagatatactctgctcattaatcaaaagactcaataatgttaagatgtcaatttttcccaaattgtgctatagattcaatgtaatcacaatcaaaaccccagaagactttttatagaaactgacaagctgcttctaaactttatatggaaatgcaaagaatattagaaaagccaaaacaactttgaaaaagaattgatttcaggacttataaagctatagtaatcaagacaatgtggtattagcattaaaaacaagacaaattgaaatagaacaaatcaaaatgaaacaagagaaaatccagcaataaaaatccacacatacatggtaaactggttatcaacaaaggtgctaaggcaactcaacagagaaaggataatcttttcaacaaatggtgctggaacaactgaacagtcatatataaaacaaaacaaaacccctctggcccttaactcatactatatataaaattggccaaaaatggatcctagacctaaatttaagagctaaaactataaaatttctagaagacaacatataaggaaagcttagtgatgtctggtttggcaaaagacttcttaaatggaacagaaaaagcacaaagcataaaagaaaaaatataccagtaaattagactttaaaattagtaattttgcccttcaaaaaatactctttagattatgaaaagacaacccacaaaataggagtatatacttacaaaatacatataagacaaaagacttgtatttacaatatataagaactcttatcactcaataagaagacaatctattaaaataggcaaaagatctgaacattcattaaagaaaatatacagatggcaaaaaagcaaataaaaagatcttcaacatgattagtcattaggaagtgctaattaaaaccgaaagacagcactatatactcactagaatagctaaaattaaaaagacttactatatcaagtgctggcagtgatgtggaacaattggaattttcacagaatgctgatagaaatgtaaaatgtcaaaactattttggaaaagtttagcagtttcttgaaaacttaaactaccatatgacccagccattccactcctagttatttatccaagagaaatgaaaacataagtccatagaaagacttgcacataaatacagtaacttgatttacaatagcaaaaaactagtaaattactgggcaaatggataaattatggtataaccatgcaattgaatactattgggcaatacaaagaacaaactattcataaatgcaacatcaggccgggtgtggtggctcgtacctgtaatcgcagcactttgggaggccaagatgggtggatcacctgaggtcaggaattcaagacctgcctggccaacatggtgaaactgtttgagccgagactgcatcactgtactccagcctgggctacagagcaagacccagtctcaaaaaaaaaatttttttaatgcaacatcaatgaatctcaaaataattttcatgagtgaaacaaaaaagaatatatactgtatgagctaccatttaaaggaaattcggtaatgaaaattacactatgataagagagagcaggctggtggttacctaagaataggggagagacaaaagaagaaaagaaaggatgaattataaaggtatacaacaaaacttctggatgtgacaaacatctttatcttgaatgcggtaatggtttcacaagtgtgtgtgtgtctatgggtgtatgtatatcaaaattcatcaaattgtacactttaaatttatgcaacttatcatatgttaattttacctcagtacatctgtaaaaacacacaaacaaaaaagggcaaaaaccataaccactgctctcagaattaggctaggattccttttgacagaaaggaaaagaaaaatgtccaaaaaaaaagaacaaaaacctatcatcaccaccaccagcacagcaacaaagaaaactaactacgggagagtcttggttttctgttctgtaaaataggaataaccacaccactagctctgcctatctctttgcgttcttctgaaaaccagacaagataatgcgtgtgaaaatgctttgtaaactacaaagtgctacacaaatgtattattattgatccttattataattcatcttcttagatttggcacatcatttcagtcaggtgagatctttttagatgctgccttcattatttcatattactagttcattattttatattactagtttcttccctagtctcacatcccttttcaattgaatcagcagaccaccatgtctctaagttattaatcatcttttgaataggtcagaatcaagaatatctgtcaccttctactaaaggatagcatgtacatactatggctaatacttcgatactcttataaggtagaacccactttcttcctttccctcctggaaaagtaaatttgcccatccagttttacagcacctctgctctcacacagttattcaaacattacttaatgtgatctctcggtatctctaaaagatcatttttatgagcaacaagactttcaagctaaggcagctgggtactcctgtacaatcaactgccttgcgtatcttaggcttcacttccctcttaccagggaatctttcctcttacttttttttgtttatgggttatattttatttgatgaaaaataaagaggaagaatgggatagagccattctttttttttttttactttgttacatcactgatcccacacaatgagtctttgatcttgatatctttataaaatccttttgcttgctttagcgtttgtgaacagctcaccttagatgatgaagcttttctaacattggttttatattacctttctttttttttttttttttttttttttgagatggagtctcactcttgttgcccaggctggagtgcagtggcacgatctcagctcactgcaacctctgcctcccgggttcaagcgattctcctgcctcagcctcccgagtagctggaattacaagtgcccaccaccacacctggctaatttttgtatttttagtagagacggggtttcaccacattggccatggtgatctcaggtgatccacccacctcagcctcccgaagtgctgggattacaggcaggagccactgcgcccggccagttttacaaatctttcaagaaaagaaaggtgattagttcccatgctaacctgcctctgtgagttttaaaactctgtaatttggttctttgtcctttggaatcctacaataagatgaaaacttaggatctgagatttacagcccacgaaagaaaagactttgtgtctaaaacccttttccagaacatcttggcgaatcctttctcattcccaaggaactcttacaggaccaaaacctttgggtagagcatctaaatcattcttggataaattcccaaaataaaaagtttttagctttccagaatcaatctaattttttttttctttttttgagacagagtctcactctgccacccaggctggagtgcaatggcgtgatctcagctcactgcaacctccgcctcctgggttcaagtgatcaagcgattctcctgcctcagcctcccgagtagctgggattacaggcctgcactaccatgcccagctaatttttgctttttcagtagagatagggtttcaccatgttggccatgctgatctcaaactcctgacctcaagtgatccgcccacctcagcctcccatgctggaattacaggcgtgagccatcatgcccagccagatgtggaaactttcatagaacagagaactagagtgaagatcacccagaaaaaggcctcaatagccaagagatcaaaggaatgggggacagaaagagataagacctggggaagagcacttaggaggatctgaagactctgattctcaaattaaggtattcagttagtagtggtacctggcttctcagacacatggcacctatggtctgggagcctttcggctcacagatccatccccagatcccaggaactggaatcaggtaaacactacagattgggtttaaagcaggacagactaattagcttgaaagaaagccctgagcattaaaattttttaaatccccaagtgattctaatgtgtgcccagggttgagaatcactgagtttatgagactatgtaaccatttccttcagaatgtcaagaagtcaaacaactaaaaccacaaacttaagtagttcaagtacttaatgaagagctgggtgaaacattcacttcaagttcttcaagttcatgttctaaacaagttttcatactcttaaacggagaaaaggagacggtaaagtacacacctaattaaaacatgaggccaggggaatacccttcccccagtattccttcattagactaatgcaaattaagaacataatattgtaggagcctgccaagtaccaacagttagtcttttactcactaaagaacaattttataaaccttctctggctcagcacagactttaaatattatattctaataatttgtaattattaaattatctaaaggcaaattacactgaatattaacatttaaaactccatttacaaattggtaaaaatttacaattttagcgagacaaagcaactttgaaataccatttttaccaatatcaaattcaaaactttctgagaaaaattttaacagaatcaaaattttaatttttaaagcactatgaaaataatcaattcagcagatgttctttgagaagtaacctgactcactctatgtactttctgatggcctggaactattacaaagcaaattatttccctgtctggtgtaattagttacctttcccttttctaagcattatcacttactttggcttgaaaaaaaaaaatttccattctgaaacaagtttcaaaatattcctaactaaaaggtattaaatatttaataaaaatgtataatattcaatgtgtctttgaaaaaaattggactataaaacaaagtcacctggaatttttgggaaactatttgttaactcccatataatagaaagaaaacccaaacaagattaaaacagatattgtgggctctaatggcagttctaccattaactgcctgtacgattgtgactaagttattgaggctctgttaaaagcagtaaccaccctgcaacttgcattggcatatatacgtatgaacatgtatgcacaagcgtacattaagccttcactctagtctaggcctaaaattctgtttctagtaaaaaggtaataccaagaagaattgggagaccgtgggttaactcattttatgtgttctagttttaatatatttaaataattcaaagcatttccaagactgtgattacaggtaagatatgcaaacacattttaacatctatagcaacgtatattatttacaaaaatgcttagtgagattcttttttttgagatggagtctggctctgtcgcccaggctggagtgcagtggcgtgatctcggctcactgcaacctccacctcccaggttcatgccattctcctgcctcagcctcctgaatagctgggaccacaggcgcccaccaccacacctggctaattttttttttttatttttagtagagacagggtttcaccgtgttagccaggatggtctcaatctcctgacctcgtgatccacccacctcagcctcccaaagtgctgggattaaaggtgtgagccaccgcgcctggccaatgcttagtgactttctaagaaaagtatgttaatacaaaaaaatgtgtcatggaaaagctttactttctaccactgcactcacctatcatcttaaaacacccatgttttgtgattgtcatgattctttctctaaaatatattcaccagttcttcccatctctgataaaaagctatagtgctctcttttaaagtcagcctttcactttactggcttacagaatcaagaaaaaataaaaagccaactataggtttaaacttaaccaaaattttatggaggctaacaacagtagtattctcctcatctaactttccaggactgagtatgaactgactgaaaccatcaaaacatctaataagaagtattttggagggtgagtaggtctcagttagaatgtgtatactttttcagtttaaaagtaagattcaagcaactcaccattgttccaaaaggaatggctcttgaagcatggtaataaatggctatgaaattgatgaagaaggcagtgccacacaccatagctgggataaggaatgccccaataaacatctgctttatccatctccttcctgaaaagaaaggaaactatgaaagtttaatataattatttagtacgaaattatttgtttgaaattttaatataaagatcatgaaatttaacatcttaataatttcttcaaaataatagctaacaaataccaaagatttccaagtacgtatagtgaaatcacagcttctgaagtgggtgcactggaaaagagcaatgacctgtaataaaatattctgacattttgtcttgactctgccactgaactgctgtgaactttcataagccactctctctctctaggctacaagttggcctagaaaggggtttttattactggtttaaattaactgatcaaaaaaaagagaaaggggttttaaaactattccttggagttctggagcttcttggcatgcccatgaagtcactggtgaagaaaaatcccaggtgcccttacccctgcttcaaccagaacaattacattttcaacagttacacattggagtttcatgtaagttttcatttgaaaagcaggttatactactttaaaaagaagaaaaaagtctaaaaaccagtgagtttttaaaaaaagaacctcgcaagaaacccacttgtgatttttcagcaccctaagacagggcaaaaaaaaaattaaacgtgaaataataaaaaacaaaaaaccctgagttagacagcctctaagtttgtccttagctctaaaattataattataaatatgtatttaagagcatttctacgtttgaaaagaaaaaaaaccaatgtgtttcataagctctctctcagcaatcagaactacagatttataagttttactatttctctgtacctctgtgtattgccaaaattctatacattgagcttctattattcaaataatcaagggaacaaattttttaactatgtaataaaaaaatcttcaattttgctcatacagaccagaagagcaacagagagctgtctttctaatacagcagagggtaaagctggcagaaaatatcttcaaacagcttagaaacactgaatcactatcaaaattcaattccacaatcataagcaacagggacccaaacagaaagtaccatagaaaaataagcaatactctaatttttgctttctgctatataaagttcttttaaaacatctgttacagaattattacctaaaatcataacgttcctccagaaaaactccttaatcctgagttttctctcctgtttcatttcttttccagctaagtttcaagaacctctcctttctaactgatagccagcattggaacaatacaaaaaggtggtgattaattaaagtattacttctatttaattccaacacctttctagcattttcttttcctgcattttccactatcttctcagattcagacatgtatcaacaaaactgtggccgggcgtggtggctcatgcctgtaatcccagcactttgggaagctgaggcgagcagatcacctgaagtcaggagttcaagaccagcctggccaacgtggtgaaactccatctctactaaaaataaaaaattagccgggcatggtgacacgcgcctgtaatcctagctattgagcaggctgaggtaggagaatcgcttgaacccaggaggtggaggttgcagtaagctgagatcgtgccattgcactccagcctgggagacaagagcgaaactccatctcaaaatcaatcaatcaatcaatcaatcaatcaatctccttatccaactctctatttctccctttccttctaacagtcaaaaagaatcctgtacacattccactgggtacaaccagtaacccaagtatctgcattgctgtgttttctactgctcttcaaacccttgaagtctctggctaaggtcctggataccactggcttcaaactagatctacagcattatagtgcactgaggacagtgtgaagaccttgagcttcactgtagttcaaatcctgagataagtctgaaaaattattgatcccctgggttgacttctacattaacctggtttttgaggcttgatcggacaaaatatcaggacactatcagatctcctcaggacactaccaatcagaacataatctttacattacattttgtaagacttgatattcctagacctgagcctgaactctgtcagctttcaagaataagtgtagtaaaggaaagttgggctgggtgttcttaacttgcagtcagactaaaaacaaatttatgtccaactttaaataaatttcctgttttaaataaatctgtttctgctgtggagactattttgagagtcataaactaaaattttagcctaattaatttccaggtcaaattcaaagtagaagttgcctcatgtgtccttatttccttaggatgtagtcctatatgataggactaatttcccacacctgcgagtcgaatttagagactgaacatctacctaaaatagtcaggaacccatagtgacactccctcagtcaatccaaataattatctatactgaaggtacaggtcacattaagtctaggaagattaataaaaaagcaatggtaaaccaagatataatcctacgctccgatttcctataacctataagtgtgcccagtctactaaaagaaggcaggatcccctaatgctgacactgcttaagatgggctgtggaaaatcacaactccatccttggaaatataattttaaggtatttcaacaacacttcattcataaactaaaatgcaaatctaccaatttttgtacttttctgacctcagactactgcagggaatacaaggcatttctgaatgccactgcagaaaaaaacaccaaggagcagtatccttgtattatcgtgttattagttccatcaatttcaggtaatagtagtaaaggagcaacaggatatttaagacaaagtgctcttagcaagagactgtgacagtgacaaagaatagcagaaatctttgcgaagggtcctttgataaaactaacagtcaacagaaatacataactttccttcctattctctttccattgtccagaaactttacccacagaccattacacatgcctttatattcatctataaagctttttttctgtgtggatgcatcacatggagcacatctagagccaggcacctcaaagcaaatagtatcaataacttaaatgcactctcctacatgttcctcagggcaaattacatggtgcacaaaggagattatctactaattattcataattttaggaaataaaacgcgagaattccacaaaagcaagacagaacacacaataggtttggtagaaattatgtgaaatgagataacaaagaattttacaatggctgttctgcacattttaaattccaaatatctcacagtaggccagacactttgggaggccgaatcacttgaggtcaggagttcacagcagcctggctaacatggtgaaatctcatctctactaaaaacacaaaattagctgggcatggtggcacacacctgtaattccaagctactcaggaggctgaggcacgagaatcgcttgaacccaggaggtggagactgcagtgagcagagattgcaccactgcactccagcctgggtgatggagtgagactctctcaaaacaaacaaaaaaaatctcatagtaaaatattagcatctataattaacaacatgaagtgagaattcgtaagttacctccttgtctagcatacagacttcctccaaaataaccattcactggagacgtagcagcatagacaaatatggctgtactgagcattgatcccctcctaaaaaggcaaaaaagaaaaaaaaaattaaaaccaacaatttaaagaaaacatcatagtctattatattagcattagtttaatttcaaagataactttaacagaaatacaaaaatatcacaacctggactacaaataaaactcaaaagattctctatagtgaatgaatttgtagttaaaactgcatttacatgatacctggctgatcctaatttttttatcctgcagttaaatgttatgatatattctaagcaagtatttcatatttatttggcaaaaatactagaagctgacactaaaactgttttgtgaccctgtaaaccaatcccataatatggaacaagatgttcatctgttaagaaaaatgactggaatagtctgtttcataacttgattcaactgcttatgaatcttgcctgcaaacagaaataaaacagtagtataatctatattaaatactattattttagatggaataacactgaggctttccctgtttccctcatgctgctgaaaatgatttttaggccgcgcacagtggctcacacctgtaatccgagcactttggaaagccaaggtgggcagatcacgtgaggtcaggagtttgaaaccagcctggccaacatggcaaaaccccgcctctactaaaaatacaaaaattagccatgtgtgatggcaggtgcctataattccaattactcgagaggctgaggcaggagaactacttgaacctgggaggcagaggtggcagtgagccaagaacgcgtcactgcactccagcctggatgtcaaagcaagactccatctcaaaaaaaaaaaaaaaaaaaaaagtaaaaatgtaaaaattaaaatcagacatacgattttaaaaaagtctataggtccttcacttctttgttcacaaatattctatgggcattccctccccatgtccctcaagtaaaccatttttatctacattgaaaaatctgctgagggaggcaacagtcctccttattcatctctccaagatgggatgtggggaacatctgaagaggtatttagcctacacctgccacagccttaccactctccagtgaaaactttcagagtagcagcagcagcactaacaagcttactcctcaccttctcaaactctatgccttctcaatatcacactataacaggcacccacactgatactgatcctctaccttataccctcaaaatacttttcctctgattgctatagtgaccacagaggcaaagtaatttttactttacattatctgctctttatcctttagaatcattcctattcaagtgacttatcccaattttgtgtgcaaatttttcattttctcaccactttgtattattattttctctattttcatttccgtaacatagcaaattaagaaaagagttctggaataagattgcctaggttccaatcccagctcactaacactctttactagtaaagggtgctcattgatctcagtcagattatttctctgagctttagtgtcctggtctgtagaatggaaatagaatatttccttcatagggttgatgtgaagattaagggatcaaatgtgcatgaaacacctaaagtgaaatctcaataagttggccacttttatataataataaatccttaatgctttagtacttacataagtaatgaattacattcacttcaaataaacacaacacagaaaaaccacttacagtaattataggctaaaataacaatgcatgacttgcctgctaatattatacattagtgagtggtttcttatttataaaagttgaaggtctttaagtagaagagcttctgcattttaaaaaaaaaaaaaaaaaaagagctgccgaattgtaacactaacattttgaaaaggaagcagcaaaaacttggattctagaagagattatcttctagtggctcttaagactgtgacagtacagctagtgtcaattcgatagtgattaacttaatccagtgtttaatgtaaagcacaacttcttggtagatgtgaaatgttttcttatatttagggtccagcttatctgaaatacattatgcccgaaaatatgaactactcgccagaactctgaagtttagatttgggttattttaaagctcatgcggtaaatgaattagaaaggttatattaaagaaatacaaccaatgctacagagaaatagctttgttggttaatacatattcacttcagttcaacaagcattgactgaataccttccacatgcaaagctccttatgtaggtactttgagaattcaaaggtaagttatgacctgatccttactctcaaggaacttactatctagcagaggaaacaaatatttagtatacagttaaatatttaatatgcaactaaagagccattctttcagcaaggatgtattgcttgcccatcaaacgccaggcatatagaggaaagagtgcattatgaactaaaacagaggcatgaaatataactagagaaaagtgtcattctgaaggaggacttcatatggccgcacctgaaatgcctgaattataatcgctaccacccaggcaccagagtgtgtttgcttcacagaggttgtggctttcttgagcactgaatagggacctgagatcttctgtgaatgtgtaactttttcacataattcaaagacctcaaattaagaatttcttacaaatggttttgtttgcaaagaaagaattacaaaacttgtgtcaagataggatgcatactgacctaggagtttttttttcaaagaagtcatcaattatttttctaaccttatgtgactatttcatcactctttttactattatttacaatgttttcttctactctgatgttttccagatctgaaggtaaatatgaagtaacttagtaactgaaattcttgaacttctgatgaagctctaattggatcttcaactttaggaaaaaaaaggctatttactttgtcaaacagctctggattgaaagtaacctctgttcatatctttaatggaacatataacctttataactaaccacaatgttcagtaatgctactaagttttggcatgtaacagaaaaatacagattactgttcattatttaatttgtctgtctgcatttatgatatttatcataaactgtaagataaaggaaataagtaacgatttaattatgattgacttaaaagattccagtgattaaaactatttaagaacaataaagacataatacagttaagtgtaggcacttactcagtatataaatcttctatcattgcaacaataataacgatgagagacacagcaaatatctgacatccagaaccaatcagagaggaaaatatcagtgggtgacttgatggtctaaatacatctccatgcacctgtttccatccatattcatctcctaggtctctatcctatatacaaatatatatatagagagagaaaagcaaatcattcagaatcaaactaaaacatagtatgtaaaaattacagttgtaagtttcctccctccaaatttatagctaaagaaatacaaaatattgagaaagtatattccaaacttagaatgatcactgccttaataacaatgttaaaatgctgaggttcaggaagttgacttctggttgtgctcagagaatctcaaataacggaaaaagaaaaggtttagtaacaaaaagaaatggtcaaattgggagaacagtgcactgactctcttaatgccactttcagacactattcttgctattcacatcatagctgtagctcatatacaatcaggggctaggtggagaaatgaaagagaagagtatcaaaaccagtactagatcccctaagaatgcagaaatgtcctttagcgcctagaatctaagaaaacatatgggggaaatattcaatatgaatgtttttatttaacagtctatatgcatttttttaaaaagaattcaatttttactttgcaaccttagtaagcaagtgctccttaaacagtttctaacacagcttgtttctaaaacaatatttcctaaggaatagaagtccctcaaggtaatctgttttggtggggagaatcctaatcagatacagttaagaggtaccaaatgctttatccaccctctgatacttcacaatataccctagtatattaaaatttaaaatttgaaactatttcccaagccaggcacggtggctcacacctataataacagcactttgggaggccaaggcaggaagatcgtttgaggccaggagctcaagaccagcctgggcagcatagtgaaattatctctacaataaataaaaaaatagccaggggtgggggcttgttcctgtattcctagctactcaggaggctgaggtggcacgatcacttgagctcttgagtttgaagttacagtgagctatgatcgcaccactacactccagcctgtctcttaaaacaaatttcctaaatttatttaatgatacagtatacctataccgaatatccattagctagcactctatgtaacacactttttgttctctaacttagtaaaagaacttagaaaacaaatctttcctctgaacccactaaactgaacataaattaatccttctacccattccctgaattttaagcagtatttaacagtattagacatattcttacttggtggcaaaacttggcttgaactaacaagaggttacactatttatttatcccacttcgggtgaatgttcttatgttttcctgaaaaaaaattaatattatttgattacagggcatggttacagaccacactgggcattttacatctttcttaactctaaaaatcctgaattgtggaaactcaaagacttccggtaagaaattatgacctacctcccaacatttaaaacttaacactcagttaaaatgtttctacaaatataatgtaaatgtttactcaccatatcatccatttcttcctctttactgtaccgagcataatcttttcttaatgttctcattaaaatcattgaaactaagcccaccaagaagatcaccatcatgaaggagttgaaaattgaaaaccaatgaatctaaaataacagaaaataaaatgttaccaacctgcaatatcagccacaaaattcataggttccatgaggacaaccggatgttaatgcaaagaaaaaaaaaagtctttaattaaatcctttagacaaaaatccaaatttcagacactttgaggatgagtattcattatgccaaggggattggctttctttacaataagcacccatatgttgaaaacatgctatcatttatataaattttcaaaatcaaatttattgttaaaaacaaaaagtacaatttggccatataacctatgctattcagcattacatggaaaaaacatgggctctggagtcaaacattgccagtttctgactatgtgaccgcggttttctcatctggaaaatggaggagctaatacttatcttgtaagtgatttgtagggcttaataatgtatatataaagtatggcaccttagatactcagtaaatgttagttcccttccccctaattgaacaatctgaaaacctccttaaaatactaagactaaactattatagctggctgccatggacttaggtcaccatcctgaatgatttgcttcacttgctccagattagttcatcctcaccctgtcaccatcataattcagccctttccaaatccattttccatagcatattgaggtatcctttagttcctcaatgttcttgaagctcttggctttgattttatccacatatttgtttcaatattacatctagattctgattcataatcacaaggtactactcaaaatgtagcatatctgatttgaactaggtctgtggcactgcccagttatttctttatttacattttaattcccaaaagatctttagggatagtccccaaatttctctcctctcttcaaggccccaatgccatcctttctgctgccttcccttgaagcaaatcctgtcttctatgacacaacctttccacatccagttttgaggtgttttttctcctctcattttgcatcccaacccctccacctttcaccagccatcagcaatctccaaaggtccttatctacaatgatgtctactccctggggttgtcatagagtttaaacaataaaggtaaagcaaatagtatagtgcctggcacatcataaacactaaataaaacctaaaagttattgttattgctattattctcttttgaagtgtttgcttcatcttttgtccctcattcttttcatcttctcacctcccgatcctttcaatgtcaatacttttcaaagaagacatgttccagttcttccctcacttcctccaaaacacaatacaatctcacttttgccccacaaaatttctctcaaaggcctgcaatgaacttctaaaccgattcagcagccaattatctgcctcactctccttgatctctctgccacatctgacctttcctgacactacagcatcctacttcactgaccgctgcttctcctctttcatcttccatgctggctcctcccatcctttgtgaacttctccaaaagctccagtcttagtactctgctgtgacttctttaggctctcagaacttttaaccagcattccaatgatgatgataacaccctcgcccccacctcccatcccaccccaaattgctagtcttctttctcactcatgtttcaggcttttgctaactacaataatttccacttgaatgtttctggaattgcagactcagactgccctaaagtacactcataatcttccacctcatatataacacttgtttctgattctctaacttctgctaatggtactaacatgtggctttgaaattttacaattatctctggctcttccttctccttaattcttcataggtaatattaagcatgtatttttcttcaaaatgacttgtatctatccattctgcttcattcccatgccatcacctcataccttgatagcactaatggcctcctggttggccttttttttttttggtctctccccttcctttcaatttatcctgtaaaaagctatcaaggaaatctttccaaagcaggttcatatatcactcctctattctaaaatttacagttgtacaccctatttctctcatatcaaatctaaactattttctccaatattctatacttcctgtaatatggccatctcaccttatctagtcaacttttctttccattatattctatattccaataagccttatccctcttcaagaatccacaagcacagcatactcacttccacctctgtatttttcttataatttcttctcacatagatctacttctactccccttagcaaattctacccagtcttcatattccaacacaagtaccttcccctccatgaaacctcttatctacatattccggttcttcatagatatcctcctgctctaaaattctacaggtacatacatatgcattgctgtgtatgattaggacatatgttaacttgggctaacgtgctgaatatgtgcatgaaactgaagggcagtccaggctctgttatccaccctgaggtttcaggaacgagataaactctatggatcttcttgaaaaacaggagacagcctcttcagaagactattccttacttcattcaacaatttatttattgagcatccagtaaaattataaaggaaccaagaaatgcattgttttttgaaatgtttgctcaaaaaaggttatataaatctgagtttattgtaaaagtatcatttaaggttcataaaagcagtctatgattttccaaagatttgattttgttcccaccctgagatgttaacccagaaaagctcaagagggaaagaaaaatgacacataccatcttttagtcaatttatcaaattttttaaaataaaagaagttttatatagttactagtaactatactaattagacacacataaaatgttgtaatttctaacaaggctctgctattttctaatctaagatatacactattataatgtagtaataacctgaaattttgtaatattcctttattctaaaaattatgagatgttgtataattgtgaaattattataccagggaaaatacttcttaaaaataaagaaacctggtgtcacaaaggggtttactaaccctactaatgctgcatgccagcaccctctagtgtcactaatcctgaagctgcaccctcaatttgtcataaatttagaatgcaactggagataaataactataccaacaatactgcctcttacctgctatgtgccaaacactgaactaggtgctttatatcaacgtgaaattccccaacagctctgcaaggtactataatccttgcttcactattaagggaacagaagctgaagaactgaatcatttaaccaaggtcatagtaagcggcaaagcatcagtttgaattcagctttagctcctttgcctgtgctattagtcactgtattagaagcaattcttatacttgtacagtacatcatatcccttccttctacttaaggaaaacgatgcagtatttctctcctttttctcctgcattgccagttttgcaatctccactgaaccccatcagcatataaagttaatgtttttcttacatttaaaaaaaaaagaaagaaaaatctcctaattccattttccacactggctactgcaccatttctttgctccctttagcagccaagctcctcacaagtccataattgccgtctccaattcctcttttcccattctctcttacagcagctctgttcaggttctgaatgccccaccattataccaaaatcgttgtcaagttcaccaatgacttcaggttaatccaatagtcacttttcagtgctcatcttacttgacccatcagcaaaaattcagagctaatctctctatcctccatgatacactttcttctcttggcattcagaacaccatactttcccctcccccgcaaagcccttaactgaactcccctgttcttcctaaactcttactactgcacccagggcttagtccttggtcctcttctctctctacatctcccttccttagcaattattacatccagtctcatagccacaaatatgatctatatgccaattgctgcaaaatttgtatctctagcccagacctctctcctgaactccagaactgatatatccaatttgccggtcaatatctccatttggatatcgtacagacacaccaaaacgaacatgtcccaaactgtaccctaatcttcccctctaaatctcctccaaatacagccccagtgatgtcagctccactcagactgaaaaccctagagtttgtctcaacccttcttcaccttcctatcaatcacgaaatgccgccagctttaacttcaaaatatactcacaatctaacatcttttcatcacctaccctgctaccacccttgacttcctgaacccacataataatttgatcctttaaaaacaaaagtcagatttgttacccccctgctgaaaacactacagtgctcccctgccccctttgcatttaagagtaaaatctgcagtccttaaaatgaccatggataatctggctcctgctacctctctgacttcatcttcttgctagtcctcaaaccacagtaagcatatcctcactttaataggcttttcaatggtgttgcctccacctggaatactctttcccctaaatatccacattctttatttccttcaactccttcaagcttttgctcaacaatccatttcagaggcttaccttgactacataatataaaactgcaacttacccgacccctggtactcttgttctgctgtctactttttcttttttgacacacttctctttgaataaagtgtgttttacttattgtgtttatttcacgtctccttgactagaacgtaagttcctagagggtatagatctttgcctttattttctaatgtatcctacttacctaatacagtgcttggcagatagcaggtgctcaattaatatgtgttgaagtaataaatacagtataccattccatagtgaaaatactaaaaggcagtctttcccctaagttgtcaatgtccagtggggctagaatcaaggcagacctaagagttccagtagtgagtgccagttaagagccttcatattctcaaatgttatctaaatcttgaaattatctgtgtccataccctattgaagattgcctgagcattatactcgaggagaacacacagcaggtggggttgaggtggggattgaggtaggggaaaaattttagctccaagagtagtatgctaaatccttcagtaaagacaatccaggcagggcgcggtggctcacgcctgtaatctcagcactttgggaggctaagggcaggtggatcacttgaggtcaggagctcaagaccagcctgaccaacatggtgaaaccccacccctactaaaaaaaatacaaaaattagccgggcatgatggtgtgtgcctgtaatcccagctactcgggaggctgaggcaggagaatcgcttgaaccaaggaggcggaggttgcagtgagccaagatcatgccactgcactccagcccaggggacagagcaaggctctgtctcaaaaaaaaaaaaaaagactaaattccaaatagcttaattgttaaaatctctgacccctgagtaagatcagaagtagtgataggttccggtagagtctaagaatggaacctaacagtaatatgtaaatctgagacaacaaaaacttacgggccatctcaaaaataggtgattaataaactttaaaattctagtccaaaagattagatcaaaagaaagaagcaacaattcaggaagaaattcagaagaagggatacccttatgccttgtctttttatctccatccttgaggaggaaaccaccaaaacaaagtgtgatttttgctataaagaatcaaaactacctgtacaaaaccaacactaatgctaccggctttatgaactaaaattcagcaagtatctgtcggtgggggctggggaactgggaggccatttcttcccattcttgatgtttctttctacatggaaggatttccacaagcagaaattcctgatctcaatccgttctctcattacctccttctgatgcatacattctgttctttctcacaccgtaagttgtataagggcaagtgcccatgtagggaagcctataatatactctctgagtgtgttaagtctaattctgagtttcagtagtaagaagcccacttgatcacagatagatataagccacattctccaatattcacctcattagaaggccaatgcgctattcattgtgcaacgcagccatctaatattcaccttattagtgatattttggcttcccgtatgttatattcttcgtttatctcttaattggtttaaaccacaagcacaaagaaggaagtttttgattgctcctctaaaactccccatcacccttatgatttcaagctcatactttaaatcaccattagctaaatcttttaatccacagtcctcaacacagtgccctgcaaatgacagatactcaatgtttgttgaacgaattggtgcacataatcaatgtcttaaaatacactatttacctacccgatgttgaaaaaaggacggatcaagatatttgtcaaatcgatcttcaaatttcacatctgactttttccattttacctaaaaaaaattttttcatttgaaaataaaggccagtaaacaaattaataatctgatgacaaaactctgagcaaaatatagatttacacacacttagaattaaaattcactagagaaatggaggaaagttacttacaacatgagaagtggaaacgattatgataaaactaatcaacttttctgtttattgacaaaacttaacaactttcctcagaggggtgatttcagttctcaaggactgtttacttttgttgacttacatattatgacctgataaatgtgatatgaactgaattagtataagctcatatcacaagtgtctaaatcaattaaaataagaatctgtacatctgcctggtgtaattctgtcctgcgtggctgttctcttgagcagaagtcatttatctccgtctgccttctttcccacctaaatgcgtgctgccaccccatggaagattcgatggacatggacatgagccccctgaggccccagaactatcttttcagttgtgaactaaaggccaacaaagatgatcactttaaggtggataatgatgaaaatgagcaccaattatctttaagaacggtcagtttaggggctggtgcaaaggatgaattgcatattgttgaagcagaggcaatgaattatgaaggcagtccaattaaataacactggcacctttgaaaatgtctgcacagccaacggtttcccttgggggctttgaaatcacaccaccagtgcttttatggttgaagtgtggttcagggccagtgtatattagtggacagcatttagtagctgtggaggaagatgcagaatcagaagatgaacaggaggaggcgaaattcttaaggatatctggaaagtgatctgtccctggaggtggtagcaaggttccacagaaaaaagtaaaacttgctgctgatgaagatgatgatgatgatgatgacgattttgatgaggaaactaaagaaaaaccaccagtgaagaaatctacatgagataatccagccaaaaatgcacaaaagtcaaatcagaatggaaaagactcaaaactatcaacactaagatcaaaaggacaaaaatccttcaaaaacaggaaaaaaaattcctaaaacaccaaaaggacctagttctgtagaaaacattaaagcaaaaatgcaagcaagtatacaaaaagtgcattgaacagttcagggcactactggtaaattaagcccaaagatggggagaaaagaaaaggagagacaaatatagtccatactgagtatcatcaacaatccagactgaagtcttctattttaatctcaatctccttttctgatctgccatggatgcctctttaggctggaaacaatctcactcttggttccctaaagcagtttcttctgattgctgtgattcagtgaaccttgccctttgctttctattacttgcacattcgcctctcctctgaccatgttctgaatcaccttcgtatctccttagctgctcaataaatatttgaatgaataataaaaaaaaatctgtaaatctttatttttagactgcattacttttattacaactataaaattttttcattaagtttagttatataaggattatttgcatcaggtacatatgcacaaggcttgaaaaactttcaaaattgactactagcaatggactcattccagctatgaggcaataactggcagaggctacctacactgaatttctctctcatttttactatttttaagcctaagacaacagaaatagcttgacagttgctaaaaggctctgacaagctctcactgtgcaggagtatattattccaactgacagagcaatccatgataaactacatctatccagcaactttcaatacagcatcacttctatctgcaacattaaaaaggaaagggaaacaacatgaagtactgcaatctaaaaatgtaaccataaaaatacatgactgggttagtctaattacccagctacaacagtaaacttggctgtaccaaatggtttagctcctgcaaaggcataactggtatctaatactacagacctgaagcaaatcctctctttgctttcaggaggcttacttacgtacactgagaaaatatagttttaataatattctgttgcatcccatttcaagctacattttcatttactaaagttcaaagccacaaattgttgacatcgggtcacaaacactacttcctacattaaactatttgaatacttactgaatatgacatctggattttagtatttggaaccagtttcacctttccttcactagttagattaacatcaacaattcgatttccattaaaacctatttcaagttttttataggtccaaagatagtaatcttctccattttcatcagcctcaccaacaatacctacaaaagaaaaaacactttatacaaggtaaaaccacttaatatttaaaatatcctacaagctaaatgctcattaagttttttttttttttttttttacctccgccctctctccctccctggccactcttgactctcccttcaccttctgccatgattgtaagtttcctgaggtctccccagaagccaagcagatgccgctatgcttccaatatagcctgcagaaccgtgagccaattaaacctcttttctttttaaattacatagtcttaggtacttctttatagtggtgttagaatggactaataccactccctaacatctcaaaatttcagagaagtgcttacatcaccatctgccaaggttacccagctattagtggtcaaaccaaaattaaaatcaaggtttccagatccctagtctagtactttctctaataacctatgatctacccattcccagtaagatgtacacatgtatatatgggcaccaaaacttaacatgtctcctttttatacctcaactgctggatctgtccctgggaaatcagcaaaataaaaggagtggtgaagataaatggtaataaggatacagtttaaaattatcacttcaatcataatttgggatattggaaaaaaaagatccacaatgttagggaaatattataggtggtagctgaggatacatctctcatgccctcagactgccagctatttgtccaatgttccccacccaagcctaaacagttcccaatagctttatgctctgtaagttactccttagggccttccccctacgctttagtaagtattagggaaaaatataatcatatttataaaatattatttattaaccaaagtgattctaattggtacaaattcaaggagtatagttttgttttgcttgggattgtaggggataatgaaatccttcttttatctttatttgttattgaaacaaggtctcacactctgtcacccaggctggagtgtagtgacacaatcatagctcactgcagtctcaaactcctgggctcaaacaatcctcctacctcagcctctagagtagttaggactacaggcaagtgccaccacgcctgggtaaatgttttatttttttgtagagatgaatctcgttatgttgcccagtctgttctcaaactcctggccttagcttctcaaagtgctgtattacaggcgtgagccaccacactagcatgaaatccttctaataattaatttttttttttttgagacagagtctcgctctgttgctcaggctggatagagtgcaaaggtgcagtcttggctcactgcaacctccacccgctgggttcaagcaattcttatgcctcagcctcccaagtagctgggactataggtgtgcaccaccatgcacagctaaattttttgtatttttagtagagacagggtttcgccatgctggccatggtggtctcgaactcctggccccaagtgatccgcccaccttggccacccaaagtgctgggattacaggcgtgagccaccgcgcccagccaataattaatttcattaaggtttatttacctatctactctgaaaaccagactttgggggtaaagacataattatatcaagtaagaagctactctctaaaaggcgttaaaagactctgaaacctttaccccacgaaaagtcaggtacaaagttgttttttttttttttctgacaaggattctccatggttcagacattcaaggacatccaaaagtatttccccaaacagggcatattctaaaatcccagggctataataaatttaacacaggaaagcacagttgccactgttgctaacgagcccacagctgtgaatgaaaaaacctaaagcatgatggcttatccctatataatcccagaaatttgggaggctgaggcaagaggattgcttgaagccagaagtttgagattagtttaaataaagcaagacatcttgtctctacaaacacaccaaaaaaaaaaaaaaagagccaggcatggtggggtgcaccggtagtcccagctgctcaggagaccaagggagaaggatcacttaagcccaggagtctgaggctacaatgagctatcatggcatcactgcacaaacctgtaagcaagggaaaacaatagggaagaaacctgttctctcaaatatgaaggaggcccaaaccaatgggtttccctgaactacaggctcagaaaaatcttcagtgaatattcagcacatcttcctaccactgtcagagcggatcagagaaatgtctgtgttaccataatggtaactgcagtcatttatatgatatactaactacatatacctaattaacatgcaacacagtaatgatgatgcatataattatctcttgatattaactttctaaatttcatcttagtatgatattaaatgctgatctgatatgttcagactttgatagtttactgctcatgatgacagtaatctgctaacaattttaagcattagaagaaacattcattatacataacagcagatttccagagacaaaagaaagaaacaattagagaaaaatgtgatcaaacatattggccatgacagctggctgtgctttgcattataaataatttaatcaagtccaacataaatgattttggattattcataaattggcattaactattccatagctcttctccattaatatggataaataagggcaaaaacataaacattttttagcaaaataagccattcaagaaactatcataccaagaaaccatactaccacagtaccaacatgagaaaaagacagaatgaaacttcaaaatcctattagtccctttaactgtatttaaaagaacaaattaagatatgaaaaaaaatggaagcagaagaaatttttagattgttctaagcaccttctcattcttgaatctgaaaagttatactataaaaaagttatattttaggcaagtttcatgtaaggcatggcaatgtcaaaaattcttcaagcaacaggtgaccataaaactggtattaaaatcattctgtaaaaaacagtgaaaacacatttacaccatgatccagtacacaatcaccttaacagagtcattttataaattctgattatgcaaattttcccaaatcttaaatacaacatacaatacttaccccatattggtaaatcatctatgtacatctggtaccagtaatgattttttatggcatatacaaatgcatctctcttttctttatctaaatcaatttcacagtaagtggctggcatcacatcatctgcacaaaataaaaattgcaaattagcccactagtttgcaaaatagttacattaaaaaaaaaaaagacaagaaaaaagccaacatttcctacagttaaaatttctattcacaatagctgaatctgagtgataaataagtgtgggttcagtgtactattcctccctttttttgtgtatctttaagactttttataatgaaaaaattttaatcatctttattttcaaacattacctaagtgaaatcatcccttatacaaagcaaattatacaagaaaatttataaagtaacttcaaaataaattgattttaaaaacaaaaaaagcttaaacacataacaaagtttttatttaatatatacaaaagctcaagaatatggtcataaacagagataaccatttgtagctataagatctctctgagataaacactgattttaacattcttggaaagacaagttactggaagccacagattctatgaaaacacccagtgactattcataagcaggaagattaaaaggcaaacctctattcagcaaacatcactgtttataaattgccttaaagtcccctcaagatgagtcattttccaccccgactgctttcaaagatactgctactataattctattcagatggtttctaacttaataaacctagtatttcaaaaatgtacctgtttctaataaaacaaaagaaaatccaaaaaacctacaaatactaaacatgtcaatcaaaagaagttgttttggtatattaagcaattagaaaaaaattaagaaatcattctgaacaagaacaaaaaagcaagcacaagtttgtttttaagttctatactatatttgtactataatattggttatttgaaacatgaaatgcaatttctctaaagatacattattaaactttttattgatcaaaagttcttaaacataaattgtagctacatcatttagtggctcaaagaaatagcaatctaatttataactcaagatacccagcagtatgtctccccaatccttaagagagagagtagcttcccatattatagaccaacctaaagtgggtaccccaaaactacaacaccaaagatggcagtaaacattaaagtcccatggaagaatgtcagggaaataccttcttaccctcaaagtatgggaagaaaattaatttgtctccaacagcgactcccacatagattttctttctgcccaagccctcctaggcagtaaggaatttaggattttcatgatggcaaaaacaaacaaacaaacaacaacaaaaaaaaccctgaggctgagcagtgaagcaacggagggttaaaaaatgagattgctccaaagggtttctacagcaggagctagaaaaactgacagcaagagatccccaaatggggtctccaaggagtgtgataatgaacaaaaggtagcaggcaactgcagctacggaagggatattcagaaccaaaggaaggtccaggcttaagggacaacaaatggccacagtggcagtagggtacctcacagctacctctgcaaagccattgaattccttgccgttagaaacaaatattcattgataatggtcattaacaatatggtagatttaagtaggaagctctaagatatatacagtatggcatttatctgtataaagcctttttttttttttttttgagacggagtttcactcttgttgtccaagctggagtgcaatggtgagatctcggctcactgcaacttccacctcccaggttcaagcgattctcctgcctcagcctcccgagtagctgggattacaagcatatgccaccaggcccgactaattttttgtatttttagtagaaacagggtttcaccatgttagcaggctggtcttgaactcctgatctcaggtgaaccgcccgcctcagcctcccaaagtgctgggattacaggcgtgagccaccgcacccggccaatctgtataaagcttttaaaagattcctcagagtctggattttagtccaactctttgtttcccaactgatatatctgcctctacgctcaagccaaactcaattcccacacaccctgtgctctcttggcctctgaacttttttgctcatgctgttaactctacctaaaatgtccagtctaaaatcctcaccatcccccagccctttcctccacaaaggaatccctgactccccactccccacacttcttatacccactcccatacctcccttatggcatgtaggcctgtaccattttctacctcataccagtatcttgctcctcaaaaacaccattaggtcttgagcgctttgtccataactgattatatcctttttatctccagccatgcctgcttcagtaccctgcacagactaggcactaaacaaataaacaaaaaattttaagagcataattttcttatttggcaaaggaaatcactacacatattagggtatgtacctatacatgcatctgtgtatgaatagtgtgtatgtttgtacagaaggagaaaatgccaatttataaacaaatgaaatttttgaacagtgtctctcagaaggattgacaaagaggtcttgaagaataactttaactcatgtaaagtctagaaacgaagcatgttaaaagggaaaatctattattatgacaggctatataaaaagggtgttggttggtcatatcttaatgaaattcatcttccaggcaggtagacaaatacaaacatcacaaataactgaagagtctctggctgcccaactgaaacagcatttccctcaggagggagccaatttgaaaataactaatgcaatgtgtatgaatatgccaaatcattattcagcactctatatatctggaaaacaatctgaaaaatctaccagcataaatcagtgctttaaaattataataggctatatctttcgaaggtgaaacacacatccatgaattctgaaaaagatgcaattaagattttactaatgtaaatagttcttacgagggaaaaaaacaaagtagtaaagtggcaaatgttaaccttatttttcaaacagaaagcaaggttaggtagattctggacactatgcaccccaataatctaccatcagttcccaataaaactccaggctaacaattgaataggcagtgaaagcactgagaaaagaaagtggtaattattcatgagttctctaagaacacagtatgccatactttgtttactttctcttttgataacattacatttggaaaatgagaaacagtctacctctaattcagcagcacttggcaaagtctctcttcaaagaaatcaatatataaaaagttatagagaaatgggcagaaaggtgaggtttattctgagctctagtatctagtagctatgtgaataaaaagcaagttatttaacttccatgaacctctcagttcccttaacagagacagcatctatgctatctccttcccagagttaagaattaaaagcatcaggccaagcgtgctggctcacacctggaatctcagcactttaggaggcccaaggcagactgatcccctgagcccaggagttcgagaccagcctgagcaacatgtcaaaacctcatctttacaaaaaccagaaaaattagccaggcatggtggtgtgtgcctatagttccagctactcagaaggctgaggccggggaggtcgaggctgcagtaagctgtgatgggaccactgcactccagcctgggtgacagtaagaccctgtctccaaaaaaagaaaaaaaggattgaaagtgccaatatattcacagaaagtgttcttaagtttccttgggcctcacacccctttgagaatccaatgaaagtgatctttcccttgcccaccccctgaaaatgcacattcacataaaattaacgtagaatttcagagggcctgaagaccccagaagccagagctcttggttgaactatgcatacccagagcctaccatcgtgctggaatgcagtaagatactcaataactgctgaattaactagaggaaaacaagaactggaaaaactgatatattcacagttaattaaataactatataaagagtactgattaactgaccaacctgactagcagtataaacagtgtaattttttctaaacgacaatttggcaacatgtgtcaacaactgccttaaatatgtttataccctttgattcagtaattctacttccaagaattcatcctaataacagattcagagatgtactgaaatacttatgtgcaatagcagaaaaagaaaaccaaagaaggatggaaggaaggatcaaaatatcaaacaactagaaaatgggagaaaggccgggcgcaatggctcacacctgtaatcccagcattttgggaggccgaggcaggcagatcacgaggtcaggagatcaagaccatcctggccaacatggtgaaaccccgtctctactaaaaatacaaaaatcagcttggcgtggtggcgtgtgcccgtaatcccagctacctgggaggctgaggcaggagaatcgcgtgaggttgcagtgagccaagatcacaccactgcaccgcaatccagcctagcaacagagcgagactccgtctcaaaaaaaagaaagaaaatgggggaaaaaaaccacagtatccaagttacagaatagtatgttgccacatttaaaagagtaattaacagtatggggacaagctcataaaatgtcaagagaacaaaagcagaacaaaaactatatataacttactaaatgtgttagaatgtgcttaaaacagtgtccggcacataatatgcactatataaggatttgttaaataaactttaataaatatatgtagaatgaactcaactttcacatatttaaaacaatgtggataaacacaaacacagaaggactgaagaaaatacaacaaaatgttaatggtaattatatccaggtttatattttcctgtagttactaaattgtgtatttgaacttctatcactgttacaatcagaaaaatatatatgcatatatattcctttaaaaaacaaaaaagagatgcccatatttatcaaatctgctgttagtacaaggtataagaaatcggtaataagaattgacaaatttcagattcaaattatttggtctggctaaaacactttggttgaaaccaacaggacaacatattgtaccaagttcccagacttccacttacaaacaaggcagatttaaccacaagtatatttcttctctctcttaaaacccattaaaatgtcagtgaaggaataaaaagtatgttaagtccacagagacaaagagaagagacaacggtgggaaaaaaacaaaaaaaattgagatggagttttgctcttgtcacgcaggctggagtgcagtggtacaatcttggctcactgcaacctctgcctcctggattcaagcaattctcctgcctcggcttcccgggtagctgggattattacaggtccccggctaatttttgtatttttttggtagagacagggtttcaccatgttggccaagctggtctcgaactcctgacctcaagtgatccacccgcctcggcttcccaaagtgctgggattacaggccatgagccaccacccccggccatgggaaaaagattttaacaaatttttaggaaatggaaaacggttgtaagatgacaaactactaataaagcaggagaaaacataacaggagagtgatgcctgtaagggagggaactggtgtcacagaacccaagagacactcaggacttggaggcactacagacctcaaaagctagggggacagatgtaggactaaacacaaagggaactgtattaaaatattaaatatgtacataaatgggttagatggccaggtcccctcctctacccttcatacagctagacacatactgtaccctcaacttatccctgtagtagaccagtggcaccttcctctagagaacttaaaccagaggggctccagaatcagggacagcaggaatagcagaagctagggactgaaaacagcatgggggattacctgaagtaaacatcttccggctgaataagtaaacctaccatccccccagtcccttttcctcaccttttggcaatcaggcctatattccccaggcagatatctggagggaaataccgcatggtgaagataagaacagccaagattgagaatcactaaactaaaaatatataaggctctaaacagcccttggcatctcttcctacctgcagtactctcaacttaacaattaactctaaagaaaaaaatacttgtaaaataatttcagccctctgttaagttgcgaaattcaaggaagaaaaaaattcaagggaagatcgataaaataaacagaaggaaggagtcctgtagaagtcactgatttttccacaattaacacacttcattatactgcaagaattctcaaatgggggaaggggaaggacggatgggtggtgatctcttctggttaagaattactattccagatcatctaatgtccataatgaaccaattatcgtaacaacaagtaggcacaaaccgtctggatgctagacaatttattaaaagcatactatgtcttaacagctaagggtgcaatggtgaataagagtgctactataacaggctagtacagcagcttggggataaatcaaagtctgtaatcaataaactaacatttcataatcgtaaatacaaaatcaaggtggagctacagacccatgctatgtgctattagtattcctaattaccacttttcgaatataaactatataccaggaactttgataaatgctctacatgcattctcatttaaacctgacacttcgatcaaataaatattatttcccacacttcacagataagcaatacgagatcaaagaggttgaacaatttgcccatgaccacacaggtaagcagaggcaaagctggatgcatcaagtctctctgaccctaaagcacatcttctattccacactatgatggcaaggttcgaagaggtaccctctaaaactggagggtactgaattcaaaccaggctcaaggatgcctaatctaagtcagcccttctatatttaacgcattttctttttttttttttttttttaagacagagtcttgctctgtcgcccaggctggagtgcaatggcgcaatctcagctcactgcaagctccgcctcctgggttcacgccattctcctgcctcagcctcccgagtagctgggaccacaagcgcccaccaccgtgcccggcgaattttttttgtatttttagtagagatggggtttcaccgtggtctcgaccccctgacctcgtgatccacccgcctcagcctcccaaagtgctgggattacaggggtgagccaccgcgcctggcccattttcttaaaatggtctcaatttagcatttttgtctagtgctagaatataagattattagcaagaaaaagttgtgtataaaatcttgagaggcatcctgtattagagttagactatcattagttcctttaaatagtctctttagtaatcatcattttacaaaacgataccaatccatggagcctgacacagtctaataggttaaaaaaagatgtgtgtgtatgcatatgtaaacatgtatgtatgtgtacgtatagttttctctggtttcacatttccaaaattttatttgaatatgccttcagaagaatctttaaaagtcaaatattcaagagatgaaagattaagaacacacggtaaatattcctatagttcacaagagacataatgttccagtttctattattagtatgctacgatacaccatggataaatcactttatctctgggcttctgggagagggaattggatgacacaatctctaaggtgcatcctatttttttaatgtttggctaagtgacaacctacaacacttttcaaagcatgatcgactttatctttgaacacagcaagcaaagagctacagtagagggcgaagataaatctaatcagcatctactatttcatctggaccacttaatttagcagcttctttagcagcatatccatgctggaggtggaaacttggtaagacccctaggaatcagcaactctcagggaataacacttggctagctcttctttttttaatctgaaagtgcttagcttagtctgaaaagaaaataaatcccacttctttacccatgaaaaccatattcctctatttaaataatctctccatctcagcctctaggaactaataaaagggggtttaagattgccaaataaggtactggtaccaaaacagatatatagaccaacagaacagaacagagccctcagaaataacaccacacatctacaaccatgtgatctttgacaaacctgacaaaaacaagcaatgacaaaaggattccctatttaataggtggtgttgggaaaactggctagccatatgcagaaaactgaagctggaccccttccttacaccttaagcaaaaattaactcgagatggattaaagacttaaacgtaagacctaaaaccataaaaatcctagaagaaaacctaggcaataccattaaggacataggcatgggcagacttcatgtctaaaacaccaaaagcaatggcaataaaagccaaaatagacaaacaggatctaattaaactaaagagcttctgcatagcaaaagaaactaccatcaaagtgaacaggcaacctacagaatgggagaaaatttttgcaatcaatccatctgacaaagggctaatatccagaatctacaaagaacttaaacaaatttacaagaaaaaaccaaacaaccccatcaaaaagtgggcaaagaatatgaacagacgcttctcaaaagaagacatttatgcagccaacgaacatacaaaaaaaagctcatcatcaccggtcactagagaaatgcgaatcaaaactacaatgagctactaccttataccagttagaatggcgatcattaaaaaatcaggaaacaacagatgctggagaggatgggagaaacaggaatgcttttacactgttggtgggagtgtaaattagttcaaccattgtggaagacagtgtggcaattcctcaaggatctagaactagaaataccatttgacccagcaatcccattactgggcatataccccaaaaattataaatcattctactataaagatacatacacatgtatgtttactgtggcactattcacaacagcaaagacttggaaccaacccaaatgtccatcaatgatagaatggataaagaaaatgtggcacatatataccatggaatactatgcagccacagaaaaggatgagttaacattctttgcagggacatggatgaagctggaaaccatcattctcagcaaactaacacaagaacagaaaaccaaacacctcatgttctcactcgtaagtgggaattgaacaatgagaacacatggacacagggaagggaacatcacacacccggccctgtcagggggtggggggctagggaagggatagcattaggagaaataccaaacgtaggtgacgggttgatgggtgcagcaaaccaccatggcatgtgtattcctatgtatcaaaactgcacgttctgcacaagtaccccagatcttaaagtattaaaaaaaaaaaagattgctgaattaagtactcttctttagtaaatatgggtgaggatctcaaaaactaatgaaatctgtacacagtagcaaagtaggactcaggagttctgcctattctctcttgttggttcctctttaataaactagaaatgcacaccaaatacggaaaaagagaaagcagacgattacatatagtaccaaatctcaaagatcacattttctagtttaagttttcttgttatttgtgactaaatacttaaattacctaattaaattaaaacacaagcctcaaaggtatgtttacagtgattcataaaattacaggccatgccactgtggtttaaatttacaacttaattttataattaagccccaaagactataaacggggggatggggaggggggagaatgtaaatagatacggtatacctattttcaacaataactgagcaattttaaaaacaagaataaaatttaacaaatcgaaattaaagtaacattatctttaaaatctcactgacattcttctcctcaaagtactaaataataacatctttagtactaaaaataccagaagtcagttactattcatcttacacatggagacaatgaagtcaaaactgcagtaaacaattttactaaaatgaatacagtaccaaaaaaaaaaaaaaggaggattaaaatccaaagctcctgtttacaggatccatgatgtattcaaaaaccaagacacctaatcaaagatcctgcaaaaattcaattactcaagcttctgttcaccatgctaaaaatgcctgtgcaggaaatacactctctgacaaacttcacagagaaaaatgaaaagtataaacacactcaaaggacctgataaatggatacctgcataataactagatacgatgaagtattttccccaaatttaacaagtctttgacttaaaatttaaatatcctataggtattaacaggataaattaatacaacactgataaataatacatgttaagcctatggtacaagtttgaatttgaggcgtcacacaagaattttaagtatccacgcatcccattacagcctcagacctccagaaattactttgttaaatatccatgaaggtcttcccgggccacatgtgtctaatcaatagggggtttactagacaacacttttcagaaggaaatatgttaaggaaatacaattttattaacaattatctattttattatcttataaatattcaaaggaaatctttgttaattactaatatactttcctaaatgcaatacacctcatttacagactaaaacacattttagagtctaaagtagtggttctcaactgacagcaattagcaatgtctggtgacttttttggttttcacaactggaaggtgctactggcatctggggggtacaggccagggactctgctagacatcctaacatgtacataacagctccatacaacaaagaattatccaacaccagtgtcaatagtgccaaaatatgaaacccttgtctacaatccaaattgcattgtaaggactattaaggtttacttacctttaaatttaatatccagaccactaaattccaattcaaccccttgaagtgcttctcccagagtttcatggtaatgactgatacttttttttgaccccacacagaatggaagtgaaaagtacttatatgtttcttgacgattatggtagggcccaacagtattcatccataagacaacttcctctttatcttgatactgaaacaagaaaagcaaacaagaattaaaaaaaaaaaacacactaattcaaattaagggaatatttgttgtgtgttctaaacaaaagtgcatcatctctgttcaggaagctataaaataaatactggaagcttaatctgatgatgaatgtccacatcttaaaaatgaaactttgtgaattttaaaattatatcctctgattgtagtctcaggcagatacaccttttccaaacttgttttatagaagacagtgtttgaactaagcccaatagctcataagagtgtgtctattatttacatttacactatcaaatagtggcaaacctgcaaccagcatgattcaccatgctaacatggacaaggaaggaggaaacaaaatcaagtttatccagaacctcatgttaatcaattaaaaaaaaaaaaaaacctaatgttgccagcaagcataaataaaatttcatctccttgcgagactttcacacagccactggtcaaagtactacagaggacaaggaagaagactgctatagaacctccacaagtccattcaagccaacattctatcttgttagcagcctgaaagacatgcactatatgcatatttctttgaataagtaattatggaactacatatcagtgaatattatacatggctaaatctgaagtgtggtcagtaatgactttgagtagttccaaggtacaagtgggaggcctgtcaaagatttctaagatctcgacaagtttaaagttccaatgattctatggaaactgattaccatggtaattttaaaactaataattctaagtagcagtataaattaaagacaacattggatgcatttaaatcaactaatagtgcagacattaattcactgaacaattatttactaagtgcttagcatgtgaaacaactgtgtttataactgaggatacagctttgaacaagatgtgttccctgtcctactgggggaaggatgggcattaaacaagcaataataataaggtaggttgctatggggcacataatagaagaagtgatccaactggcccactatgaaatccttatctccagtcctccatctaaaactagttaataaataaatattttcaatcaaaacctaacatctccaaaaccaaactcatctacccaaatccacttcccccagcttcatttttctaatggtactaccattctctcagccatggagactcaaaccccaaatctctctgcactctagggaacccaaaaacattaacttgtatgttcttaccaaaaacatctgcctttttcttttgattcacacgattatcaccctaagacttagacccagtcatttcattttcaaacataaatgcctcactgttcatataagacaacagccaggtcattaaggaaataacaaatgatctcaccttttgaacacatgtgacaggtaccaagtatcgcgttaggtattaagaatataaaagtaagtaaaatactgtcgtttccttaagaagttcataatccacagtggaatcagacaagtaaatgattaacaaagaaaaaataagtattataattaaggtaataaagggctattgtagcaacaataaaggaatgattaaattcactttggcagagaaggtcaggacgaataacaatttggaaaatcataagctgtttcaagggagttcagaaaaacaactgtagataatcttcacataggaagtaatgaatcaaaggtctaaatgttaatgtagcagtatatccccattcattactattctttttatttggggagactgacaaatatatgtatgcccccactcttccatccaatgctcatgggccacacaatactaatcaaccaagttactcctttctgctgaacatagatattgcctcagagttctcaaaacagtgctctaaaccaatcattaccaactgatgagagttggtattagaattaaaacttgttcatggccgggtacggtgactcacacctgtaatcccaagaccttgggacgccaaagcaggcggatcacttaaggttaggagtttgaaatcagcctggccaacatggtgaaaccctgtctctacttaaaatacaaatattagcagggtgtcgtggcacacaccttgtaatcccagctacttgggaggctgaggcaagagaatcacttgaacctgggaggtggaggttgcagtgagcctgagattgcgccactgcactccagtctgggtaacagggcgagactcagtctcacaagaagaacctattcaccaaggcaaatagatatttaataaatatgatgggaaaacactgaagaaatgctgaaatgtaaagttcattggcaacttggtaaaagaagtttgaagtatgtgaaatgactgctatgtaccctgactgtaagagtaccttttcagaaaaataaggggaggtaacataattcatctatttaagagcagaatgttgaatgagacgacctattaaagagcaccttgccattaaccctgctgagtctgcagaaatgttataaatgtaacttgtgaaaataagcacaaaaatactttttctataaattccaatacttttcctttaaaaatagacaacatttttgaaaataaatacctttaaaaatagggcatccatttattttatacaaattaaaacataaggactaaaataatttaagggtcccagtcgatgttaaaccacatattccgaagttactcattttaaacattcaggaatccttaacagagtggtagagttgtgatgtgatgcccgtactgtaataaaatttatatcattttgtagtctaagattctttctgggaagaggactgaaacagtaattagaaatacacatactgagagtttagggtgaatagcaaggcaaaaataatgcttttttcttttgttttgctccttactatgcagactgtggtttaatacaattaacttaaaatgtttacttttcattgcagaccttgattgtccctgagaataagtgcttccaagacaagatcaagagttctctctcaaaagaaaatgttttaaaatattttgaaattaaaaaataccaaaagacttcacacaacttctgaaggagaaaacaaaacaaacaaaaatctttcctttccctaaagctttgataaagcccctgagctccacagtctgtgggaagagagtgctaggcccagaagaaggtggggtggagtcacagaagcacagcagtgtatcaggggatccctaagcacgataataatccctttcatctgaggcttccctgggaaacggccaagtgagaggaggccaattcaggctaccggcattcttcacctacttattttccagctctcagaagaatctcactgctacacttacgtcatccacgctggccaaaacggtttatgatattgtcttcctccccttttctgcttcatctttgtgtgtgtgtgtgtgtgtgagacggagtcttgctctgtcgcccaggctgcagtgcagtggtgcaatctcggctcactgaaagctccgcctcccaggttcacgccattctcccgcctcagcctcctgagtaactaggactacaggcgcccaccaccacacccggctaattttttgtattttttagtagagacggggtttcaccatgttagccaggacggtctcgatctcctgacctcgtgatccacccgcctcggcctcccaaagtgctgggattacaggcgtgagccactgcgcctggccccacttcatcttctttcgtcattccaccaaatttagaatgccctccttttctccacttagccaaactctaataatccttccgaaatgctcaaatcctcctttttcaaatcctcaagtaaagccttaactcaccaaaccctaacatgacatgatctcaccatttttgtaataataacatcagtagctaacaataaatacatactatgagctaggtatagttctaaggtctttatatgaacacttaaataatcatctcaaaattctataaaataggtcctattacttccccattttacagactaaaaacaaaaacaaaactaaagaacagagatgttaagtaatttgtccaaatcaatcagcatcaagtttaaaaggttagtatttttgctaatccctagtcagcttcattcattaaagagcaaaaaactaaatcaaggaaatatgaaaacagtgccaggtgtacaaagcaactaaagacagtcctgaacactgaataacttttctatgtgagcctttaatctgcctgaaagaaaaaaaaccttctaagaagctatttgcactctaatctcaaaaggaatgacctttattctcaagaagtcaccaatgttgggcccctcttatttaaatactgtttatgtgttgggggggtaccaaagttttcctccttgacagaggtaatgaattaattattatcaggagaaacgctttagaagataatatgctgacgtggtcatgtgaaatctgaataagaaatcacaatttacatagatgagcaaaggactgagggttcagaacaagcacccaaatgctatccttcattttcatacaaagggggaaaaatatatgtgtttacttcaaaataatgttccagaaatcataatttcaaaacctttaaattattaaaacacacatcagaattctaatacaaataaattagaaatgtaattttgaatagtctcttgagataactactctctctcaaaaatagctttgtacctaaataaactttcagtctatcattgagtagagctgaaaataggacaacgaattacggcatttaacaatctacattagataactcacaaattcacttatagtaaacagcttatactctttataagttttcagtaagttttaagagttcctatactcccaacagagacaaagacaaaaggtttccatttgccaaagtaaatcaaacaaaacatttctgaaatcactccgtgatataatacaaattatttatgaggcagaggctgagtaaacgattctagtaggcatccagtctgtccaacattagaagtctcaagattaccagaagtacactgggccacagagaaatagggaattttagcctaggtaggacccccaaatcaaaacagaagactatgcatcttaaaggaataacggcctcagtttgttcattgtgcttccacactgcatatccttgtcactagtagctccctaattattcaagtcattcaacaagcactcatcaagtactatttgtgccaagcacagtgcttgcgtatataacagaccaaaaaaaaaaaaatctgactttgtgatcttgttaaggaaacagaacccataaaaattcaaggctacagtgcaaactataaaatgctctaagattcctgtgcccctaagtactgggtttttgctgctaacatctttacatattataactatggaattacatgtaaaagacaggtagaaaagacaagactggcgatcaggaagctctgattctttctgtggccttgagcaagtctctgaacctgtacaggccattaggaaaatgaagagttttggattaaattattgagtctttctagttctaaaattctatgattctcaatctgaaattgtttttaatggagtccttcggaatcttaggagacatagtaatctaactctagatgcttccaagtgctttgagttttagaaaaccaaataagcataaacatacctttcactgactataaagaagcctatgtcccttcaatcagttattaaaagcctgtcttccacaaaagtgttaattttcatttcaaacaacatgtctgtaatgcatatgattcaacttttaaaaattaaaaggaacacatttttacatattctagatatgtacatacagtcaatagcacatttccttttcaacactcttcagagaatattaaaataactttggacaaataagcacataaaatatatacatatataccatagggtcaggcgcagtggctcacacctataatcccagcactttgggaggccgaggcaggcggatcacctgatatcaggagttcaagaccagctgaccaacatggagaaaccctgtctcaactaaaaaaatacaaaattagtcaggcacggtagcacatgcctgtaatcccagctactcaggaggctgagacaggagaatcgtttgaacccgggaggcggaagttgcagtgagccgagatcacgccattgcactccagcctgggcaacaagagtgaaacatagtctcaaaaaaaaaaaaagaaaaaaaagaaagaaagaaagaaaaagaaaaaaaaataccatatgggtcagatggccacctgaatcctaattcagtaggtacagtaagagatatcaggggctttggggaatgggcataaggtattgtcccttcttaggacaagctatataatttgtgcgacccagtacagaaaaatacagagccccttgttaaaaaatttaaaacttcaagatgttacaggatagcatgaaaacaagctctcacacagtcttttgtgactattcagggcacgtgcccatgaagtcaacactattgctccttaatgctaacccaaagatctcagaaacaactcatcatggagccacactcattcgagcatttaagcatttaagcacttaaaaatcaatatagagaaccactcaatacctagtgctttactgtcttatttttaggataaaggggaatagagcatatggcggctcacagtgcagaagactatcaactcagaatgcctaagttcaaatcccacctctacccctaccagatgtgtgttatctgcaggtgacctcacctctctagattcactttcctcatctacaaaatgggcatattactcacctcgtaggttattaatagatgagttaataagtgtaaaatacttagaacagtgcatagccagcagggcatggtggctcacacctgtaatcccagcactttgggaggccgaggcaggcagatcacctgaggtcaggagttcaagaccagcctggccaacatggtgaaacctcgtctctactaaaaatacacaaattagccaggcatggtggcaagcacctgtaatcacagctactagggaggctgaggcaggagaattgcttgaacccaggaggcagagattgcagtgagtggacattgtgccactgtactccagcctgggtgacaagagcaaaactatgcctcaaaaaaacaaaacaaaacaaacaaaaaaaaacagtgcatagcccattttactacaaaagacatactaggtattatctggaaacaatcttcacaggcaattaacctaaaaggccagcttcagcttctaaaagttattgtttgataattcaattctacatgtatttactaaacacctactcagcaacttccccacaccaatgtctcctcttcctttagtattattctctctttactagctacttctgcttctttgacagaaaaaaataaataaaactcacttgacattagccttttcggtactactatctggctaagaggaataggaatgcctagtttttgagaaatattttcaagaaatttagaaaaagcaaaagattttggctaacagtgaaaaaataatataaatgacatttgaattttatgcttatttttagatgctattcttcccataactgtttttgtttttgttttgctttttacaatacatattcggccaggcgtggtggctcatgcctgtaatcccagcactttgtggggccaaggcaggcagatcacttgaggccagtcgttttgagttcaagaccagccgggccaacatggcgaaatcccctttctactaaaaatacaaaaattagctaagtgtggtggcgcacacctgtaatcccagctacttggctaaggcacgagaatcgcttgagcccgcaaggctgaggttgcagtgatgtgagacagcaccactgcactccagcctgggcaacagagtgggactctgtctcaaaaataaataaataaataataggtatttaataatgggtaaccaagtaagagcagttcaatatagacatgaagtaatatggattctaaattttttgtctagcaaccatctcatatataccatattatctttcgtggcagtcaacaaaaaccttttatcaaatatcttatatgcaattactagaataaaaaactgaaatagtcctagcaataaaactgcattgaaattacacttttaatttgtaaattattctaaagcctttatatacacccaatttgtaaaattttaatggtttccctaatcacagcagtgtaagtcacaagattacaagattaaaaagtagaatacagtacacttttgagcttatatgcctgtatcacggaactacacattgagagttctgagtttcatatggtaacttttcctaagtgtttttttaattggaaatatattagtaataatatcattaaacagaaggatggatgcccactgaaaatttaaaaatactcaaagacccaaatctatacatggtccctgtatactatgtgaaacaatagcagttcttaaactttgagacagcttatctgatgaaagaacacaaaaggaaatcgttttaagctgtttaacctcccaacaaaattatcttaggtgaaacaccacaagtacagtacaaaaacatgtcaccaattcgagatttgtgtctctaaagaaatacatacctacacaggtaagaagtttctggctgtgaccgaaggtagaacagtcaaaagtttagagcttttattagctaaaataagatcccagctagccaaggatccagcgaaaagttttgttgattacaaataaaatcggatccattaaataggtaaggacgactgcttcatttcctcacttaccagaaatgacataagactccctcagatcgttctgatttagtacaaacacagtctctcatagaaactcctatcattaatggtaaaggtataaaaaacaattactcgtcaagcaaactctcaatttacctgaccttcctgccttgctcaagtctaccactctgaaaaccacagttacagccctaagtgaaagccatttgaagagtcgttcacatgcacgttttgatgtgagaataccaattaaacaaactgccaatcacctttaggccaaatgcaaaagggactgtttctggccctgacctgaagactgggaaacgtcaagaccctttactgtcagaagctgccttagttagagactatcgggatgggggtctcacttaggggctggaaggtgaggagaaagttacaagaaaggcctaggaattgaacgcgtgtaggttgggtgcacttacaagtaagtataaactgctcttcaattcaagtttattaatgctgccccaccccagggttttaatccggtctgggcagaagcgggcgataaaagccaaaggagaccataaagtgtaggatatttcctggttagtggctgccgggtaatcacgatgcatccatcttcctcggcgtcgcagccctcagtagccagaaggcagtctccttccctggggggcaaaagccccgagcccagcctgcccgttgccccgctcccgcggtggatgaacctcaacccttcccaggctccttcctggccccagggtcccaggaaccccgagaccctggggtgcggcgccactgaggcccagaccgggggaaggagaccctgtcactcgggagcggagccctgtcccgggagcgcacggaaatgcctcctccacgctcccaaggttcctgctccgccaggcccaaccggaaggagtcctcgggccgcagtggggcaccaccgggccgccgggcactccaggctgcgtggggcctgcctcagtgggcaactggggagctagcccggggcggccgcgccggccggggcgcctcaccgtgtgttcgtgctcgtccgcccgggtccggggcagcagcagcagcagcagccacagcgcggcggccgccgccacgccaagagcgccaggcagcggcctcatcctccgcgcccctccggcccggagccggctcaccgactcctcctcccgccgccgcctcctccgccgccgccgcctccgccgcggccgattcgcatccacggggcgcggacagacgcacggggcccggcccagccgctgcctcctctgccgccgccgtcgccgtcaccgcccgctcctgagcctcccccgccccccgcgcctcctcagcctcttcctctgactcagccacgtcatccggccaccccggcacgcgccggaagtgcctcgcgacgcggggccgccaccgccgccgggccgagggagggcccggcaaccgccgcctgcgcgccggctgcccctcggctcctgggagccgcggcgctacgggcctgccgagcactcgggcgggcgccgagcaggctgggccccggcgcagtggcctagcctggaccgcaaggccgaagccgcctccgggccgcgtcccggtgtttcgggttgtgtaaccttggccaaaatgcttaagcttttttcctggctgccaaatggggccgatcgtctgacctgctgcctccggaacttgagggatcagatcaaataaccctttcctggcgctcgtctgccgctgtgaatgaatcacgggctcctgtaatcaccgttaggagagattgttaaactcgtacagggttggatgttttaaagttactgaatatttactggacccctactgttcaatcaagacatgctaagttagcttgccattcttgttcatttatgtgtttacttaactatttctgggtctcctcttcccagtcataaatatctcttggagtgtaagctcctcggagcagagatcctgtttccgtatttcctgtacctagaacagtgccagatccgtagtagacactgaaacaaaaaatctttaaaaaaaaaaaaatatacgaatgtggcaccaccatttacacaggccactaagccaaaaatctcgaacttgtcagattgtctcttctcagccatcagcagtcaacaagttctagcatttggtctcttaaaagtggttcaagagtttatttttcctctccttcctctgccagtaccaaccagtcttccgtatcactatgtattgcaagagtctcacaagaagatatccatcactgactgatcttcctcccgtttaacatccccaacaggtgccagggtgatgttttttttattctaaaaagaaaccagattatatcgctcactcccttgcttaaaacagttcttcaatgttaggtaaataaatcatggagtcaccacgagggcgttcatctgccaggcactattctgaacgatattggctcattaaattctcacagaaaccctatgcagcaggtacggtgaaaatgttcctgttacagatgaggtaactgaagcacagagagcttgagtggcttgctgaaacaccagacccactcagtctggctccataataggtctttttgctggtaatgatttaccaactatacagccactttaaaaaaaggaaataggtaagtactggcatggaatgataaccaagaggttctgttaaattttcaagttgaagaaaataagagtttaacttcattttatatggcaatatgttagtctgcccatagaaaacaatctgaaagattataacaaactactatcagtggttaactttctactttgtacatgcctataaatgtttggttattttttacagtgagcatgtgctaactatgtaatcagaaaaaaagttccctgctaaaggataaagtccaaatttttgcctattttatccctaatttatttccctaactttaccttccaccaatttctatgctctgcattcacccgtatatatttttacacctctgtgcctttgctctttatactccctttatctggcatgctctgcttcaccttgtgccttagatattatcctttcagacctagctgatgatcacctcctcagtgaaaccttgcatgatcccttgagaaatggagcattccttctttgggatttcaatagcatttggcgtgttgtgttgtaattatctattcacatttcctcttctacactgcattcggacctttttgattgcagggactatgatttgtttgtctttatatctgtcccagctgctgagatagtgcttgtcacatcataggtattcaactctttgctgaatgaatgaagacattaacaagtgaaaagtcaaatagcatagcaagatttgaagaatgctttctagatagtgtaagaaacatcacaaagcagtacatgattaattgctgaatgaatcatacaccagtaattgctgtagaaatcagaggaggcatcttatacatctttgtatatcctcccgagcacctagcagggtgacttgctcatagtgaaagctcagtcaattctgtgaatgaataatcactgctcttgaatgaagtgatgatgtgcaattgaagaacaagccgtgtaagtgctacattaagatggatgtgtagtttcttaagtatccatcaccaccctccacagatttgaggtagtatgcatgtggcaggtgttttggggaggactgggttggcaaatgcttggaggtagggaggacacaagaaaaagtatattcatttagggaggatagattaaaaccaggaaactacacacacaacaaagaacaggcatgacagtgtacttttaaaaaggaacacaaaagctggccaactgtgcaaatggtcaacaggcagtaaaagcaatgggcaatgagagaagtggaaagaaaccctatttcagaggagtatttgggaaaatttaatggatggaagagcaggtagagccattaattcaacgattatttattaagcctctactatgtaccaggcactctggtaggtactaggggaattatgctgataaatggcattaggtgatacaagtctgacagcagtaggtgtggaaagaaggaaagggagataaagtaactgattagagtaaaagaagtgtggcttcaaagatcctaggtgcctgatgacctcaacaggacaaaacagggctcaggtcaccatcaaaattagggttgtttcactaaactggggagtgaaaaacattaacataccttatttcaccacttatttcatctgggtgaatgacctcattccctgacaccaaaaaggatggcagcggtggggagaaaatgccggtgaaaggcatttcccacctcccccagtggctatacagcctcttttctatggtagctctaataagactccattttggttaaagagcttatgaccagcaagcaatccagaaaaccaaaatgtcagtcttttattttcattctgggtaaacatgatcatcaaaactattaggtatgggggctaggcacagtggctcacccctgtaatcccagtactttgggaggccgaggtgggcagactgcttgagctcaggagttcaagaccaacctggacaacagagtgacacctctgtctcttcaaaaaatacaaaaaaaaaaaagtatctgggcatgctggcacgtgcctgtggtcccagctcctcaggaggctgaggtaggaagatggcttgaacctgggaggtggaggttgcagtgagctgattgtgccactgcactccagcctgggtgacagagccagaccctgtctcaaaaaaaaaaaaaaaaaaaaagtattagggtatggattgaccacatatcttctgatttctatcatcagctactttttctttgaaattctatttcttccttctactttgttatgtttgtcttgccagttatgtacttcagcagggtgggcgacagttcgtctattgctatttgccattttccacctccaccgtttctgttctggctgtaatgttctagacacagatcttcatgattgctctgagttctttctttaggaagccattactgagaacatttagttcttggactgaagagcaactaaggccattagtttctttgtgtggttcctctttcactgtctctcagttttttaactgatataacagtgagacagagcaaggaacagcaggtgccacataataaaaagagccttgccaattaggtggtgatgccactaaggctgtctccctgcttcttccgacaaagcgattccacaccctctttctgagacttagacttaacagagttgaagagacctagactgttaccaaagacacaactctccacttcgtaggtgatgaaacatagaacaaggtagtcaagttatgtgaactcgtcaagtaagtagcacaccaaaataaaagaccaggtttcctggcttccgaaacaatctcttccctataccatgctaactcttactgcagagatagcaaagacattttatcctaaatgggctttggcgactagcctaaatattaaatttgaactcaattgaacatggacacaaacgatggtcaccaagtcccagaacggattgtgtgagctctttgaggcgttcatccagcgttgtttcggagaaatctctatttcaatctattcctatacattagttattgaaaaacaatagacaaccgcaaaaacaagttgacctttttgtgttccttgatcctggtcacaaagggcccttgtgactggacctcatgccaaacaactcgttacaaaaagagctagggttccagactgcgccgaagcttcatgagacctctccttgtctgcatggacgagtggccaactctggagcccaggctgttgcttcccagtctggtggtgaatcctccatagtctggtgagtgtaaatacatatatatatcttttcccttctcccttcccattgcaatttgcttattatatcatttgcttatatctgcactgccatttgggataaagcttgtttacccttaaaggtattgtgtgtgtgtctcctcccgcgcgcatttcccacacagaacacctaagaacctattttttatgatttttacgagaagtgaattccaagttgtgcctcagaattcagaatatatctttcaacctcctactcatcccctcaccaccctggtgaacacagtgtctggccagcaggaatgaatgaagaagactattttatgttcttaataacttgcttggaaatgaacagagcacaatttatcaaaccaaagcaaatatttatacaggcagatcccttaaaattgaggattaatgcttaggaagaattttttagaattttccaaattaaccacttgtctttctcagaaataaatctgttactgatgcttcctccaccaaccagctgcaaaaccacacactattctttgaaggaggaacacagaaaaccaacttacttcctggggcatttgggagaggaatctaaaaatcctagtgatatggcaatgactagaaccttttttttttttgtaacaacaaagctaaaaggggatgtgtaacttagcttgacttgtaaaaatattcgtagaagtcatctatattttaccactttgtgtaactaaggcagagcattagagattattcacatcattaaatatgtccagttaaattattagattacaacaccaacctcttgttcatagtctctcagtcttcagctgggcacgggggctcacgcctgtaatgccaccactttgggatgccgagacgggcggatcacttgaggtcaggagtttgagaccaacctgggcaacatggtgaaaccccgtctctactaaaaatacaaaaattagctaggcgtggtggcaggtgcctataatcccagccactcgggaggctgaggcgggagaatcactggaacccaagaggtggaaattgcagtaagccaagatggcaccactgcactccagcctgggtgacaagagcaaaactcttgtctcaaaaaaaaaaaaaaaaaaatagtctctcagtcttcatactttgttgcttagttggattatctgctcctaggttttaatataagatgaaataaaagtgctggcctaggaattggaggccaatttaccttaggggcaaaggcaatggtggtgaatatacccaacagcttcactttctatggagccagcttgtaaaatcttgggcaaggatggtggcagcagagctgtctgcctaagcatcatgtagaaaattttttaatggtttctttggaccctagcttgcagtgtcatttctgcttctcattgtattggaaatccatggttttgttacataatgtactcctaaaaatgtatacacatgtgttgagtatgtggaagttgaatatatttatgttataaatgagcagttctgtttctggaaaatgaaaattttcacctcatcactacagacattctttgataacacagtcccagtgtttcatccagattatttcattttcttcttttacatataaccaaccattttggatgttaaaggaacaaccagtgagggcttaagatctgctgcttttgacttggcactcctgatcagttccatccgtgtctcaagtgtatcacattcacgagacaaggcttctcatcagcaatttcaattttatgttttctacttatttttatataagaatacaatgcaacaaaatattcatatattgcacaaacagtgatgtgcatacaaagatgctaacaacattggctggtaataggctttaccatgttacgatctaaatgcttgttcatcagagaatgtacaaaattctaagtttggcatccaaaagggggcttacagttattgaatatttttcccagccctattttaaatcaaattcaagtttgcctatgacaaagactgtctataagtaacagggcaagcataccaacatcaaaattattcttcttcttatctcacgtgcccctatttctcccaaataagtgacaaggagagtaaaaggatcactgagggaacatttgaagaatgctactaagtgccaggtcctgtacaaggtaattaattactacaaacactctcgtgatggacatggccaatagtgtattttgtcaaaaaacaaaaacaaaacccaagattccagaagctgtttctgacaagaagtccttgtttcagtactcttcagtatgagtccttacttgcaggactgaggaatgaaattgagaaagaacctttaatcattagaaaaggacccaataaaactatacttaaatggatcattaatgtggatttttttacattcgtgtgggatagagaataatcccatgggaaacaaacacattttgaatattttttaaagaagtatttctgattctaattttactgtatgtttaggcatcattaaggacctctgatttgaaggtagatttatgtgccagggactccaaattcatgacatgttttaaggctccatattccatgcaaaaatggacttactgagcatggtggtaataataagtatgtaaaaaatagataactacagtcgtactttggtatccatgggggattggttccaggatcccccagtatcaaaatccacaaatgctcaagtcccatatataaaatagcatagtatttgcatataacctatgcacatcctcctgtatgctttaaatcatttctagatttcttataatatctaatacaatgcctacacatcacttcatttacatgaattcaacatacttcttggcatgcagcaaattcaagttttgctttttgaaactttgtagattttttttcaaatatttttgatccaaggttggttgaatccacggacacagaacccatggatttgaaaggctgactgtatttctattttaggtttgtttttcctcctcagaagcctcaacgaagaaaaagtcaaaggtccttctctctctatgaccagaaataaaacctataaaggaaatagagcactaagtggggtccctggaatccccagcttctggtttccagccacttctagatgttctctggaaacataactgcgttgaaaccatactgaagtataaattcccaaattggaaagaaaacaaacaaacttggtagtctcatgcctgggagatacggaagatggaaaattctggaagaccaataggcactgatgaatttctacatctgggcatttcttgagggagagagggcctggctatttggagatggaaaatgtggtgacctagaatgagcaggcccagtctagactaacctctttatttaaccaactgaatagtcttggttccagacttctgtggaacctcagatttgccttctgtataagaggagtttgtactaatccctctagtctttttcagttggttgtgtgtgaccagccctagcacttaaataccctgctgaatatacagaaaagtagaagaattattttaaaattaggtcacttatcttacttgaatactacaagtctcacactataacctcttctagaaatcaggctgaactagcaaatacataaagactaatataagtgcatttcagtaaaatcactggtgaagtacatttatgatcattctttttaggcttctgatatggcaaattagaggtaagtatttcgattaagtcttcatccttttggcaaacaagtatatggttcgatatacttggtgatggtgaatgaagcccttagtttttcacttcttcgtgccttaataaaatcttcgaggcaagcccaaaccagcagggctgcagcattatcagcaatgagaatggatcttaaggtcaacagtcatgctataaaactcaacatgaagacatcattaacaggctgaagactgtgagtcttaaagtcctgaagtaggcaggttttaggaggtggaatcagcgtcctctgggtggaacaggtggaggaggatggaaggtctccctggtcggaggcctaaaatgaaagataaggcaactctatttaaaaactaatttgattaaacagttcttaggaatgcacaatttgttgcaaacttggtatactatgcaaaggacacaatcctcaatgagacaggacacacatatgaatgtatgagtgacacgcatgctagctgtggcttgcaatcctggcggcacattagaaacaccagtggagcttttaaaaataccaattccaaggatccatcccagacccatcgcattctaagctctagaggataggactcaagccacaaagcttttgaatagtttccctccccaaacagctgtcctcaccaatcctttcattatctgatgttttgccatcttggggccttgctgaccctggagagactgcccctcccagggtaagctaaaattcctagaaacagcaaacaagctacttgccttccagtgctaaatatacctttcgtatgcaaaccaaccagtccagatgcatgccccaaccacctcctctatggggctttcacactccactttatggggccaccatccacttgcccttatcaccctagggccaggtaccagacgactagagtcagcccttatgcctcagagccaatgaaattattcaaactagccaattctaaatcttacccaggctcacctgttttgtcccatggaaaccacaataaaagctcttgtccacattttcccctgctcctctgcctcctcactggccctgatgcttccccatgtagccccctatgggttgatgtacccctgttttgggatctgtgagtataacaaactatcttttcagtggcagttgtctcctgagctgttgactttgccatacctacataataataaaacctaggttttaaaacaccagcaattctaatagccacttgggagacacactgtagtagggagatttgttgagagaggaattggaatttccaaagcctgcttctcatgactgcttcctcatgagataactgttatctcaactgttatcccaactctgcatctgccttcctagaaacttccctccatgttattctgtatggtttttgaacagtcttaaatgacattccagttagactagggtgagtctatttacagacaggttcaaggattacagatggcatttccacgtgtgtactgtaaaaccaatatttaattcccttggaagcaagtcaataagtcaagaaaaagagctttgttaggtgctataattgaactgtgccaccctggagttgcatacttgaggattgattgaatcaaagagtaaatatgtactaaatgtctcttgaatgcaaggtttgtataggtcaaggaaatgacaactgagttgggaaaagaggggctgcctcaggagcaagagagggaggcaggagcagaaaataagaatcacagacaaccttgggaggtcctgccctagtcccaggattagatggttttgtatggttgtcactgagtgactgagctttataccatgaaaaaaaaaaggatggcctccttctatctcttcagcctgccctgtgagtttggggttataggagaaagccaaagggcatgataccacttttacctgagcaaatttagcctgcccacctctctgccttctttttttctttctttctttctttccttccttccttccttccttccttccttccttccttccttccttccttccttccttctttccttccctccctccctccctccctctctctctctctctctctctttctttctttctttctttcaacaaacactaatttactttatatccactcctgggtatgggatataacagcaagtaaagtggtcatggattaggccctcaagatgatgcaagtgtgtggatgagacggacaataggcaaaaaatcagtaaactctacagagcaatttggtaagggaggttcagaacctataggaacatatagcatagacatttatgcatatatctctgtgtgtgcaagttcaacgcctctgcaattgttttctcatctgccaaacagaggtactgatccctacgttggagtaccatgtgaggcttggagatgacagtaggaaagtaggtagcagtttctggcttggagtaggcacacaacaagtaaagctaataatgagataatgacgattaaagatctattctgaaatctgttccccaggtatgccccatgagccttacattttatcttctatcacaaagacaaccatgatttcctcccagcccctcttccgctttctgctgccacactgtgcagttggggtgggcctatgggcataccctctctaggtttcattctgaggaacaactccagctaaagattggaagctacatctcaaggaaacttatttataattgcagacctataattatagtgggttttttttgtttttttgttgtttttttttttttttttgagacatggactcactctgtcatccaggctggaatgcaatggcgcaatcacagcttactacagcctcaaactcccaggctcaagcaatttgcccacctcagcctctcgagtacctgagactacaggcacacaccaccacacctggctaattttttttgtttgtttgttttgtagagatgggattttgccaagttgcccaggctggtctcaaactcctgagctcaaggaatccctccctccctgcctcagcctcctaaagtgctgggattacaggcatgagccactgtgcctggccaagagtgtgaagtttctttcactcatctataacccccctgcatacggtggtagatgacttgatggctactttttttaagagctccggaagtccaacccaaacagtaccaatctatccttccatccattcacttaacacagtgagtaccttttaagttcctagtatgtgccacttactctgccaggcactagggataggagaaaaaaaattaaaagtcaaaaatggtgtctcacaggttcgccattcattgaggagacacatctacacaagggtcgcaacacagagtgtattattagagtatagaatataatagaagtgcttgggaaaccaaaagaagattcactcgcatgggaacattagggagggcttcacagaggaggtgatgtttgaactgagtcctaaaggatgtataggaattttctaagcaagagtagaagggagtaggaagacagcattccaggcaaaaggaacagattgggcaaagaaacagtacagagtggcagagctcactgggaatgctgaagtggcagatcatcggtgaatacaggagaggggcaggacttgagctaggcagagccaaagaatgctgaaatacacagaattaaacgtgaaggcttttatgccaggcaatggcatcatcagctattcctgttctagaaagggcactctggctgcaatgtggaggagggagtgactggaggaagggaggtaagtgtgggccttcaagaatgaacttaggcactagcagatggaaaggagggcggatctgacagctgaaagagcagcagaacggacagagcatgaagacacactggatatgagagctgtgaggggggcagggatcaaggatgactcccaggtttggggcttggggaagggagagaatggtcccactatctcaggctgggaactcatgagaagaaggcagtttggggtagagaatggtaggtgggctgatgagttcagttttgcacaggctatgtttgagatattggtggggtccctgaatgaagatccccagtcaactgcaggaaagagaaggctgagatggagatggagacttggggtctttgtctgctggtggcaattcaagctctgggatagcatgtagagtgagcagaggcaaggaccagaaccgggatggagtgggatggaggctgtactaccagtgctgtttggtttgggccaggggttagcagggaggttagaacacgggcagagaagagatgctgatgcccagatctgacagtggagtctaggacaccaaggccagccttcaatcctgtctataagcaggtcaaacattgaagtcattctggagagagtcccattttattatctgctcaaatatccccgtattttattgtgaacattgcatactcacacatcttttttcacaccaaaaatgcacccaaaccccaagttctatcaattacaaactgcttcgtaaacattgtttctttagcaaaaaatgttttcctccttttctctccccatctctatcacaacttgcttccagactccccaaacaactcaaccaccatctctttttacacatttacatgcttcctagtttctatcctttaatttttggaacctgtttccccggttgtcttctctttctcttctgttaacaaaatcccaccgaaaccttgtagctaaagttttaaacttgacaactcttttatcttggtacaattagacaactgcttccaaagtcctcaccttcaggaataaaaggccttggatcttgaacctcctcccctaatactgagactttcttggagaggtataaaacaatgcctatgagatgaagtctggcaggtttgccacacacagcaagtctcagcccaatctcaagccccagtttctacatctgcaaaatgggataacactaaatacctacgtcttaggattgtggagagaattaaacaggataatgcatttagtatgtttaacggaatacctgccacatagtaagtctcaataaataacagcatttatcaccatcactgctcttggtaagccctccaatcaccaactatgtgataattttcaagcaacagagcacagtgcaaattcaggggatgggactagattactgctaagcttccttccaggactaatattctaatccgtgccttccagtctacaccaggaaagcatgcccggtgggtgtggcacagcctgggcctgggcgatgtttgagtagcaagtgccaacacacaaatgttgctgggagcgcatgagaaagtgataaatagcaaagggagaaatggaaagatccttagcacagagccagcctctctttccagaacaccagaagaaagacctccttgttgcactttctcaacaaattccactgatgagcttcatctaaaagtttcaaaatgcaaaaatcaaaacaaaaccctggttgaagaaaagcttcctccttccttatgccccattaacacatgaacattttattttaaacatcgaagagttaactcctcagacaagccttggcttttattcccaagggctcctttctgcatctgtggacacacagctagctgtgaccactttttccgttactccacaagactgaaccataaaaaggttcctaccagaggcccaagtatcatataaacaaaggcatacatcaaaatctagtaaattagtcaaattctttagtctaatgctcatctccaaatctctagatattaactcctctcctgtataaaaaaaaagatcacttatattgctgagttctcactataggccaagaactcaatgcttatgattctgcagaaagttctgttattatcctcattttatagacaaggaaattgaggctgggcatggtggctcatgtctgtaatcccagcactttgggaggctgaggcgagcagattacctgaagtcaggagttcgaggccagcctagtcaaaatggcgaaaccctgtctctactaaaaacacaaaaattagccaggcgtggtggcaggtacctgtaatcccagctactcggaaggctgaggcaggagaatcacttgaacccaggaggcggaggttgcagtgagccgagatcacaccactgcactccagcctgggtaacagaacaagaatctatctcaaaaaaaaaaaaaaaaaaaaggaaattgaaatacatgaaagttaaatagttcttgcaagtttgcaaatagctgctggagacttgaccccaggtaggggggctctagagtcaggcttcccaccaccatacgatgtagcctgtcacctgcattttcatttccaattccttcatattttctgttccccaaaaggcactgtccctacagtccagccaagggaattagttattggagagttgaattctagccaaactgataaaaacaattttaaaagttgacatttttcaatgtatttcatttatgaaacattgcatttgctatttaaagtatttgcaactaaataatgcatcacttaaattaatgaagggtccacattgaaatgtgtccaatggagtaggcatttcaattagctctgtacttattcttttttttgagacagtttctctctgtcacccaggctagagtgcagtggcatgatctcggctcactgcaacctctgcctcccgggttcaagcaattctcctgcctaagccttctgagtggctgggactacaggcgtgtgccatcatgctcggctaattttttgtatttttagtagagatggggtatcaccatgttagccaggatggtcttgatctctggaccctgtgatccgcccgccttggcctcccaaagtgctgggattacaggcatgagccactgcgcccagctctgcgcttattctttagtcatcttaggtgtttccaagtcctattctcccctaggattcagagataagggaaaaatttcatatcagttttgatgttacctctgtgaggcagctctcggaggcaccctggggggtctctcgagggacatggtgggtgtcccatccacttgtggggggcctggactgcgacttctggtaacctcagggacttcattatcctacagcaaagaagatgagaaagaaaggcgaaaactacattcagcaaccagcatagctggacaaccgtaactcaaaagccccttggtcctccttaggctggggctgaaggttgtttgcaaattgataatcaacccagccatacctggcagctttccatttcttcctgaagtcactgaggcactgaggaagacaatctggccccaatgatcattaattgcctgaattctaattccttgctactcaaagtgtgctctgtggccggtcagcatcagcatcaggtggaagcttattagaaatgcccacccaaggactcttctcagaaggcttcagagttggcagtgacccatgtggcccctcctgcttgtcccagccactggtccctggatcaagctagacacatgtcccaaattgggccaacttggaatggggcctcaacctaaagcagcaacttactccctgctcggaggcctagtggactcaggggactgtggagaagcagaaggcagaggtgtgaggggaaagaaagcggatgtgcacagagaagcagagaccaaagagcttttgggcctgggatacacagaacagtgaccccggctccctctggcaggtcctgcagctcctaatccagacccagagcacggcccctaaccctggatcccctgagactcacctgctccttcccacagatgccccttaaggtttcactagtaagagtggatttccagctgtctatttccttccttcctttctttccttcttttctatttattgaggtgaagttaacataaacttaaccattttaaagtggacaattcagtggcattgagtgtatttacaatgttgtgcagcctctatctagtcttaaaacgttttcatcaccccaaaaagaaaccctgtgtgatggtgaatactgactatcaacttgattggattgaaggatgcaaagtattgatcctgggtgtgtctgtgagggtgttgccaaaggagattaacatttgagtcagtgggctggggaaggcagacccacccttaatctgcgtgggcaccatctagtcagctgccagccaatataaagcaggaagaaaaacgtgaaaagcagagactggcttagcctcccagcctacatctttctcccatgctgcatgcttcctgccctcaaacactggactccaagttctccagttttggggactcagactggcttccttgctcctcagcttgcaggtggcctcttgtgggactctgtgattgtgtgagttaatactacttaatacacacacacacacacacacacacacacacacacacacaccacatatatatatatgttctgtccctctagagaaccctaatacacctgtccccattaagcagtttcttcccattcctcctccctccagccgctggcaaccaccaatcttcaaactgtctctgtggatttgcccactctggcatttcatataaatggaatcctataatatatgaccttttgtgcctggctcctttcacctgggtttctatctcttgcgatgaaacgacccctaggacaggataggtggggtggagtcccagctctcacctcgttgtccccttccatcccgctgctcacactgaggaggctccgggtgctggagcggttacttgtgctacctaaagggtagaaagaaaatcagccggattgaggattctttcaggctaaaataaaatagagaactctagaacttatttagttttattgatataaataatacataagctgtaagtatggggttcttcaaactttggccatcttatactttttgttttcttagagacaaggtcttgctggagtgcagtggcatgatcacagctcatggtagcctcaaactcctggacacaaaagatcctcctgccttagccccctaagtagctgggactacaggtgtgtgccaccacacctagccaattttttttttttttttttttttttttttttttttgtagcaacaggatctcactctgttgcacaggctggtcttcaactcttgggctcaagcgatcctcctgcctcagcctctcaaagtgctagaattacaagtgtgaaccactatgtccagccttctaccattttattagagttcagtttttctttcagcatgaaacaaaattattcactttttgatgactaactttggcattactgctaccattgactgagggctttgaaaatgtgattgccatttaacccctatgaaaatcctgtttgatattagtgctccaatttgaaggacaagacagcaaaggtattctgattctcagctcttcagtggtatttctaaaatctgcaaactaactttgttgctgcagttttttgcttaggaattctagcaaacaggtatgtatcacccatgcagacacgccttgtaataaggggccggaccctttgacacaaaacaaaatgcaaagtacacactcaaaagtataattttttttttccccgagactgagttttgctttgttacccaggctggagtgcagtggcacgatctcggctcagtgcaacctccacctcccaggttcaatggattctcctgcctcagcctcccaagtagctgggactacaggcacgtgccaccacgcctggctaatttttgtatttttagtagagacagcatttcatcatgttggccaggctggtctcaaactcctgacctcatgatccgtccacctcggcctcccaaagagctgggattacaggtgtgagctaccatgccgggccctcagaagtataatttatgttcatggtcagaattgtgactgtgagtttaggcactcaaggcttttcagttgggaatttatcacctgtatcattagattagcatcatccaatagaactttcagggcatcttttactgtgtgttatccaatatggtagcaagtgggaaacatggctagtgcaaccaaggaaatgaattttaaattttatttagttgtaattaacttaaaaatgtaaataaccacgtgtggccagtggctaccataactggacagcacagcattagaagaaagcccaggacatggtgatctagcagagaagaagaaaaaataagagttaatcaacaaaaataaggagatcttaactttaattttccaatattctcactaacaacatagtcaagatcttaggtttgctgaatttccacttcaaatagctcctggtcatgtaagtttataggtagtcaaaaaatagttttgactgcattctggtatcaactttgaccgaattaatttagatgttagcttgaatagagcaggttaagattctaattttgaattcttttttggggacagatttttaaataaaataatacgtcaaaatgtttctataatccaggggatgcagaaattgtttattaaggaacatgagccgggtgcggtggctcacgcctgtaatccctacactttgggaggctgaggcgggtggatcacgaggtcagcagtttaagaccagcctggccaagatggtgaaaccccgtatctactaaaaatacaaaaattagctgggcgtggtcgcgggtgcctgtaattccagctacttgggacactgaggcagagaactgcttgaacccgggaggcagagattgcagtgagccgatatcatgccactgcacttcagcctgggcgacagagtgagactccgtctcaaaaacaaaaacaaaaacaaaaaggaacatgtgatcctgtctctttctactcgttacccatacacaacactgttcaaggaccaggctgtctttttctccctactcttcccagcccactcctgtccacaagtctaaaacctcctcagtctccaaggctcaggacaaatgctatcaaaacctccccacattcccccaactaaaagtagcccctcgggcccacgggcccccatccctctgtggctaagcctccccatgccattcctcattgttcatcacattcccttacgatgagccataatccttttgaaggttatctactagcaagaagtcataaagctgccacaggcaccagctccatgactccggaaactcataccaatcagttcccactgtcccttctgctggcattcttaaatcttcaaccccaatgtttggctctgaaccttggccctggccctcctcctctccaagctgatgacttacttgcccaatcccctctaggctacacagttgttaggagactctggccctagctcccatcatcttcacacttgccagggggaaggggggcagtgcccaccccttggtaggcttctaccatcaggggagaagtatcggacaagcatctaacgccatgctactcttgtactttctctcctccgttacaaggctcctaaagacaggctctggttctttttcatctttggttctctagcatacagtctagctcagtatacaaagagctatcctcagtatttggtggatcaaggagtgagagaaaaaaatgaccatataaaagtataatacgattcttaagaaacttggttacacttgaaactagcgtctgttttaaaaaagaaagaaagaaaaaagaaacttgggccagacaacctaggaggtcaacagcctttctgttttgaaatttttgttctcttaaacataacactaatatctggcgcttgaatttttagttataaccagatttaacctgcaactgtttttctgtggttcccaagagatgacagctgcaccataataaaaacagtgttttttttagggtgtgattcagggggttaaggggcagttggtggataagctgggccatcctcactctccctctctgccatgggaattatttctatttggaaggcagtacacccccacagctgaaagcacaggaagacatagatgtgaattccagaccccctgcttgcttgccaagagacttggggcaagttgcctaccctttctgctccattttcttatctagaaactcacagcactgttgtataaaatgaacccgaaaatatggtgacatgcttggcacagggcatgcaaagagaaagcatttgattaatggaagcagctatctatactattatccatttcaagatggtagactaaccaccagtgaccccctagtcaacctcccgcccaggatccacacctttgtatgctcctgccccctgccacactctagcttagccatgtgacctgctttggccaatatggcattagcaagtgtgatgcaagccaaagcttgacaggcactagcaaactggagcttttccttttggcctattccctctccagatcttgttgccatataaaaggctatgaattaaaggccacgtgtagagaggccccggaggatgagaggtttccttggatgttccagcccaagcagggcttactgctgaatgctggctcatgaatgaccccagccgatgccacagaggaaagatgaaccaccgtcccccactgagtcctgtttaagttgtaggataaggtataaatgaagggttgttttaagccactacattttggcatggtttattgcatggcaagagataacagaaactgtataacaggggccgggtgcagactacagccacaaagtagagtaaaatccattggtctgtcatttagtaacattttctaaccagatgagccagccaaccctgggcactaaaccactgcacaaggggaaaagcacagtttattcttcccatcttctcctcaccccaggctatcccccaaaaaacatatacacaaaatctattcaattactctgaacctgaaattagtgcatttctcttgttaaatttccagctgtcactctccttccccaccctgggatgcactgttctcaccctgagagggttctaccactttcctcctccacaggtctgagagacagagatagccacctgtcccttgctccttctgccacctgtgatccctgaggacatctctcccattcctgaacttgtcagaattctcaaattgcccccagtgggctttgcatacaaatgatcacccccattatgtaagaggaagttttctcctctgtccagactagacttcccaggcagtcacgtgataggctgtgggtctgttttgacaggtaatgagggcagagaaaggagctaggatctactcgcacctttgccattcactggctatgtaaccttgggcaaaattctctctctttccgggtcacaaataccccatctataaaggatgaaggaaaactagctcagaggttcttgacctaagtccatgggtgggcaaaattgtgtgtgtgtgcccacagacacatgcatacacctgtgcatgtatctgggggacacagccaaagtatgtatcagattctcaaggggctttgtgatgcagaaaagattaagaacccccagagttagataaccttcctgctccaacatgcgttatggggttctctgcccgacatttaaggagatatgagtcctgaaattcagctgctctctggctcttttattgctttcctagctgttttattagcactgaaatgtatgaaagaagagaaactcaatctatgtggcttgtgaagccaatgtgtctggagtcagctaacactgccctggatacgggaacaaagccctcggctcctgcctgatgcatcaggctgtattgtctgtgcaatcagacgactattgaagctttccagccaaaaggaaggcatttcctaattagatcctcaacctgcctgtaaagttggaatgttcaaatttgagttcattattttctttttctcttctttctttttattttacttgagtacattgttttctgatatttctgactctgtgccctttcctttgctttatcatagttgaggaagcagcaaagaatggtggctaagagccttggctctgtatccagaatgagttcaaattccggctattccacattagctatttaacctaggccagagcactaagcctcttgcttcctcctcagtaaacaaagatgacagtccctattccatagagcttcagtgagaattaaattagataatctataaagaggcttagaatatagtaaatgctcaataaatgttacctattagtattaggttttgatatttagaaaagggccagagtaataattatcacgtaactaggtttcatgggatacaaagcaaacctcatagtcaaacagtaactcggccccaccttttatacctctcaaacccaaaccaggccccactggagatctcctgggctcttaagaggatgtttcctaaggtccaagggtgccagctggagcccagtcaagaagaccccacccccgcacccccagctgctcacttgctgtgctggaggtgctgtctgttttccagtctcctcgtctcagctccgtcctagggggaatgacacttttcctggggccactctcatagactccaaactccacttttgcaggcaggtgctgtgagtgccgaattgggaccgtgatctccaagtctggaattggaggaaagagggataagctgtcaagataccagactgtcacctgccaagctgctcagcagcttccctccacctgcctctctcacaggagcctgcatgggaaggggaaggggaagggaaaagacgatgggagagggaggggccctgggttggtggccccctccccttcagcactgaaactactgaatcctgtgtggctgtcactgagagactgaagagaggaatagaataatgtgagaaagggacagagaagcgcttctgcatcagggagtggaaagaacaaaccataagagaaaggtttgggctctcagccctgccacttagcatctgtggaactccagcaagacagttctcctctctgaatcactccccttatctgaggaggggtatctccatccttgactgtaataacaggctgccctatgcaccaagcagagttctgagagctatggtatttttcattcatttaacccccacaacacccaagaaataaatattattatcatcaatgccagcagaaactaaggtacaaagaagtgatgtagcatgtcctgtcgaacagttggtaagtggcagagctgggatttgaacccaggctccggagtccaggctcttaaccactgcttgtacagcctcttgctctctgcacaaggaacggatggtgggtgggtgggtgtgggctgggtggcccacacacacagtaatgaccccgaaagctaatgaaaggaggtccttcaggcctatgaaagattttgtgacttgcaaggcccctggggtaaagagagctgatgcctttgtcgagcaaagcactgacctgacctccttactggcttaaccctacccagaggttgtctctgttcctccctacatttccaatgctgggttctaggagcagaaaacagtaactctgatgagtagaaaaaaagtctgggggcagcagcaccaacttcctcctgaaggcaagatgtgctcctgcctcaagactcccccggctgcctgggaccttctcaagcccaggggcagggtttatacagcggtggctatacaaacttgggtagaagaggtgttagctttggggacgagtgcttttatcttctggtaccacttcctcctccacctctacccttctaggggacaggcgtggcaggaagttcagagagtccaggggcagaggtggctccacctaccaaagccagaaatctggcagggtgaatggataaactggaacaggatgaaggagcagcgagaggacagggcacaccaagtcccccagaacattctgcgcagagaatgatcagagtggattgttggcttgcacaggcaccagccttcctcatctggagactccggctccaggtgtagtgtatggtccaagtgtccaaccagcttcctagggttttgtgtaatccaggtctttttcacatgctggggctctcttggctacaaccatgccatggaagcacctaccccagcttggagctacttgggcaaaaatagccaggggcactcactctcatatgggtagcccccacagtatcttagagaccaaacgagtgtcagtctttttttttttcttcctgctctgacttagatttttaaaaatcattgtttgtttgagaaggaatctcgctctgtcgccaggctggagtgcagtggcgccatcttggctcacttcaacctctgcctcctgggttcaagcaattctcctgcctcagcctcccgagtagctgggactacaggcacgcgccaccatgcccagctcatttttgcatttttagtagagacggggtttcaccatgttggccaggatggtctcaatctcttgacctcatgatccacccatctcagcctcccaaagtgctgggattaggtgtgagccactgcacccagccaaaaatcacttttttaaaagggagattccggtctgcttaattaacttcgaggaggcaattttttaacctcaactagttctataaagaaggaaagtaaaatacacaggaaaaaatagggagtcaaaagttcaaaaaatcaggtagaaccagtccgaatgtttataaaatcctgatattctttgaataaaggtacaatgctaggaatagttatcatgattatattgcatagtgctttcccaaagtgcatttatatgcattattatacctcctttaaacttcatgacttctccattaagtagataagtcaggttatagcccccagtgaggaaactgaggcacagagtggttaaaggaattggatcataaagtgattcagtgacaaagcaggaatcagaacccaagtttcctgggacccggttagctcctctacgtcctgctccacaggacacacccagaacacaaatattgattatcttctctgtgaggccatggctctcaccagcccttctctaatttcctacgccatcaacgctctgtaccagcccagtaagagcaaacaaacccctggggttggagaaaaatgggcaagttattaagaacagtcttaatttttaattctctttggcattctaacccaaattaaagattactattttttccctaaggcaaacgaagttctcaaatgaatagtcagtcattgtgtttagaatgggttacattcttagaaaagatcctttaagcacaaacattattcatcaaccctaattttcctataatgttatcgtgtgtcaataatatgtcatatttactcaaccataaatgatgccttctctttggcaaatgctgcccttcaacctcagcatgcagtacagggtccaacttctaattgcctgaggctgtttctcgtagcagaatgatgagtgcccctccccaagcaggcctccatcaaaggctgatgggggctggtgtataaatgtcccagctgtctcgttgcttaggtgggtgttctccactgattcctccctgtctcacttctccatcccctaccactttccctgggatcacctcccacaccagctatttgctctcaaatccttatcaggggagaaaagttctagaaatgcaagtggtagtgctggcacaacactgtgaatgtactttatgccactgaattgtgtgtgtgtgtatatatatatatatatatatatatatatatattttttttttttttttttttttttttttttttttgagacagagtctcgcactgtcgcccacgctggagtgcagtggtgcgatcttggctcactgcagcctccgcctcccaggttcaagcgattctcctgcctcagcctcctgagtagctgggactagaggcgcatgccaccacacccagctaatttttgtatttttggtagagacaaggttttgccatgttggccaggctgctctcgaactcctggcctcaagtgatcctcccacttcagcctcccaaagtgccgggattacaggtgtgagccactgcacccagcctgaattatgcacttaaaaatggttcaaatggtaaattttatgttaggcatattttattacaataagtaccacaaacaaggaggcccttggggctgtcaggcagaacgttctcccatatagattgcttgccgtccccggtcattcttgttttgtatcaaattatatacagtttaatctctcaatagttatgacattgattaaagcccctgatataagaagtacaaatacttaacacccctctcccgaaaatatccttgtcagagggtctgcttcttggagagtcggggatgggggctggagatgggcaaactaagccatgctcttttggaaaaatgtagacactgaccattctaatttagactgtcgctactggtgggtataaatcacttgttcagagcctgaacagccttgggtgaaccttgcataatgtttcagaacttgtgattcattctggatggccctgcctgagaggacctcagctggtgtgtgggcctctgtgtaatcatgggtgtggacacttttaggaatactcccaggtgccaggcactgtgctaagcactggttataccccaactcattcaatgctccctaatggggtgggcactttcacttttaccattttgcaaagcaggactgaggctcagggaggtgacatatctcgcccacagctcccagctagtgaggggtgagcagtgagcaggaatttgaccccaacctcgctggccccagagtccatccctgtacccctctactcctctgcatgtgcgtctgtcctgcttcagtatctccagtggcaccaggtggggagcccagatgagtggtcaggatgtgatgagacccagaaggctcaggtcttgagcccagacggctgagcacatgtgactccaacactaggactcctgggccttcaaacactgggtgcaacgccaaatcacaggtttcttgatgctgtctgtatttaaaaacctgaaatgtctcattccatcaaggcttctatctttgggcgcatggactctagttttaaaaagcatctcatctcttttatcactgagacccctattatctgaccctaggatgactgtgcagatctcgaaacagcttttctgccttctctcctttctcttcctctcaaccaggaggacagacaagtgtgaactcagccaccggcagcataaatttaaaatccagacacccaagcagaagacataggatgacctctctgaccttctgcgatggttaaaacctcttaacccctcttctcccaaaatcattaacattcactaggttagtactatcttcaaaacactgtgttaggcatggtggaacagaccctagtagggaaagccagacctgtgtgaatacaaagataactgactcattagctaccagatggtgaagctagtgtctcataggtctctgtatttggcagggtgcctggtgcttgttaagtgtggaatgaatgagtggtgtcaccaaatagtttcctgaaactgaccattccaacaaagccttctagaactccatcactgtactgttctgcacactggggactccacggagcacacagcagacaagtttttgcccatgtggagcttctagtggaagggagatggggtgttggaccataaccttgagaacagaaaccaaagatgattccagtctgtgatatgtaaaaagagaggatgccagggaacagaaagtgagtcgtggagggctactctggagagaatggcagagaaggcctctgatgaggagatgctacactgaactctgaaggatgaaaagggcctgaaggtgaagatgtggggaaaggcaggggaatggcaagtgcacaggccctgagggagaaatgctcttggcttgttagagcaataaataggagtccagggactgcagcacagggtttgggggagaatggaggatgagctcaggggtcagatcacaaagggccttgtaggctgtgagcaggaatgtgtgattttaccctgagtgggacaggagcccctggaaggctttgatcaagggcgtggcattatctgacttttaaattttttaaacatcattggctacaatgggttaactatagaggggcaagagtgaacatggggagatgactgagtgactactcccttagtctaggcaagagatgatgtggcttggctgcagcagtgccataggagatggttagaaatgaccagatttaggatacgctttggaggcagaacatctgtggactgctgatggcttggatgaaggaatgaggtgatagcaaccagagacagaaaaagagaagtgccagatgaatggaaggggtgggaggtcccacatatacttgaatgaggaaggaataccatggcctagagtggtccaggaaggtgttactgagaaggggctgccagggctgggtcttgcagcccagtagttttcatacaggtgagaaagaagaggcatggcatgagcaaggggtccacggcaggagagaatgtcccatttggacaccagggtgttaccagcccaactaggttcatgggaagtcaggcagctgatggcagctggagagagaccgtggaagctgtgcacaaacagggctagattttaacttggttcttcatgtaatagggctccattcaagatctgagtgcctctgaaagccttctcctgcatgctcctcttgctataaggctggcctcggttaatcacagaggcccactatgccagaggctctctgtgggaagatgcattgtgggtaaacgccaacttcttgctcaagggtggtgatgccacatggctggcacaggggtaggcttaaggggagcgggggcccagtccatagtgtgcaccactggaatttgtggccctgctattgcaccatggaagccctgctacacctggggcatgggcttctgaagcactgtatggtgtggatgcagatgacgccattgctcaccagaatcagaaatagacactgggtaaatgggattttctcctttctctgcttaaaaaacataagtcctcctaattgccaaggggagagtcagatgtctgcagaggaagtatcaccatcctatttgagtgaaaaggtggaagcatgcagagttgaatccacttattcacttccgggcatgtcttatgtaccaggtaccagattgtttacagaataaataagatataaccattgtccaaaaggcctttacagtctagtgggggacccagatctgtaaacagtatgacgagtgctgggcaagtggtctgcccactcaggccacagccaaaaggagagtcaaggacaacagatgacagcaatgtcccacacaatgcagcaccctaggaagccacatacctgtctgctttcctgatttttgcttctctctctgtcttcgggtgatgctgtctcttagccgtttaagattttcctggaaaaaaatttggtttattttttaagtgtacaacaggatgataccctctggacatgagagtttctttcagattgtatgctgtttgcagggtatatcacattgcagtcacatttacaacatgcaaatgaggctcagcgcattcacagtcagcccccagagaaatccaaatactcacagaatctgtgcctgaagagaagacatctcttccacaagaaagtgtctttcctcccctctggttctcagctctgttctatatgacccctctcatgtatgcctcttagcccagctcacaaatactccacaggtattcctgtctctgagactgtgttctcacatcactcccctgaccttcatggatgttggttcttctccatgagtctggatcaaggcccactttctccctgaagcctccccagatatgccaaccatccagcacttgggctatgctgctccatcatgtgtgcacactcttgtgccttgcctctttgagatactgtgagctcttcaaggtcaagagaccacgtcgtgtacctttccataatcctgccatctggcccattgtagtcattcaataaatgttgaatagacatgtaagggtcaagattgttgctattttagtcaattaacaataacgccgaagttaagtgcctgagcattctagggaaaatgtccagacaatctggctggagcagaaggttcatgttggggagtcacaggaggccaaactggaaaggggggttggtctgcagctgcaggctgaagagactcacctgtgtccaggagacagcagggaaacactgaacactgtgagcttgtcatggatttaaggttctagtgaactagagaagaaggaacagaggccagcagaccttcctggagactatggagtatgccagatgcaggcaacagaagctgacatggggatgtggctgggggaatggagagacaggagcagatgcaagaggacaaatgccgcagagcaggaccaagcaggacacaccgctgactgggtgagcggaagcacgggagaaggccaaagagactctgaggtctgatctccctctcctctgtgatgagcacagagaggctgttgggaaaggaaagcggccttgagggatggtttgttgttagacatgctgtgagcctggggcactcagggggacaaagccaactggggctggaaacatggaactggagacacagactgcacagagaaggagctgaaggaaagcttcaatgtccattgtgagagggtgacgtgaaggagacagaggagtggacagagaggcagaggaaaaggaagatgaggcctccacccaggaatgtctccacaccaccagcccctgaaggggagatgctcaggaagtggctagaggctctcagggaaccaaacaatgtgagcccccatgagctgggattctgccgtattaaatataaacccgtcgtctgctatgcccaagagttctggaccagctcatgggaagggaagaggtctcttggatagaaacacagaaagacatggcacatgtatacctatgtaaaaaacctgcacgttgtgcacatgtaccctagaacttaaagtataacaacaacaacgataacaaaaaaaccatacttggaaaggatttacctttctgcaacaatggactggtacatacaggatgatggtaatgataagacacgtaaattatgttcccactggaaacctgccctgtccaccccttctcatttcccttaaccttatcctcaaactactttagctgagaagctttccagcagactgagttagtggtggcttatacctatttatatttgtattaattgcttacagattatacctcatattagcaattaccttacactacaagaaaatgtaaaaaaaaaaaaaaagaaaaaaagaaagagagctaacatttattatgtatttactacgtaccagttatgctgcttacagtagcttatatcacctagtcctcccctttcatatgaggcacagcaaggtcaaggtcatcaaatagcagaataaagatgtaaattcaggctgccagctctagagccctggctgttcttaactactgtgccacgtggttgcacaacttggcaaggagcaaaaaaacattgtttagccagggccagccttttctcagcaggactgcagcctcccaggggctcctgagtgaaaagcacccgtgattcctgcattcagctctccagagtgccctcccacccttcaggccccaaaagggagggaggcagctggcagagcaggtgcccctgtcttaaggagcactaaaaaggcagaaggcatagtgaagggagcacaggctctggggtgagaaaggggaggtttgaaccttgactgcctcttcgcctctctgagcctcagttttctgtagaacaggaggagtaatacttatttcatatgcgtgtatgaggagtgaaagagatcaggtctatttaacgctgagcacaatgcctaacatagcactgtcggaggtcagcaaatgcggcctgatgacatgcttccccactcttcaccactaatcctgtcccagaagacaggctcctatctcagccctggacgggtgctgcttactccccgccttgacagctggtatgtcagatagcgtaagaacagagattagaatacacaccaccagggtctatagccataacaccctgaacgcgcccaatcccatctgatctctgagggtaagcagggtcgggcctggctagtactttgaaggaagcagcctggggaggtggagagagaaagcaatagttccagtcctgactcggcccctcactaggaaagatgccttggacgtgtcccttaacctcctgagccccatttcctcctttttaatacaaaggcattggtggactaagaatgagcttcctaaggttaagtttgagttctttttttgtttttaattatacatcatgtacacttatgatacaggtatggagttatatattctcataaaagcttcaaactatacaggtagagcaagagtctcctctgacaccccagtcctccaatcccagtcttctcctgagaggtggcccctggaatgggcccgaagtggccgtttccagatctttgtccttgcatttatatacatgtccatagaaatacagagtttgtgtgtggacgtgtctgagttgttttaatttgggtggttttgtatctgcaacttgttttgttcatttaatcatatttcttgggagttttccaagttctctttgagtcataaagtgtgatagttatgagggtatttggcagtaggaatagagagagagagactctgaaaagaaaaaagctggaaagcagaagcagggagccaaatgcagagagacacagcagcagagttagtgtttgtagttgagtctttgttcctgatctcaagcctcatggtacctggaaaagctacccagctctcagccagggagccatgtggttacagaccgaggtgacactcatacacactcactggttcacaatgaaactcaaacattcgcaggcacagccacaggtgtccaggtacagcaatacacaagacagccatggcccagccctcctctactgtcaagtggggaaatagacatgaaacaaattccatacgaagctagttacctgctggaaacgaaaggactccgatcgtttcttctggttgagctgccactctttgaagtggagcacagcctcatccacgttgacaatgcccagcttcacctgctcctggagggtgataagctgccgctggcctggcgttttcattcccgcaaaagggtcatatatactcgactggggcctgtccctccatggtctgacgggcggccctggaaaggatggcaaaactcagcttgacagctcccccactggggaccactcaccagaagtgtacggttaatgaggctggtcacaggctcaagaggactcttctcaaaagaacaattacatgtggccaagaagggggagatacaacataaaatcaggggagaagaatgcagctaataattccaaggcctatcacactgaagtagacaaggctgcaacatttaagggaggcgtgaaatctgctgactctcccaagtcttaactattattattatttttaacaggcttcattcatttcatttttctggtaagaaaaccgtacgttgtagccacagctggaacctgcgtcttctgcttagagactctggtgtgggtcttgagagatggtcagtgaattcctggtagggaaacttggtgaatacagtctctttccagaggtcagggatccagttgctagcagtcttagagatggcatcaaaggtggcccagggtggcagtgcggtccctggccaaggcgtagcagccatcagcagcagcttcttgggcacagaggccaagatgatgcttagtgcccctgggggcagggatgaggcacacacaccagcacagagccagtggcctgtcacgttgcaaaggctggtgtggggcttgctgatcttgttccccctgtagcctctctgtgcgggtccaatggagagcttggctgggatgatggcccgttggatggtagtggctacccccttggagtgcttaatacccagacaacatggccattgtagtcctcaaaggcaacaaacaccttgaacctggtgaaatggccagcatgggtcaacttctgtgccagcataatcttcagaaccccattcttgagagacgactccaggaaaaggtcaatgatctcagacaccttgatgggcagagagaagacagctctcccaggacttgatcttcacatctttggccagatggtttaacttagtgataggcgtcgactccttgttctcagacttacctctatgagctccagagccttggccccagccacagccacaaccttggcctgatgtcactgccaaagcctccagggaggccatcgcagcctgccattccaggacccccaggccctcccactgcatcagcatcatccaccatttggtgttttcttgaagaagcagccaagccttaattattgagacgcctttagacaagtatttctcaaccttggcactattgacattttgggccaggtaattccttactgtgtgggtgtgtcctgtgtattgtaggatgttcagcagcatccctggcttctacccattaaatgctagcagcacccccttcttgagttgtgacaaccaaaattcccttatattgccaaatgttctttagggagggggtacaaaatcacttccaattgagaaccactgctttagacttaaatccatacccagaagagaatacactggaagagtttagccaggatgcttctcttagccccactctcatccctcactgtctctaagcagcatgaggcacagtgattgtggacccatgggcatgaaatgccccaggagactggaacatcagtggaatcctgacacaggcccaacagcatcaggtataaagtaggtgctggcttccagctggctacccttgggttgttcctgtgccaacctctcttctacattacaaattcacagttctctgctttggagcttctggagaaatatgaagccaaccctcatctctctacaggctgtgacttcagttctgtggggaatgagctactcgcagcgaccatggggccactgaggcaacttgacgtttcactcaattcatacaaggctatttggatctaaatttctccagcaggactccatttgggcattgtgactcagggacataacatgaagaaaaaagagaaatggctgcaccggtgagtactgaaaaagcctcagagacgtttatctatcattctgcccaaccattcacttatctgtccgcacacacccacacatccttctcccaggtctgcccttgtcaaggctctctttaatggtattgggagacacagtggaggaaaaaacaaaatgcacaagccaaccagttccagtttcctactaccagagccctttgggggatgccttcaaatgcttagatggtgtcatggctacttttcaaaagaatcctcaatgggataatactgagtgtttctgtttagcacaaggaaattaatcaagagaaaagagcacttagctcctcaaacttcctttaaaactgtttagaaaaataagacttccaagttgttccccaatggcaagcaaaataccttttaaataaaagttgaatcaaagtatagtttagctagtatagataaggtaagtaaatagcccagaaaggctgttatcattaggtaaagactgagtgctgggccacctactttcatcctgttggcatcaacctccatttttagattgtacttttatgtgctttatggacactttccactaattaaggtcctttgtacgaccaatttgcacagcattgtaggggaccctgatctctttccctccccctttaccatcagtacaagactctcagacagtgccacactaaagtatccttggatctctctaattaattaaataatttatttaatttttatctaattaattaatttatttaattttagagacagggtctcactatgttgcccaggttggtctcaaactcctggcctcgagtgattcaccccccttagcctcccaaagtgctgggactacaggcgtgagccatgatgcctggcctagatccctctatttttcaatgtcaaggagctattgttacacttggaaatcactgacctatgaacacttcaaccacacaaaagttcagttcatataacacatggcttacctttcctgatgctctctgaggaaacgtagaaattcccaggccgctcttgacttttttctgcaaaaactatgagataaagaatattctgattactgaaaaagtatcaaaatccagtacaaaataataataataatgaatccatacctaggaccaccgtatgtggttctgtaaatcaaaattgtagaaagaggcaattaatgagaaggactaggaattgtcaagtaatggcagactaaacagacacaatctcaaactagaaaaccaaagctagccagaggacatgatcagcatttacaagctcattgaagaaaacggtaatgggaaaggacatgtgcctggacccctgagaacctgaagctagccatggaaaatgtgagccttaaaattagagaataaaaggaagtaccacttaaaatgccagctagtgccataagacagaactctaagcagtagaacagcaaaatgtgtgcacagctccaaagagattaaggtgaagtcacttacgagggacagattcatgaaggttaggagagaaaactgggacatgacaaaatctcacttagtggtaagatgacatggtgattatggctccctgggctctgaaagaggctctctgagtccaaatactagctctgtggcttgtgaaccatatgatcttggacaagtggcttgacctcttcctgtccctatttcttatctgtagaatgaggatgataatagttctttcactggttgtgatgaagattaaatgagttaatacatggaaagtgcttagaacagtgtgtggcccatgtaaacactcagtgttagcttttattataattattcatatctaaactttgagactgttgccaatagtcagcaataccttggcatgctagttaacccaagggatggctctacaatgccttacagtttgtaaagtacttccttctgtattatttcatctgaccttcgcaataaggctatggcagagtattagtatgtattattaggacatgtattaatctatacgtgtattattacaatatccattttatagatgaggaaactaaagctaaaaagggtgaaatggtccagacatggtggctcatgcccataatcccagcattttgggaggccgaggcaggaggattgcttgagcacaggagttcaagaccagcctgggcaacacagcaagaccctgtctcaaaaaaaaaaaaaagaaaggtgaaatgacttacccaatatcctatgctgaacagctggaaaatgcaagagctgagagatgaacccaggtgttctggcatccaagccattgccccttttgtcatctcctgcctctctcctttccttcgcttctccacagtttcctagcaagtccatcagggctcttgaggaatcacctgtgcccctgtccaaacacctccctacaatgagccatgccatcagtacggttccctactccctctgctatttaggaattaccagcatatatttgcatgcttcttagattgagttccctcagaagcagaacccgagacaaggattcaagtgcaagttgtctatttgagaggtgatggaggtgagacggggaagcggatggtgcaatgaatggtgggctatcaagcaagttacactgcgggcaacctaggaatgactagaacacaatgtagaatgcgcaactaagaattctcccaccggaggatgcaagtaagctggggcactcatccatacctcctgtcaggcactggttgagggcagcaactccgtgtgttaattccccagtgctttcaacctgtcctataagagggcagagaaggtgccaggtgccagaggaagccctcaggctgcaagacacagatgctgacaggtagggtccagccaatgagcacagaaatgcaaagggctagagggacatgggcaagaaaacaacagtgtctgctgctcatgccaaggagataatacccaaggagactgcaggccacaagcactgacagcacctggcagtacataatatctcacaactgtattcctacccagttcagggttgctggatttcacaaaacaaaaatgtgtgtactatttgggacatacactaaaaactcatttgccatttatttgaaattcaaagtcaactgggcatcctgcattttatctggtaaccccaacccaactacctagggctctgggtgaatgctaccttccccaatttataattcccttttgccacacctccaacaacatgatgataccattgaaaaatagaatatagttccagagcacagatctggcaattcttatttattcttttttcagacagagtcttgctctgtcgcccaagctggaatgcagtggctcaatctcggctcactgtaacctacacctcccaggctcaagcaatccttccacctcagcctcctgagtagctgggactcagtgcgggccatcacacctggataattttttgtattttttgtagagacggagttttgccatgctgctcaggccagtctcaaactcctgggatcaagcaatctgcctgcctcagcctcccaaagtactgggattacaggtatgagccacccctcctcctatttctaatactcttatagtacttgtaaccatattattgcaatcgagtcgaaaaaatagtgaaactaacaatgctatcagtatctaactaatgtcccagggatgattaagaagtcaaaaccttaatttttaataacatgggtagatggacagcctagcataatggctaaaagccagggctgtgaaatcagactccctgattttggctttgctatgcaatggttgaatgacctctgtaaaacctctatttcctcatctgtaaaatgagataataatggtccttacctaataggttattgtaaagattaaatggcgtgttccagatagagcattcttgatagatttcaataaatgttagcaattcaaatttcataataatatcaagaagggtttcaggagataaaaatatatcaggggtcttgtttacctgcctttgcaactgtgcgtaaatacttccaggaaggccagcactgactctggtcattactcctattctagctccagaatctgtcccaagatatgaccctgtctcgtagggctggttgaagaccatttagaaggggatagtctctgagcaatggttcaaaaagccaggtcatccaggaaatccctgttgagaagctccaaagacccagttggacatcattccctgccatacttgcctttaaaaatgtatggttcgttgtcaggcagctggtgagcaccaggagcagtggtctctggtctgggcactgggacagggggcctgctggccaggtccacagaaaaggcctcatcgtcatccaccgtgtgataaacatcttcttcctgaccaagatggcactgatctctctccagattggtcattcccatgctgttgcctagaaacgcagagaaaggtgactgaaagcagtggccaaacaaactgggtgatcatcagtcataaagcagagtgagggaccttactttgtttcctcagtgctgccccctggcaaaggactttccccaatatcacttcctgtatcgtctgctcagaacaccacacaaagcaactgagaaaacactcatgtcacctccattgacacccagcgatgcagtgaaaggacatgagcacaaggctttatcatctctgttttactgctgggattcagttattcatcccattagaactagggaaagtcctagatgggactaactgtcaaagccctagttaagaaaggtggggcgttcactgccaactgtccaataaaagtggtacttcttatctagggcttgaaacagactgcccaagactcccctctcagggaaacttttcattctagagttggggtcagcacacatttttttaaagatccaaatagtaaatatttcaagttttgcaggccataaagtctgttgcaggtactcaactgctcttgtgacatgaaagcagccatatataatactaaataaacggtcctgttgtgttccaataaaactttatttataagacaggcagatggccaggctgtggtttgtctaccactgctttagagttttttccttcctcttcactgtgaaaatgacttttgtccccttctgagtcccatcctcttagcactctgctttctatatctacttgatcaacagaccccaccatacattgcaaatgattggacagggttaaagaattacccacgcaatttaacatcctccacctttgaaaccttcagtaataataacaacaataataaatcttcattaactgcttgttatgtgcatggtggtgctctgagacctaatgcataataactcatttaattatcacaacatttatctcattttacaacggaggaaactgagtcccagaggacttgaataacttgcctaaggttttccagctaactggatgggaaaattgagaatagatcagagttaatcttcctaaccactatacaacacagcctcaacttagtatctttgtttatatttgcctccttcaccagcaagtaaagtctcctgagggcattgatcatatcttattttcctttgtatctccagccccaacatccagaacagtgatttgcacatagtaagtactcaataaattttggccaaataaaaacaacagatgcatttaaaaaaaactagaggcaacttgtttacccaaacaagtggctccactggttggaactcctggcccacctctaaagggctgacgggggagctcagggtagaggggtcgggggaggcagagtgcctttattcacatcacatgccatgtatgcagcagcccattccttgaggggagcaaccctcatagagaaccagacaatgtcttgcatttgtttctcttttgctcttttggcttccctgctcatggctatgacttaccttctaaaaacttgcggatcatagagtccttagtggcccgagagaaaccatctccagggattgggttagatgtactggcctgaagcatttcaacatctagaaggaaaaggagactaagagttatatattggtctcctccacaggcaaggagatttttacagatggaactatgaggtttggcaactctcttaagagattcaagcattcatcaatctatccatccctccatccatccacctactcaaggacacccagtaagtgtgaggcataaaagagagcaacgtgcccaaccctcaggctcttccttgcaccacaggtctcaaagggtaaagatatgcttatttgcatttgaaagaatgggttcaattttgacatactacatcatcccattgtttattacagaaaaaaatggaagcaggaatacattgtgttttatatatacatataaacatatatatacacacacacatatatacacatatatatatatacatatatatatatatatatgtgtatatatatatatatatatggcaaggtctcaggctggagtgcagtggctattcacaggcacaactacagcacactccagcctcgaactcctggcctcaagccatcctcccgcctcagcctcccaagtagctaggattacagaaatgcaccaccatgcctggtttacaaattgtggtctattcaaacaatggaacattatgtaacaattaaaaacaatgtactgaagctatttctatcaacatagttacttttcaaaaacataatgttgagtgaaaaagttacagacaggtgtcatggtatgatattgtttatataaggttctaaggcctacaaaaatatagtacaaattgtttatgaattcataaatatgcagtaaacacacaaatatgctgggaatgataaataatgaatttctggaagtggtttacctatggagagggagagaggataactggattccggagggggttaatagaggactataactggaaccatattatttaattttaaaaaaatctgacataaaggaataaaaaggaaatacatattcttgaagattctgatgaatctgaagattcagaatcttcaaaaaatacaatatactagataattaatatgctacccaaagggggcaaaattagattctattttcatatttgcttatatacataaaaaagaaactctgggccaggcatggtggctcacaactttaatcccaacactttgggaggccaaggcagaaggatcacttgagcctaggagttcgagtccagcctacgcaacacagtgagaccccatctctacaaaaaaaaaaaaaaaaaaagacagaaaaaattagcaaggtatagcggcacctgactgtggtcccagccacttgggatgcagaactgggaggattgcttgggccaaggaggtcaaggcagcaatgaactgtgatcatgccactgcactccagccggggcgatagagcaagaccctgtctcaataacaacaacaaccaaaaaaaaaaaaaaaaaaaaaaagaagaagaagaagaagaagaagaagaaaggaaaaaagaaaagaaaagaaaccctggaaggagatataagaaattaatatcagtggttttctgggaactgaaaagatggggataagtaatacagaaagatattccactgttcatcttcttatattttagcttttcagcctattcgaaaaaataaagaaatgcagtattctgacatgtttttgttaccttattatccaaaaaacacacaaacaaaaaacaacctccttatttctacttcttcagtttatgtctcctggcatagtggacgcgttacataaatataatgtaccttgatgtcctccagttcagggcactacgattccaaatgaggaaccagtaaatgaatcccgcccgcctgttcttgtcaccactgaattccataacagactagaaagtttagggtaattgtactaatcctgaagcatacctagagatgcattcattattttaaacatattctgataagaactcacgcctaattcattctttaaaaattcaagaccagaaaaattctacttatatgagactttcagtttaatttgcttaattgtgtttcacggaacattttcctcatggagttagaaaactggaggccgggcacagggtatcacacctgtaatcccagcactttggaaggctgaggcaggaagatcgcttgagcccagaagttcaagaccagcctggacaacacacagaaaccctgtctctattaaaaaaaaaaagaaaaaaaaattggctgggcatggtggtgcaggcctatagccccatctattcaggaggctggggtgggagaattgcttgagcccaagagatctggctgcagtgagttaggatcacgccaccgcactgcagcctgggtgacacagtgaaaccctgtctcaaaaaaagaaaagaaagatgggaaggaacacatattctacaggtgtgtgccctgctaagagcaggaccctcttctacctgaccaagactctgtactgccttccttcttcccaattcttaccccaatctccactcccacctgcctgaccttgggcccagttaatttttgaaacttcagtttgaaactcatcattaacccaacaatgaagcaccaaggaacttacccccaagggaagacatgctcgggtcagacacccctaaagatgaggggagggagaaactccacagccctgtggtccagctttatactgcccagtgctgaaccctctagaaaaccatacctgtctcaggccccagcatctccaagaaccttctccagggcatagcaacctcaggaccattttaatcactaatcaccaaatgtcccaggctgataatatcagagtgcaaacctcacacaatctgtcaaccctgttgacagagtggtaaaagcctcatgcaatggtccagctattttcactaacaacgttcaatttgagagagttgatttgcatgtcggagaggtaggtgcaaaactgaaggagctataaagagaatttagggaaataaaatgtggaggaaaatagtagaaggaagagcagtcctggctgggcctggcatgctcatatatatggatgcagacttccactttgggtactataacccctttcctaatgtgctcatttggggaggagttaaagaaagaacttaaaaagagaaaagaacaagccaggtgcagtggctcatgcctgtaatcccagcaatttgggaggccaaggcgggtggattgcttgaggtcaggagttttgagaccagcctcatggcaaaaccccatctctactaaaatacaaaaattagctgggcatggtggagcgcacctgtactcccagctactcaggaggctgaggcaggagaacagcttgaacccaggaggcggaggctgcagtgagctgggattaacactactacactccagcctgggtgacagagcaagactctgtctcaaaaaacaaaacaaaacaaaaataaaacaaaataaaataaaacagaaaagaatgagcaccagtaatgagacttaagaacatcatgactccttccaccaagaagggcatcatttctatggcattcttgacaaaaattcataacctcagcccaattatagaaaacatcagacaaactcaaactgaagagcattctacaaaataactgatcagtgctcttcaaaagtatcgagacaaggaaagactgaggaactgctgcaaaccgaaggagactgagaagaaataactaaatgcattgtaagatcctagaaaggagcacggaacagaaaaagagtatcagtggcacaactagagaaatttgaacaaggtctataatttagttagaagtattgtgccagtgtaattccctgcctttggtaattgtactatggttatgtaagatgttaatactacgggagcctgagtgaaaggtatgtaagaactctgatgtttttgcaacttttctctctaaaagtatttcaaaataattttttttttttttttacaaaaaggagaggaggaaccactatagcaaaactaaataatcatagctcctgaggatgaccccatgatcctcctttctgtctgcctacactatcaagctaagtaccttccacagacactgtggagcacatgtgtgtggatgcaatgatcgagatggtgctaaatgaaccacttgtgaaaaacaaatatttttactttacagtcacaccttaactggtggttaagagcaagattttggaagcaacaatgtaggtggctaaatatcagctctgtgacttggtagagttctttggcctccttgagcctccctgagagtgtctcacaggatgattagaagcgtgggcattaggatcgcaatgcataggttccaattgtgtttttcccacttctggctgtattgactacacatccaccagtccaacaccaaccagtatttttaggttcaatcgaacattcagactcacaagatgaccctgggacatgcttggcaccagtccactcacaaagataaaggacacaagctagcagggcagtgaagagagctggtcttcctttgagccagtccttgcatctgatcagcaactcagatgcaaagagacaagatccatagcaggccacgctggtgaaaaacctcatgtcctacaagagcaatttctctcatagcaactccagaggcggagcttccagggtcaccatgagaggtatgccagagtcaatgccctcaggaaagcccaaagaatgctgtccctttcaagtatttctagttcctgtacagatcctcccagttccagatgcaatttaccaatcaggagccatttttattgtaggcaatgttgcctggaaacatagttgacatttggctcttaccaggttaccggggtaacagagctaggaagtcaactgaaggtcaaaatcttatgcagaaagggaaattatagctattatattttctctttgcccataattatcttgggccaagtttttaaaatcctctcagcttctctctcttcttgtctgtaaaatggtgatagtaatagtacgtatctcccaggtttgtcatgagtattaaattaggaggttgccaagtgcttagcacagtatctagcacataggaagtgctgaaggaatgctagctactattattactattattattatttttattgttaaattctatacccaggctaatgtcctaaacagagaacaattcaaaaaagaggattcaatttacacttctttaaacaggacctttatttgtctgaacccaagttttctgccttcaaagtaatgaatgcttatgagttcattgtaatatttgaatttctacacatattctcaaatacttcattattatatttagcctagtaaaaactatgcctactcaatatatttatatttgaatatacctaaagtaagggaggaatcttcagacaacaaacatcaattctttacaatagagttatttatggaaatctgactcacagacaaggctagccaggtgcattttctttatcatggcttctggacactaagtactggcttgatagagccagcaggcttcttccctccttggtgaagggtctgccactgtggtccagaccagacttggagctcccatgcccatttgccttacacttccctgacacctatcacactctttattggtggcccaaaagtgaacaccaaggggcaattccaacagctctttcacccctgctggcaccactccgtgccaccaggaccatagcgagaggccaaccttcaggacagagcctaaagccagacgatccgaggcacggctggaagaacatgatgggggcaaaggtgcagggaggagagagggggtggtctccagacacaggggaagacccgaagtcaggagtaaaggtacggacaagggctagagtcaattgaacagactgcatgcagggaacaaacttaagtcagagaaaggcagcagctgaaaccaggcaattaatagagacccaggtgatggccactgagcaaccagtgcaggtcggcatcacgatcagaagcatggactttgatatcttggagacctgggtccgagccctggctctgactcttactagctctgtgtccttgggcaagtcacttgacatcactaagtttctatatctccatctgtaaagtgaggataagtaacagtacctacctcatatgatgatcattggggccacaggagacaatgcttacaaaatgcttactaacagtgccaggcactacattttcatgggtatcattattattatattgaggcaacttagttggtatattagttttctgtggctgctatgacaaattaccatttaaaacaacttaaatttgttatcttagagttctgtggctcagaagtctgaaataggtctcactgggtcaaagtcaaggttttgtcagggctgcattcctttctggaagctatagaggaggatctgtctccttgtcctttccagactctagaggccacctgcactccttagcactaggccgtcttctgccatcttcaagcctagcaatattgggcagaaagcttagctgaactgagtcctcccactgatgccgtctctctggtctgttttctgacgccctcttccacttttaaggacctttttgattatattgggctcaccaaggtgatccaggattttctccatatcttgaagtcagctgattagcaaccttgattccatctgtaatcttaattctcctttgccatgtaacctagcatacatacagattcaggggcattattctgcctcccaagagggacccaagcatcaggcacagtcagcttgccatgaatttccttcccatactgggccagtgaaggaaagagaggacagaaattagggcacactcaagtgagtccatcatgtttacacacaaactgggtagccttgttctgatatagacattattgagtctctagatgtgcactgccttaaaagaagttacccaaaaatgatttttccatttatattataaagaaaatgatttttaaaaatctttagttgaacataaatatctttgtagaccaggaacagcagatgccatacatgggcctccgtgcccctattccattttcgtggcaaacatcactaccaatcatagcattctttctgtccttttcaacacagcacccaggcactcaatactggccaactggggccagtatttattacaggtgcgctgactcatgtctgtaatcccagcactttgggaggccaagacaggaggatcacctgacgtcaggagttcaagactagcctggccaacatggcaaaaccccatttctactaaaaatacaaaaattagctgggtgtggtggtgggcgcctgtggtcccagccacttgggaggctgaggcaggagaattgcttgaacccaggagacagaggttgcagtgagctgagattgcacgacggcactccagcctgggcaacagagcgagactccatctcaaaaaaagaaaaagaaaactaggccgggcacggtggctcacgcctgtaatcccagcactttgggaggccgaggggggtggatcatgaggtcaggagtttgagaccagcctggccaacatggtaaaaccccgtctctactaaaaacaaacaacaacaacaacaaaattagccaggcgtggtggcgtgcaccagtaatctcagctaaagagaggataggcaggaaaactgcttgaacccgggaggcagaggttgcagtgagccaagattgtgccactgcactctagtctgggtgacagagcaagactccgtctcagaaaaaataaataaataaataaaataatacaaaaattaaaaaaaattataaaagaaaaaaatactggccaactggccttggcatgtgaaattatttttaaaatgctcttttccatacctaattaggcactaagtcctggtagtagcacatattatctttgtaataacacttttttaaaaggtacctggttacctggagttaatgagtgataaaaccctctcaggctctaaatatgacaaccccacatgtacacataacccgggcatacagtgaactacacagaaaactctgttaagtgaagggagtctgtttctagacaaagagcattttgggagggaaatcagaacaaatccctgcattcctggatgctcagggcttgtacttcagatcccaagcacttaaacttcatgacttgcaaattaaaaataaaccaacatgtactgaaacctgccggtctgaggagaaagtgcaaagttctttcatttcagcaaagaaaaacaacaacaatgataaggagactctggggccacagcctccttctggaaaagccagctatagagtcacactgcactgtacttgaggagtcagccagaaagaacccactcctggaatgcaagaagcttgaacagtgagagaacacccaggcaggcacttaattaaagaatgaatcaacagcaatagtgaattctcaaagacacccatatgatactcctcctgggacacagaccacttagctgcagtggaaactccatccagattatatgctgttaatttaatagaaaaccaagtgagtatataacacagtgaaatgtcagctactgaaagactattcttctagaaaggctttcaaaccctgaaagtaggccaaaagaatttttttctccagcaagaatcttttgtggccaaaaagagagccttagagcaaggagcatcgtagccaaacatttgaagagaacctggaacacaatgggtcagtttgcctccaggtagaatggtttgactgaccatgtcagtaagaaagtctagcttttctgtaccctaaagaattaatgggatggaagaaagagggagaggaagatgtgggagagatatacaatcacacacacacacacacacacacacacacacacacacacacactctgtgatagttattttattttttgattcagggtcccactctgtcacccaggctggagtgcagtggtgcaatcacggcccactgcagccttgatttcccaggcgatcctcccacctgagcctccttaactacaggcatgcaccaccatgcctggctaatttaaaaaaaattttttagaagtgggttttcgccatgttgcccaggctgatcttgaactactatactcaagcgatctgcccactttggcctcccaaagtgctgagattacaggcatgagccaccatgcgtggcctatgatggtcaattttgggtgccaaattgactatattaggaaatacctagagtgagggtgtttccagaaaaggagcatgcgagtagaaaagatccaccctcaaggtaggcaggcatcatctaatcagctgagggccctaatagagcaaaaacagacaaaaggcaaactggtctctccccaggggctggcatacactgccatacactcttctactcctggttggacatcaaactccaggctctccaccctttggactacaggacatacactagctgctctccccttgggttctcaggctttcgagctcagactgagagttacacaatcagcttcctggttctgaggcctttgggctacgtactttggacttctgagttgatgctggaacgagttaagagttttggggcaactggaatggaatgaatgtattttgcatgtgagaaggacacaaattttggaggctaggagcagagtgccatgatttgaatgtgtgccccaaaatttcatgtgttggaaacttaatccctccatcctcatgaatggattaatgttgctatcgtgagagtgggtttgttatcacaggagtagctttgttgtaatagcaagacctctctggctctcctgctcttgcccttttgccatgtgaatactttccacaatgttatgatgcacaagatgccagcaccatgctcttggacttcccagcctccagaattgtgagctaaataaacttattttctttacaaattacccagtccatggtgttctgttatggcaacagaaaacggactaagacacacacacagacacacacacacacagacacacacacacacacacacacacacgaatagcagtgtaaaattagagggctaatgagtgatggctggcattggcaatgaagaaggggctgcggataaatagtttaggagaagctgcaaacaagttctgtggttttcttatgcagacaaatgcctcagtacagtacccctggcaagcacaaagaccctctgccatgcaggagtgagtctatgggatgcatttgtggtgctgtgcagtgagtcgcacgcggtagcccacctgaacacagtcccacctgcattctcaaagcagtgtctttttcctccacagcactgtcacagtttgtggttatatattcagttatgtggtgtttttgtttaatattcagctctctcactagaatgtaagctttgaaaggcaagtttcatgccagcttgtttactgactcatcatcacctggcacagcgtgatttaaacacatgagaggtttgaaaaatatttttgaatgaatgaatgaacgaactaataaaggaaaaacaaatgaacacatgaatatgaaggcatttgggctttgtgaaggaatctgggcatttctcaagccgagaaaagagaaaggcaatttaggcagaaggaagagtcaaatgcaagggaacatgaaagaaaaggcagcttgtagtgaccaatggagttactgccaccctgagatgtctcacactcggggacacctaacagatgtctcagtaccacctatcaggtgggtgaggtctttacactggaatactgacacactattccacccacaaagtcgagaattacatcttattttctggtagctcaaattcaagaaatcgctgaacacctattgtgtacagcactgggataggcactgtggatgatacaaagctgtaagacatgcttcctatcgaggccaggagagggtaaccagagaagcacgtatataactagagcccaaggggatgtgtgtgcagtgtcccaaggtaagcgtgacctgcaagctgtgcaggttcagaggggagcaaggttgctgctgtcgatggggattttatctttaaatgttaaaacattcaatccagtgtgctttcactaagtccctatgtccccaacatagttcttgtatttatggaggagcaaaaagcaacaggaagtcaagaggtacactgagctcatctccctgctccccagtgggttctgtccttgcaggtaagaactcatgctgtgcacccaggcccacgggccttgaagcatctcttggctctactcgccagaatcttgccaaaagggatggcaggaggatgacagagcctcagcagtcacagggagggaggctcctgagagaaaaggatgcagataggagagacagtatgtttcataagcaaaccagtaatgtagtcattttgcatacaaattgtccttcagttggtttcagacctacagggctgggctgtgaggtcctttacagtccccaagtgtgcccccagctcagatggaacccagcttgcagagaggggctgtaatcagagagctcaggtaaagaaaacactgctggaaatgatctgttacaaagatgccagttaccagggaggttgctaagggaagctggcaagttagctagagctaagtcagctctccactacataaacacttgagctacagaaccatgaggtagggatcaggggttcagaagaaaagttcaatgtaggggtaacatgaagcagaacagtcctctgggattgattagtgagtctgcagtttctaacggcaagatgataatgcctttctcttttcgctcctttcgctttatggaagaaaaatgaggctctcgggtattgaagcaaagctacaacccacaaagcagattaccctggaaacagactggacaagggcctcccagaactgcccccccaaggccattctacccagagcctcagagaagtgaccagtcactgggcaagctttcaacacaaaattaattacctaggtccagggaccaccaggactaccatatcattctccaaggtaagggcaggggacaaagaactaagtgagaaaaagatgaggagatagtgaaaacacccacggacatttgccttgagttttatttaatgtttgcataagcttgtccttaataaagacattttatctcttacataataaggtgtgaaggttgatgctttaaatatgtggggtcttttttttttaatttttgagacagggtcccattttgttaccaggctggaatgcagtggtgcagtcatggctcactgcagccttgaacgcccaggctcaagcgattctcccaccagagcctcctgagtagctgggaccacaggcatgtgccaccacgccctgctaatttaaaaaaaaaaatttttgtagaaacgagatcttgctatgctgcccaggctggtctcgaactcctgggttcaagcaatcctcccgcctcagcctccctaaatgctgggattacgggcatgagccaccatgcccggctgatctgtggggccttgatcaaaaaattcttaagagaattgggagcaaagctgaaggtttgataacaagacacgtagttaccacctggtggcagcatatctaaactaaagacttgtgagtgtgccgtgtgtgtgtgtgtgtgtgtgtgtgtgtgtgtgtgtgtgcgtgtgcatgtatacacccacgcaagcaagttcaggggaagaagagattggagcagaattgtacaatctcagggtcagaacccaacacctctctccagccccatttcaattaacactgggagcttcccctataagcttccaactcaggtggttgccttggattctctttggagaagcaacctcattaccacccctttcccaaactcaagtcagaaagatttgtcccaacaacagttaggtgatctccaaagcagtgatctgaaagtggcctaaagcctgccaccctaaagcctgtttgtcctgtgagcgaatcagtgagtgagcaagtgagtgaatgaacacagcctaatttccttaatatggttattttcagcctccagggttaccacagtcaatggtggggcactgataaacgtggcaatctagacatttagaaatagctcctgtgtaagtgtccctctcagggctgacaaatgcagaccctagaagggcaggccaggagagccctacattccagtgggacagcagacagatttgcctcctgggaattcgaagacacagattcctgatccagtcctcccttgatgggacttaagtaagttactaaatcttggagccttagttttctttcctgtgaaatggagatcatcctattcactaaaccctgggatggtcagatgagatcacggggatacaggcagtccatggacttttaaagggctgccagatgttccaagttattattctgctgggcggtgctgcaaatacgcattttagatttagcagtttgtcctttatcctacttctttatgaattaagctgccttgtcacctacagagccactgttagtaaaataaattattcctccccaggtccaagttgctgctgcttctgagccaggaggtaagcgatcattctcaaggttaaacttgacgccacagagacagaaacacaaaccaaaccatgtctagagttagaaaattcagagttcacataactggggaaatgaaaaatgtgggccgggcatggtgcctcacgcctgtaatcccggcactttgggaggccaaagcagacggattgcttgagctcacaagttcaagaccagcctgggtaacatcacaaaatcccatctatatgaaaaatacaaaaaattaactgggcatggtggttcacacctgtagtcccagtaactcgggaggcttaggtaggaggatggcttgagctggggaggcagtggttacagggagctgagattgtgccactgcactccagcctgagcaatagagccagatgttgtctcaaaaaaaaaaaaaaaaaacagaaagaaagaaagaaaaaaagagaaagaaagaaagaaagaaaggtagaaagaaagaaaaaaaggaaggaaaagaaaagaaaaagaaaagaaagaaaaatgtggtgggtttccttttcccatgcaaaaagtagccaaatttgacaggctgcctccccgctggtagcctccttccagctacacggcatccagaagccccctggcccgggtgacttcacaagttgccagttggctacaaaccaggctagctccagagcacactgctgccttgggaagccctggtaaacctcactgatcctgctgtgaggggcccagcagaccaggaataatggaagagacacctgtggcattccctgcaggtttccagtgctgtggtgggagcatggcatgtgttagaacatccagggggacagcaagtgtaaggctctgtcaacactaaactgccaataaagtagggcattctttaattgtccagtagtttcatagcaaagacacagggcagaaaggatgatgcagtctccagattcaagtgggtactggtggttctccaagtgttcttttgtgagtgagtccctattccacaatggaaaggactgggtcctacccacttccccgcctgtatctccaacacccagaagacatcagtaaccgaaatgtactagatgctccagacatgcttattaggtatatggataggatgatgggcaaggctagggggcgccagaggctgctttgttatccaatatctggagctgcagataggggaagaaaggctatagaggctagatggtttttccaaaaggaaccacgactaaaatgcatggtgttggataacaatttctgcagaatatggtcctaatgacagagaaatctggattcaaatctgggctctatcactgattggctgtgacactttgggaatgttcagcccctctgtgcctctgtttccccatttgtaaagtgcaggtaagaaaagcatcttagtggggtagctttcggacttcaggtccgaaatcaagggtgtggatggtagcgatggtgctttctctccccacatccatgccaaggcacagctcattctggaagagcttccaccagcacttctaagcctcccagttaggtgacggagaggagcttttattgctctttcccctaaaggagcacccaatctgaatggcaaacacctaacaacctctggaccacatcttgcaggttctggggtcagtgtcaaaggcctgctggcatcagagactgcctctggccctctgaccaacctatgccttctctccaaggcatcctgttggtgcctgctcttccatgagttcatggatgggaaagtcaggcccgcctccctgtgggcccagggccctactgtcttcttttcaggctgaaggcttgtaacactcaatatagcccattccagaaattcccccatccataatgctgataccttggttgatacttctcttccttgaatctattaatgaaaaccagagggaaggagggctaagtctccggtggtgcctccgcatgcttagcatttggtagcgaatgatggtaacacatgaataagcctcttagagggcctgctgtgtgggtctcctgcttcaactccagtacgtgcgtggagatcagatccactgttacccagatcagcggttctcaagggtggtggcactgccccctgggggcgtttggaaaatctatgagggtattttgggtggtcaccaaggagatggcatttaggaaaagggggaaggaccctagacatcctgctatgtgtgggacagccctgcccaatgaagagatgtttcatgtccctcgtgactttcaaatatttccctagacatacacataagttttaaaaagtacgtatgatacatatttatacctatgtgtatatttctacatatctgtgtatatgtacaagtatgtctgtatttttaaatttaatgtcagcagatataagcaaaaatatagacaaatatacctcattttattactaattattaccaatgccatattggctgggagtcacaagtcacagaacttctctcaactcagttaaagattcctattttgttttgagtttaggtgttggaggggaacttctactgctcattcacttttgtcaaaaggcattacttttgcattggaaaaaacaagataataaaaagtgggcaaagtttgttagacagtttataagaaaaatcatgatcctgaagaatgatattttgaaaataagcttactatatattaatgcaataaaatcaaattacccctcgccccccaaaaaatctgcttattattttctgagcctagaacctaaactgtttcacatataaacacatcttatttttgcaaacacttaattttttagaaattcaatttctatgaaaatggaaaggaaatcataaagagttgttcaccatctaggaaaatccaggtgccaatgccaacattattcccatcatttgagccaccaagactgcaaacgtgtcagtcaatgtttgaagccgttgaccgtgattctgagtgtgtctgcatctgactcttttgtcatgacttctggtgcaggcatgtttgagtatgtcctcttctttaatttctctttcctatttcaattagggcagtatatttgatttctgagaattttatatgtaggtaggttatataatacataaacctcatgtcagagtaggaaaatgtttgttataaaaaggacccctggagactgagggctgagagccactgatttggcctctcagatcacgaggcaatgagttcatcaattctgacttccagatatttgcttaaactctcccagcagtcataacagaggaagtttggagaagaattctgcttgtcacagcacatgactccagccctagctttgtgtaaaacaggaccttcatctctctggggtgaagtgagggtacatagggactgccccgcgccatcttcatccggaatgaaaaaagctgtttctcagcagaaaggtggaagcagaactgggttgtgctacttacagaggtcttcagtggcagctgggacaaaggcagccatggactcatagagatcctcgtcacagccggggttgagcgagcatttcataagcaggtctgtggaaaggtgggccatggactcgtacacagcatcagcctcctccccgtgcatcagttcctctttaatgtgactcttgagcatgtccaccgtttcctgaaagagaagatgaggcccacggcgccctgaggcagcctgactttccgggtggaacttggcccccgaaggcacttgtggccagcaaagtaaaggctcccatgagtcaggattacaactggttgtgtgtatttgtattttcccacctgactgaacgctccttgaggccaggcttcccaccttttttagtttatttcacgtttttgttttaatcttcgtatcttcctacaacactaagcacagagttaggcactcaggaaatactcgttaaatgtccactgaccagaggatacaaattaaaaattactttcccatggcctgatgtggtggctcacacctgtaatcccaggactttaggaggccaaggcaagtggatcacctgaggtcaggagttcgagaccagcctggccaaaatggcaaaacctcatctctactaaaaatacaaaaattagccgggcatggtggagcacgcttggaatcccagctactcgggaggccgaggcatgagaattgcttgaatccaggaggtggaggttgcagtgagccaagatcgcaccagtgcactacagcctgggcaacagagcaagactctgtctaaaaaaaaaaaaaatactttcccgtgagcaccttttaaatgtcaggtacaatgctaggtatttgcctataccctatctcctgtaatccattccactactgcttgagaaaggtataatattctctagtttacagatgagaaaaacaaagctcacaaaaatctagtatcttactcaagggcttgcaatcctgatttctgatacttcttctacaccctagtggttcctccaaagggaaaaaaatgacacaagaaggtgtgacctttactgactagccacgcagaaattcaaatgagctgaacaggaatgcagctaaggtgttctcgccctgtgtgtagtcagaggtcactccgcagcttggcacactagcccctgttccttcagcagtctcctccaaactgtcaggaaccctgacagtttccaggggttccagcctcgattttatgtcctatgtgcccaaaaggagagatgatcttggataaagtgtcctgacatcagaaaggttctcccctgcctcccactgccatcctgcctccatgtgattgtgaagccagagaggtgacttccctgaaacctctgcacaacttttcctggtaagaaactttggtgtttcacaatccttatttcagcatcaacccacaaaaatcctcattttcaccaccactaccctaagatagctaatcttttattgacacttcgttagtttcctcacgagacccaataaaacagatgacagctgtgaaatgttggagattccagatctcacctttggttttgatgtggtgaaaaaaggaaatgggacagttctaagaggccataagcaacacaaagggacagtcttttggtcacaatgctgaagctgcatcggttgaaggtgaccacagggagaaagcaaagatggtatgacctagattgacttcggcacaaaatgaaagtgcatctttaaacatcccagttaaatacaacaggataacaagcccgggcttcagtatcaaactaggtgcaaatcctgtctctgccctgaatagtctgtggccctaagcacagtgactttgcctttctaagccgttttcctcttttgtaaagtaaggcttgcaatactgtcaacttcaaaggattgtggtggggattaaatgagataatacattttcaaatcaaatacattcaataaatactagttactactatgaacacagtaggttattaataaaaactattggcatggaaatgaaatgctacatttggtacatttgtgactttaagaaaaaactgagtaaatacacccagactgagagcaccttttagacttatttgtgtcagtgacgcccaaaaaaaaggactcacaccattttattcaaaacacttatacacctgtaaacactgggaagtcccctctgtgcctccgtgaatcactgtcttgtagattttccaacacagagcagagagttaagtttctggggagatatcaggctctgtcctgtctggaggtcgagagcaagaccgggctgtgtttattgctccctgtgaggtcacagccccatgcgagaggctgagctattctcaggtaccctctgggagtctgtgaagaaggaggaaaaccacgagggactgggatcaggaagagcagctgcttcctaggcatcagaggcaatattggggcatggaataagatgtagacgtggggtgcgatcagcctcaaagaaggacccagaagtcaatgtttgaggaggagctgagggccccaaaccagatgatcagataaactgggcatacctgcctgtcttaacatgggacccaggcagggggttagaaagagagagcgaggctgtcagcaggaggtgggccttagagttgctgccctgatgcctttccaggtgcacagctttattgaggtttctgctgaagaagaaaccaagcctaatacagttcaccggggcctgaaggcgggtgaggcagctaggagcatcccaccatggtgccctggaggcaggtgaggaggtggggggagatgatcagcctctaccttcagcagattcactctataaaggtttctgtaaattctgtgagggtgaacctcagtgcttaatagaaatgatttccttttaccttcaaaagaactctatgactcaaactatgattatcttccttctgcatattaggaaactgagagaggatacgtgacttacccaacgtcacaaggctaacaagtgttggtacaggaatttggacccaggtccatgtgactccagacctcatttcttaagcccacacatactgcccatggccagaagaggtacatgaggacatgctagagataaaatctgttcgtattttgggtgaaagggcagccatactaccacagagtgcatttccaatcctgggcccctcctgccttgaccttaccacatactcgtcgatgaactgccgcaggtccctgaagccgtgtttctcagcgatggtgttggggtagtggccatgcttgttggccacgctgtacgcctgcagggctcctgggcaggtgagcaacaaggcagtgaggttcttcagtccatacttcgcagcaaaatgcaacagggtgggcagctcttcatccctctgatctgaaaattatcaaggaaaacttaataggcagataaaaataaaggcacagggtgcccttgttcatggagatgaagctgccaagactagcatggcaacagaaagcactcagccattacttattgattgactgacctaacatctaacagcttccttcaggacaccactgaagatcatgtcctcagatgcagaggacataattttttttgttgagatggagtctcactctgtcacccaggctggagtgcagtggcgcgatcttggctcactgcaacctctgcctcccagtttcaagtgattctctcgcctcagcctctcaaatagctaggattacagctgtgcatcacgcccagctaatttttgtattttgagtagagatggggcttcaccatgttatccaggctggtctcatactcctgacctcaagtgatccacctgcctcggcctcccaaagtgctgggattacaggcatgagccaccatacccggccataacattttaattaattagcaaatctaataatgaataccctaccatcttctctaacaggactggagaatcctgagaaaaagtaccagttcaaaatgtgccgggtttgtttaaaggcttaactagcagccacacagtacaataggaatcatgttttgaacttctctgcaaagttcagagcatgtatttcttaaagctattgtttcgtgctgattaaaagaaagcagttcatcctcttagcccttattcctaatttcatgataagtacaccaagtaatcctgggtatgttccttagactttccgctgcctttagttctcaaccagaaaatacttccagactatctcaaaaggacctgggaggataagtaagatagtattcagcagggttcctatttaggagagattttgaatgttggtcttaatgcacacaagccccaccaggacgtcagttcactctctaattggtgaaaagcaaagtactccagagaggtgctgggtccccacggaccccctccacctactgacatctgaatacagcaagttaaactcaaccaagaaaatggacatgtttgtgtttgcggagctggggacaaatctcttttttcataaacgtttatttttaagcccaacaactttatagacatacatttatatacaaatgtatattttttaacatgacaaacccagccttctattccaaatatgaccttggaatgaagggtctgaaaatattcccaggatctcaaattgtcaggctatgaaatactttcttctaagccccaaacttaatagagaatagtcacatctacaaaagtgctgcaagaacattccatagtaggaaaatggggagaggcaatacgaaagagagtcccccaggagaaggcctcgaaagtcatgtaaactcacccttatggttctcttagactacagaaggatggaacgtaggcagaaggtaaccagagacttgggtcccatttgtgtagtgcaaccatggcatgaaggaacggtggtgtccacagaaacactacaataggcatcctgtccagaacaccaagcatcatccccgtgcaaggggtgtgactctctcagctcccagcatgtcacatgtgcacaagaggctgctcctccctcattaaacaactacttgtttagagcctacaaagagccagccacccaggagcagttccagccctcactgagcggacagcctagcaaagaagacagacacagctgaggagtgctaggtcaatggcacccaacatgctggtggtcggggggtgccaaagcaggtgaatggaacctactggaggtttggagaaggtcttctagggaagtgctacctaagctgctacagggaagtgagagaagttagccaggtaaacagcaaccaaggcaggaaggaaggactatctttccatgagtctaagtggcaagagacaggtgaaaaaagctcatacctcctgcagatcaaagcatagaaaagacaagagggagtgtggagagagatgagggcttgttcacaggttaagcagtttggattttatctagaaggcaactgggaacctcccctgacagtacttagcttacctgttcctcatgctatccctatgaggaataatcataacaagctccattggcttacgccaaaccaatttaaaatcactcatttcctgctcctccgtaagccaccacatgtgttttgagaagggggtaaagtattcagatttgcaattgagaagaatgaggctaaccagtcaagaatgagtccttatcacaggataggttatagagaagggacccagaagagttacagcagaaggtaaacgcgtatgttgatgggatgctgaaaccagcaggctagaatcagcccacgttggtttcctgaggtttgactgtcaacttacttgtcatcatatcttcttcttccagctggttgattccaaagaggtgcagtccgcttgcagggatattgttcttcagggattcggttagcagtttatcaagggtctctgtgttgtagggcacaattttaaaggcctgaaaacaaaagtgaagatggtcagatctgaaatccagctctcttccatcccgcagattcaagactgataagccatgagcagaaattacatgcccagaaatctcaggtttccttgtaatatccttacctgacacatgaattc

SEQ ID NO: 174 - protein, 292 aa, Homo sapiens
MMAFAPPKNTDGPKMQTKMSTWTPLNHQLLNDRVFEERRALLGKWFDKWTDSQRRRILTGLLERCSLSQQKFCCRKLQEKIPAEALDFTTKLPRVLSLYIFSFLDPRSLCRCAQVCWHWKNLAELDQLWMLKCLRFNWYINFSPTPFEQGIWKKHYIQMVKELHITKPKTPPKDGFVIADVQLVTSNSPEEKQSPLSAFRSSSSLRKKNNSGEKALPPWRSSDKHPTDIIRFNYLDNRDPMETVQQGRRKRNQMTPDFSRQSHDKKNKLQDRTRLRKAQSMMSRRNPFPLCP

SEQ ID NO: 175 - DNA, 1562 bp, Mus musculus
gggggcattcgtattgcgccgctagaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgactggcgatgcggcggcgttattcccatgacccgccgggcagcttccgggaaaccaaagtctttgggttccggggggagtatggttgcaaagctgaaacttaaaggaattgacggaagggcaccaccaggagtggagcctgcggcttaatttgactcaacacgggaaacctcacccggcccggacacggacaggattgacagattgatagctctttctcgattccgtgggtggtggtgcatggccgttcttagttggtggagcgatttgtctggttaattccgataacgaacgagactctggcatgctaactagttacgcgacccccgagcggtcggcgtcccccaacttcttagagggacaagtggcgttcagccacccgagattgagcaataacaggtctgtgatgcccttagatgtccggggctgcacgcgcgctacactgactggctcagcgtgtgcctaccctacgccggcaggcgcgggtaacccgttgaaccccattcgtgatggggatcggggattgcaattattccccatgaacgaggaattcccagtaagtgcgggtcataagcttgcgttgattaagtccctgccctttgtacacaccgcccgtcgctactaccgattggatggtttagtgaggccctcggatcggccccgccggggtcggcccacggccctggcggagcgctgagaagacggtcgaacttgactatctagaggaagtaaaagtcgtaacaaggtttccgtaggtgaacctgcggaaggatcattaacgggagactgtggaggagcggcggcgtggcccgctctccccgtcttgtgtgtgtcctcgccgggaggcgcgtgcgtcccgggtcccgtcgcccgcgtgtggagcgaggtgtctggagtgaggtgagagaaggggtgggtggggtccgtctgggaccgcctccgatctcccctccccctcccctcccctctccctcgtccggctctgacctcgccaccctaccgcggcggcggctgctcgcgggcgtcttgcctctttcccgtccggctcttccgtgtctacgaggggcggtacgtcgttacgggtttttgacccgtcccgggggcgttcggtcgtcggggcgcgcgctttgctctcccggcacccatccccgccgcggctctggcttttctacgttggctggggcggttgtcgcgtgtggggggatgtgagtgtcgcgtgtgggttcgcccgtcccgatgccacgcttttctggcctcgcgtgtcctccccgctcctgtcccgggtacctagctgtcgcgttccggcgcggaggtttaaagaccccgggggggtcgccctgccgcccccagggtcggggggaaaaaaaaaaaaaaaaaaaaaaaaaaaaaaaaaaaaaaaaaa

SEQ ID NO: 176 - protein, 984 aa, Homo sapiens
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAIVKSPIMCHEKSPSVCSPLNMTSSVCSPAGINSVSSTTASFGSFPVHSPITQGTPLTCSPNAENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKICLVCGDEASGCHYGVVTCGSCKVFFKRAVEGQHNYLCAGRNDCIIDKIRRKNCPACRLQKCLQAGMNLGARKSKKLGKLKGIHEEQPQQQQPPPPPPPPQSPEEGTTYIAPAKEPSVNTALVPQLSTISRALTPSPVMVLENIEPEIVYAGYDSSKPDTAENLLSTLNRLAGKQMIQVVKWAKVLPGFKNLPLEDQITLIQYSWMCLSSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 177 - DNA, 8352 bp, Homo sapiens
gatcagagtgggccactgccagccaacggcccccggggctcaggcggggagcagctctgtggtgtgggattgaggcgttttccaagagtgggttttcacgtttctaagatttcccaagcagacagcccgtgctgctccgatttctcgaacaaaaaagcaaaacgtgtggctgtcttgggagcaagtcgcaggactgcaagcagttgggggagaaagtccgccattttgccacttctcaaccgtccctgcaaggctggggctcagttgcgtaatggaaagtaaagccctgaactatcacactttaatcttccttcaaaaggtggtaaactatacctactgtccctcaagagaacacaagaagtgctttaagaggcggcggaaggtgatcgaattccggtgatgcgagttgttctccgtctataaatacgcctcgcccgagctgtgcggtaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagagaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcgtgttacggtgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgtgatgagggaggggaaactttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgaacactctttaatggaccagatcaggatttgagcggaagaacgaatgtaactttaaggcaggaaagacaaattttattcttcataaagtgatgagcatataataattccaggcacatggcaatagaggccctctaaataaggaataaataacctcttagacaggtgggagattatgatcagagtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctagtgagtgtatgagaccttgcagtgagtttatcagcatactcaaaatttttttcctggaatttggagggatgggaggagggggtggggcttacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaacgatggtgtcgaggtctttggtgggttgaactatgttagaaaaggccattaatttgcctgcaaattgttaacagaagggtattaaaaccacagctaagtagctctattataatacttatccagtgactaaaaccaacttaaaccagtaagtggagaaataacatgttcaagaactgtaatgctgggtgggaacatgtaacttgtagactggagaagataggcatttgagtggctgagagggcttttgggtgggaatgcaaaaattctctgctaagactttttcaggtgaacataacagacttggccaagctagcatcttagcggaagctgatctccaatgctcttcagtagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggtgtctttgctttgactactaatctgtcttcaggactctttctgtatttctccttttctctgcaggtgctagttcttggagttttggggaggtgggaggtaacagcacaatatctttgaactatatacatccttgatgtataatttgtcaggagcttgacttgattgtatattcatatttacacgagaacctaatataactgccttgtctttttcaggtaatagcctgcagctggtgttttgagaagccctactgctgaaaacttaacaattttgtgtaataaaaatggagaagctctaaattgttgtggttcttttggaataaaaaaatcttgattgggaaaaaagatgggtgttctgtgggcttgttctgttaaatctgtggtctataaacacagcacccataattacagcataatcttcaagtagggtacggactttgggggattggtgcgagggtagtgggtgagtggcctactaaaaagcccagtaacccccacaggaaaatagggaacttctttttaagtagcctcctttccactatttagtaattggctgtgagctgggctgggggagaaatggggcggggtgtgtgtgtcattggaaagctctcttttttgtttttttgagacagtctcactttgtcccccaggctggagtgtagtggcatgatctctgcaaactgcaacctccacttgtggggtccaagtggttgtcctgcttcaccctccctgtagctgggactacaggtgcacaccaccacgcctggctaatttttgtatt

SEQ ID NO: 178 - protein, 1091 aa, Homo sapiens
  misc_feature (205)..(205): Xaa can be any naturally occurring amino acid
MWQEAMRRRRYLRDRSEEAAGGGDGLPRSRDWLYESYYCMSQQHPLIVFLLLIVMGSCLALLAVFFALGLEVEDHVAFLITVPTALAIFFAIFILVCIESVFKKLLRLFSLVIWICLVAMGYLFMCFGGTVSPWDQVSFFLFIIFVVYTMLPFNMRDAIIASVLTSSSHTIVLSVCLSATPGGKEHLGLADPGQCDHFHLWEPGXTNHKHLMELALQQTYQDTCNCIKSRIKLEFEKRQQERLLLSLLPAHIAMEMKAEIIQRLQGPKAGQMENTNNFHNLYVKRHTNVSILYADIVGFTRLASDCSPGELVHMLNELFGKFDQIAKENECMRIKILGDCYYCVSGLPISLPNHAKNCVKMGLDMCEAIKKVRDATGVDINMRVGVHSGNVLCGVIGLQKWQYDVWSHDVTLANHMEAGGVPGRVHISSVTLEHLNGAYKVEEGDGDIRDPYLKQHLVKTYFVINPKGERRSPQHLFRPRHTLDGAKMRASVRMTRYLESWGAAKPFAHLHHRDSMTTENGKISTTDVPMGQHNFQNRTLRTKSQKKRFEEELNERMIQAIDGINAQKQWLKSEDIQRISLLFYNKVLEKEYRATALPAFKYYVTCACLIFFCIFIVQILVLPKTSVLGISFGAAFLLLAFILFVCFAGQLLQCSKKASPLLMWLLKSSGIIANRPWPRISLTIITTAIILMMAVFNMFFLSDSEETIPPTANTTNTSFSASNNQVAILRAQNLFFLPYFIYSCILGLISCSVFLRVNYELKMLIMMVALVGYNTILLHTHAHVLGDYSQVLFERPGIWKDLKTMGSVSLSIFFITLLVLGRQNEYYCRLDFLWKNKFKKEREEIETMENLNRVLLENVLPAHVAEHFLARSLKNEELYHQSYDCVCVMFASIPDFKEFYTESDVNKEGLECLRLLNEIIADFDDLLSKPKFSGVEKIKTIGSTYMAATGLSAVPSQEHSQEPERQYMHIGTMVEFAFALVGKLDAINKHSFNDFKLRVGINHGPVIAGVIGAQKPQYDIWGNTVNVASRMDSTGVLDKIQVTEETSLVLQTLGYTCTCRGIINVKGKGDLKTYFVNTEMSRSLSQSNVAS

SEQ ID NO: 179 - DNA, 2259 bp, Homo sapiens
ctcttgggttttttgtggcttccttcgttattggagccaggcctacacgccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgccgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccataaacaaaaaaaaaaaaaaa

SEQ ID NO: 180 - protein, 840 aa, Homo sapiens; identical to SEQ ID NO: 115

SEQ ID NO: 181 - DNA, 16571 bp, Homo sapiens
gatcacaggtctatcaccctattaaccactcacgggagctctccatgcatttggtattttcgtctggggggcatgcacgcgatagcattgcgagacgctggagccggagcaccctatgtcgcagtatctgtctttgattcctgcctcatcctattatttatcgcacctacgttcaatattacaggcgaacatacttactaaagtgtgttaattaattaatgcttgtaggacataataataacaattgaatgtctgcacagccgctttccacacagacatcataacaaaaaatttccaccaaaccccccccctccccccgcttctggccacagcacttaaacacatctctgccaaaccccaaaaacaaagaaccctaacaccagcctaaccagatttcaaattttatcttttggcggtatgcacttttaacagtcaccccccaactaacacattattttcccctcccactcccatactactaatctcatcaatacaacccccgcccatcctacccagcacacacacaccgctgctaaccccataccccgaaccaaccaaaccccaaagacaccccccacagtttatgtagcttacctcctcaaagcaatacactgaaaatgtttagacgggctcacatcaccccataaacaaataggtttggtcctagcctttctattagctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaaactacgatagcccttatgaaacttaagggtcgaaggtggatttagcagtaaactgagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaaccagagtgtagcttaacacaaagcacccaacttacacttaggagatttcaacttaacttgaccgctctgagctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaaatagggacctgtatgaatggctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttgttaagatggcagagcccggtaatcgcataaaacttaaaactttacagtcagaggttcaattcctcttcttaacaacatacccatggccaacctcctactcctcattgtacccattctaatcgcaatggcattcctaatgcttaccgaacgaaaaattctaggctatatacaactacgcaaaggccccaacgttgtaggcccctacgggctactacaacccttcgctgacgccataaaactcttcaccaaagagcccctaaaacccgccacatctaccatcaccctctacatcaccgccccgaccttagctctcaccatcgctcttctactatgaacccccctccccatacccaaccccctggtcaacctcaacctaggcctcctatttattctagccacctctagcctagccgtttactcaatcctctgatcagggtgagcatcaaactcaaactacgccctgatcggcgcactgcgagcagtagcccaaacaatctcatatgaagtcaccctagccatcattctactatcaacattactaataagtggctcctttaacctctccacccttatcacaacacaagaacacctctgattactcctgccatcatgacccttggccataatatgatttatctccacactagcagagaccaaccgaacccccttcgaccttgccgaaggggagtccgaactagtctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttgtcaccaagaccctacttctaacctccctgttcttatgaattcgaacagcatacccccgattccgctacgaccaactcatacacctcctatgaaaaaacttcctaccactcaccctagcattacttatatgatatgtctccatacccattacaatctccagcattccccctcaaacctaagaaatatgtctgataaaagagttactttgatagagtaaataataggagcttaaacccccttatttctaggactatgagaatcgaacccatccctgagaatccaaaattctccgtgccacctatcacaccccatcctaaagtaaggtcagctaaataagctatcgggcccataccccgaaaatgttggttatacccttcccgtactaattaatcccctggcccaacccgtcatctactctaccatctttgcaggcacactcatcacagcgctaagctcgcactgattttttacctgagtaggcctagaaataaacatactagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaatactaccaatcaatactcatcattaataatcataatggctatagcaataaaactaggaatagccccctttcacttctgagtcccagaggttacccaaggcacccctctgacatccggcctgcttcttctcacatgacaaaaactagcccccatctcaatcatataccaaatctctccctcactaaacgtaagccttctcctcactctctcaatcttatccatcatagcaggcagttgaggtggattaaaccaaacccagctacgcaaaatcttagcatactcctcaattacccacataggatgaataatagcagttctaccgtacaaccctaacataaccattcttaatttaactatttatattatcctaactactaccgcattcctactactcaacttaaactccagcaccacgaccctactactatctcgcacctgaaacaagctaacatgactaacacccttaattccatccaccctcctctccctaggaggcctgcccccgctaaccggctttttgcccaaatgggccattatcgaagaattcacaaaaaacaatagcctcatcatccccaccatcatagccaccatcaccctccttaacctctacttctacctacgcctaatctactccacctcaatcacactactccccatatctaacaacgtaaaaataaaatgacagtttgaacatacaaaacccaccccattcctccccacactcatcgcccttaccacgctactcctacctatctccccttttatactaataatcttatagaaatttaggttaaatacagaccaagagccttcaaagccctcagtaagttgcaatacttaatttctgtaacagctaaggactgcaaaaccccactctgcatcaactgaacgcaaatcagccactttaattaagctaagcccttactagaccaatgggacttaaacccacaaacacttagttaacagctaagcaccctaatcaactggcttcaatctacttctcccgccgccgggaaaaaaggcgggagaagccccggcaggtttgaagctgcttcttcgaatttgcaattcaatatgaaaatcacctcggagctggtaaaaagaggcctaacccctgtctttagatttacagtccaatgcttcactcagccattttacctcacccccactgatgttcgccgaccgttgactattctctacaaaccacaaagacattggaacactatacctattattcggcgcatgagctggagtcctaggcacagctctaagcctccttattcgagccgagctgggccagccaggcaaccttctaggtaacgaccacatctacaacgttatcgtcacagcccatgcatttgtaataatcttcttcatagtaatacccatcataatcggaggctttggcaactgactagttcccctaataatcggtgcccccgatatggcgtttccccgcataaacaacataagcttctgactcttacctccctctctcctactcctgctcgcatctgctatagtggaggccggagcaggaacaggttgaacagtctaccctcccttagcagggaactactcccaccctggagcctccgtagacctaaccatcttctccttacacctagcaggtgtctcctctatcttaggggccatcaatttcatcacaacaattatcaatataaaaccccctgccataacccaataccaaacgcccctcttcgtctgatccgtcctaatcacagcagtcctacttctcctatctctcccagtcctagctgctggcatcactatactactaacagaccgcaacctcaacaccaccttcttcgaccccgccggaggaggagaccccattctataccaacacctattctgatttttcggtcaccctgaagtttatattcttatcctaccaggcttcggaataatctcccatattgtaacttactactccggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgcaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgactttttcaaaaaggtattagaaaaaccatttcataactttgtcaaagttaaattataggctaaatcctatatatcttaatggcacatgcagcgcaagtaggtctacaagacgctacttcccctatcatagaagagcttatcacctttcatgatcacgccctcataatcattttccttatctgcttcctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattggccaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagagcccactgtaaagctaacttagcattaaccttttaagttaaagattaagagaaccaacacctctttacagtgaaatgccccaactaaatactaccgtatggcccaccataattacccccatactccttacactattcctcatcacccaactaaaaatattaaacacaaactaccacctacctccctcaccaaagcccataaaaataaaaaattataacaaaccctgaggaccaaaatgaacgaaaatctgttcgcttcattcattgcccccacaatcctaggcctacccgccgcagtactgatcattctatttccccctctattgatccccacctccaaatatctcatcaacaaccgactaatcaccacccaacaatgactaatcaaactaacctcaaaacaaatgataaccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaacacataatgacccaccaatcacatgcctatcatatagtaaaacccagcccatgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggtcttactcttttagtataaatagtaccgttaacttccaattaactagttttgacaacattcaaaaaagagtaataaacttcgccttaattttaataatcaacaccctcctagccttactactaataattattacattttgactaccacaactcaacggctacatagaaaaatccaccccttacgagtgcggcttcgaccctatatcccccgcccgcgtccctttctccataaaattcttcttagtagctattaccttcttattatttgatctagaaattgccctccttttacccctaccatgagccctacaaacaactaacctgccactaatagttatgtcatccctcttattaatcatcatcctagccctaagtctggcctatgagtgactacaaaaaggattagactgaaccgaattggtatatagtttaaacaaaacgaatgatttcgactcattaaattatgataatcatatttaccaaatgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacgggcttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaaccctcattcacacgagaaaacaccctcatgttcatacacctatcccccattctcctcctatccctcaaccccgacatcattaccgggttttcctcttgtaaatatagtttaaccaaaacatcagattgtgaatctgacaacagaggcttacgaccccttatttaccgagaaagctcacaagaactgctaactcatgcccccatgtctaacaacatggctttctcaacttttaaaggataacagctatccattggtcttaggccccaaaaattttggtgcaactccaaataaaagtaataaccatgcacactactataaccaccctaaccctgacttccctaattccccccatccttaccaccctcgttaaccctaacaaaaaaaactcatacccccattatgtaaaatccattgtcgcatccacctttattatcagtctcttccccacaacaatattcatgtgcctagaccaagaagttattatctcgaactgacactgagccacaacccaaacaacccagctctccctaagcttcaaactagactacttctccataatattcatccctgtagcattgttcgttacatggtccatcatagaattctcactgtgatatataaactcagacccaaacattaatcagttcttcaaatatctactcatcttcctaattaccatactaatcttagttaccgctaacaacctattccaactgttcatcggctgagagggcgtaggaattatatccttcttgctcatcagttgatgatacgcccgagcagatgccaacacagcagccattcaagcaatcctatacaaccgtatcggcgatatcggtttcatcctcgccttagcatgatttatcctacactccaactcatgagacccacaacaaatagcccttctaaacgctaatccaagcctcaccccactactaggcctcctcctagcagcagcaggcaaatcagcccaattaggtctccacccctgactcccctcagccatagaaggccccaccccagtctcagccctactccactcaagcactatagttgtagcaggaatcttcttactcatccgcttccaccccctagcagaaaatagcccactaatccaaactctaacactatgcttaggcgctatcaccactctgttcgcagcagtctgcgcccttacacaaaatgacatcaaaaaaatcgtagccttctccacttcaagtcaactaggactcataatagttacaatcggcatcaaccaaccacacctagcattcctgcacatctgtacccacgccttcttcaaagccatactatttatgtgctccgggtccatcatccacaaccttaacaatgaacaagatattcgaaaaataggaggactactcaaaaccatacctctcacttcaacctccctcaccattggcagcctagcattagcaggaatacctttcctcacaggtttctactccaaagaccacatcatcgaaaccgcaaacatatcatacacaaacgcctgagccctatctattactctcatcgctacctccctgacaagcgcctatagcactcgaataattcttctcaccctaacaggtcaacctcgcttccccacccttactaacattaacgaaaataaccccaccctactaaaccccattaaacgcctggcagccggaagcctattcgcaggatttctcattactaacaacatttcccccgcatcccccttccaaacaacaatccccctctacctaaaactcacagccctcgctgtcactttcctaggacttctaacagccctagacctcaactacctaaccaacaaacttaaaataaaatccccactatgcacattttatttctccaacatactcggattctaccctagcatcacacaccgcacaatcccctatctaggccttcttacgagccaaaacctgcccctactcctcctagacctaacctgactagaaaagctattacctaaaacaatttcacagcaccaaatctccacctccatcatcacctcaacccaaaaaggcataattaaactttacttcctctctttcttcttcccactcatcctaaccctactcctaatcacataacctattcccccgagcaatctcaattacaatatatacaccaacaaacaatgttcaaccagtaactactactaatcaacgcccataatcatacaaagcccccgcaccaataggatcctcccgaatcaaccctgacccctctccttcataaattattcagcttcctacactattaaagtttaccacaaccaccaccccatcatactctttcacccacagcaccaatcctacctccatcgctaaccccactaaaacactcaccaagacctcaacccctgacccccatgcctcaggatactcctcaatagccatcgctgtagtatatccaaagacaaccatcattccccctaaataaattaaaaaaactattaaacccatataacctcccccaaaattcagaataataacacacccgaccacaccgctaacaatcaatactaaacccccataaataggagaaggcttagaagaaaaccccacaaaccccattactaaacccacactcaacagaaacaaagcatacatcattattctcgcacggactacaaccacgaccaatgatatgaaaaaccatcgttgtatttcaactacaagaacaccaatgaccccaatacgcaaaactaaccccctaataaaattaattaaccactcattcatcgacctccccaccccatccaacatctccgcatgatgaaacttcggctcactccttggcgcctgcctgatcctccaaatcaccacaggactattcctagccatgcactactcaccagacgcctcaaccgccttttcatcaatcgcccacatcactcgagacgtaaattatggctgaatcatccgctaccttcacgccaatggcgcctcaatattctttatctgcctcttcctacacatcgggcgaggcctatattacggatcatttctctactcagaaacctgaaacatcggcattatcctcctgcttgcaactatagcaacagccttcataggctatgtcctcccgtgaggccaaatatcattctgaggggccacagtaattacaaacttactatccgccatcccatacattgggacagacctagttcaatgaatctgaggaggctactcagtagacagtcccaccctcacacgattctttacctttcacttcatcttgcccttcattattgcagccctagcagcactccacctcctattcttgcacgaaacgggatcaaacaaccccctaggaatcacctcccattccgataaaatcaccttccacccttactacacaatcaaagacgccctcggcttacttctcttccttctctccttaatgacattaacactattctcaccagacctcctaggcgacccagacaattataccctagccaaccccttaaacacccctccccacatcaagcccgaatgatatttcctattcgcctacacaattctccgatccgtccctaacaaactaggaggcgtccttgccctattactatccatcctcatcctagcaataatccccatcctccatatatccaaacaacaaagcataatatttcgcccactaagccaatcactttattgactcctagccgcagacctcctcattctaacctgaatcggaggacaaccagtaagctacccttttaccatcattggacaagtagcatccgtactatacttcacaacaatcctaatcctaataccaactatctccctaattgaaaacaaaatactcaaatgggcctgtccttgtagtataaattaatacaccagtcttgtaaaccggagatgaaaacctttttccaaggacaaatcagagaaaaagtctttaactccaccattagcacccaaagctaagattctaatttaaactattctctgttctttcatggggaagcagatttgggtaccacccaagtattgactcacccatcaacaaccgctatgtatttcgtacattactgccagccaccatgaatattgtacggtaccataaatacttgaccacctgtagtacataaaaacccaatccacatcaaaaccccctccccatgcttacaagcaagtacagcaatcaaccctcaactatcacacatcaactgcaactccaaagccacccctcacccactaggataccaacaaacctacccaccctcaacagtacatagtacataaagccatttaccgtacatagcacattacagtcaaatcccttctcgtccccatggatgacccccctcagataggggtcccttgaccaccatcctccgtgaaatcaatatcccgcacaagagtgctactctcctcgctccgggcccataacacttgggggtagctaaagtgaactgtatccgacatctggttcctacttcagggtcataaagcctaaatagcccacacgttccccttaaataagacatcacgatg

SEQ ID NO: 182 - protein, 2547 aa, Homo sapiens
MTATTRGSPVGGNDNQGQAPDGQSLPPLQQNQTSSPDSSNENSPATPPDEQGQGDAPPQLEDEEPAFPHTDLAKLDDMINRPRWVVPVLPKGELEVLLEAAIDLSKKGLDVKSEACQRFFRDGLTISFTKILTDEAVSGWKFEIHRCLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHPFDCFKASRTNASKKQREKLLELIRRLAEDDKDGVMAHRVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLVTYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLFNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGSTKYRLVGVLVHSGQASGGHYYSYIIQRNGGDGERNRWYKFDDGDVTECKMDDDEEMKNQCFGGEYMGEVFDHMMKRMSYRRQKRWWNAYIPFYERMDTIDQDDELIRYISELAITTRPHQIIMPSAIERSVRKQNVQFMHNRMQYSMEYFQFMKKLLTCNGVYLNPPPGQDHLLPEAEEITMISIQLAARFLFTTGFHTKKVVRGSASDWYDALCILLRHSKNVRFWFAHNVLFNVSNRFSEYLLECPSAEVRGAFAKLIVFIAHFSLQDGPCPSPFASPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYPYELRPYLDLLLQILLIEDSWQTHRIHNALKGIPDDRDGLFDTIQRSKNHYQKRAYQCIKCMVALFSNCPVAYQILQGNGDLKRKWTWAVEWLGDELERRPYTGNPQYTYNNWSPPVQSNETSNGYFLERSHSARMTLAKACELCPEEEPDDQDAPDEHESPPPEDAPLYPHSPGSQYQQNNHVHGQPYTGPAAHHMNNPQRTGQRAQENYEGSEEVSPPQTKDQ

SEQ ID NO: 183 - protein, 513 aa, Homo sapiens
MFADRWLFSTNHKDIGTLYLLFGAWAGVLGTALSLLIRAELGQPGNLLGNDHIYNVIVTAHAFVMIFFMVMPIMIGGFGNWLVPLMIGAPDMAFPRMNNMSFWLLPPSLLLLLASAMVEAGAGTGWTVYPPLAGNYSHPGASVDLTIFSLHLAGVSSILGAINFITTIINMKPPAMTQYQTPLFVWSVLITAVLLLLSLPVLAAGITMLLTDRNLNTTFFDPAGGGDPILYQHLFWFFGHPEVYILILPGFGMISHIVTYYSGKKEPFGYMGMVWAMMSIGFLGFIVWAHHMFTVGMDVDTRAYFTSATMIIAIPTGVKVFSWLATLHGSNMKWSAAVLWALGFIFLFTVGGLTGIVLANSSLDIVLHDTYYVVAHFHYVLSMGAVFAIMGGFIHWFPLFSGYTLDQTYAKIHFTIMFIGVNLTFFPQHFLGLSGMPRRYSDYPDAYTTWNILSSVGSFISLTAVMLMIFMIWEAFASKRKVLMVEEPSMNLEWLYGCPPPYHTFEEPVYMKS

SEQ ID NO: 184 - protein, 84 aa, Homo sapiens
MKLLYLFLAILLAIEEPVISGKRHILRCMGNSGICRASCKKNEQPYLYCRNCQSCCLQSYMRISISGKEENTDWSYEKQWPRLP

SEQ ID NO: 185 - DNA, 200622 bp, Homo sapiens
gaattcccaagccaattcctcgcgtctgtgatccacctgcaaaaaactacgattcccagaaggctttgggtccgggggcgggaagactgagctcagaaagaggtggactctaagagaaggtctttggtcgattacattgtccagagagggagtggccgcttgggcggattttgggagggatcagccttccaattggttgttattagaaagggggttggtacggcctgctggtgctggacctaggccgccgccgccggagctcaaatttcccgggccgggagcgctgggcctgccgggaaggcgctgggacggttacccagcgggccgccggcggtcgtgggcaagcttcgccatgcagagcactgacctaggcaacaaggagagcggcaagatatggcaccgcaagccgtccccggccacgcgggacgggtaaaggccgtggcgggagggcgcgggctgtggaggggatggagaccggcgaggaggggacgccgggcgtcaggcagcgttccgggttctggctctgaccttgccccgcatccctgggttggatgacctgcggtggaacagatggctccggacgccagggtccgcagagatccccttctgagttctgggagcgggggtctggtccgggacagcgcggagcaggaggaggccggtggttctcagacctgggaacttgcggcttttgctgtgtaccgggactctcctgcttttatgatcacggtatcccgctagtgtccctggcacgtagtaggtgctcagtgagtatttaacagttgcagctggagcagaactccaggaggagatgcggggtggaagagcaggacaattctgcctcttccaaaggctgcagtttatccatccttaaatccttggatgtgtttagacgcacaagcattcatcaactatttgttgagctcctactgtgtgccaagcacgcctctaagcgctggggacggcgatggaacaaaacacacttccggttctctggagtttacatatcggcgtgtatgtaggggctggggcgttcattatgcattgctggggggcttctagtacggccagcgctgcttttcattctgttcccagttacctgtcctgtttgaggctcagcctgtcttgtttccctggaagcctttgctacaaagcggtgccatttggatttcgatttctgcacgcagagtgatcttattgctcctaattccctaggatttcacggaaattgcttgagttcctgtttcagtgtgtttcttgttctagcagtgatttttcttttctttgagacggagtcttgctctgtcgcctgggctggggtgcagtggcgcgacctcggctcactgcatcctccacctcccgagttaaagcgattctcttgcctcagcctcctaagtagctgggattactggcgcgcgccactacgcccggctaatttttgtatttttagtagagacggggtttcaccatgttggccaggctggtcttgaactcctggcctcaggtgatccgcctgtctcagtctcccaacgtgcagggattacaggcctgagccaccgcgcccggcctctagtgatttttctattgatcctttggttgcttcttgacaaatcagaattttttttttctcttgagacagagtcttgctctgttgcccagggtcggatgcagtggcgcgatctcggctcactgcaacctccgcctcccgggttcaagcgattctcctgccgcagcctcctgagtagctgggattacaggcgcaccactcccggctaattttttgtatttttagtagagacggaccgtgttagccaggatggtcttgatctcctgatgtcgtgatccacccaccttggcctcccgaagtactgggattacaggcgtaagccaccgcgcctggccgacaaatcagttttaagtgcctactctgtatatccaaagtgcgatgcgagacgttttaccagcagcttgtttggttcctggttactgtcaggcctctttatcaatgccgctgcctcaactacattgaataaaaaattttctctaaagtggggattcctcaagtttttcattttcaaattctgagtttgtgtgaataccactcccacctctggtattctctaaacattctaaaagttatagcccactcgccttctctttcttgatgatacaaaatatctagatatatgtgcaagattcaaaaagtgaaagaaatgggttgattatccaaatgtcttgtttgcttcttccactaaagcatagcttatctttgtgttcgttaaaacccattgttcatgctgtttagacgggcagagagcactgacttggagtcagatgtattttgttgaagtaaatgtccgtttaccaactctgtgaccttggggaagttaatcactaaggctgtcagtggggagaatcagatttaccagacaggttgtcttacacatttggtgctcagtaaatatttgatattcttcttgtgtttgagaactgaggaactctgtcaggcaatctgtgagaatctgaaaggaagttgctctaaaataaattttttacgtgtgatttatatgaaaaatcggaggggcagaatgtcactattgtgattacatctacatggtaggattataattgagtatttgtttcttagtgtatttctatatttttcatattttgaacaatgattgtgtaattttgtagccagaacatgtaataagtgttctagaaaataagactggaggaaaaagttgtttgctctgagtttagttgccatgaaacattttgatattgcttgtcatttctgtacgtttatttttgtgtttttaattccttggggactagataaaaataagcattgttaagaattttgctatttcctttaatgagtctaaaaagccttatgtttagatacacatggagaaaatgtttaatccacttaattcaatttagtatactttaatgaaattataatgaagatagatgtttctaatataaaatccaaaaactaggcaaggtgcagtggctcacgcctgtaattccagcactttgggaggccaaggtgggaggatcacgaggtcaaaagtttgagaccagcctggccaacatggtgaaaccttgtctctactaaaaatacaaaaaattagctgggcatggtagcgtgcacctgtaatcccagctactcaggaggctgaggcaggagaatcacttgaacccaggaggtggagattgcagtgagccgagattgcaccactgcactctagcctgggtgacagagcgagactccatctcaaaaaaaaaaataaaacaaaatccaaaaatttatgaaaaatcaattaagataaaattttcatgattaaaaactattgttgcaataaagaatgggattattctgatctttgtgacgagaatatacgcacatatattattttaaggagttattttgtgctgtaagttaattttataaattttctttcaacagatacagggtatataatccttctctcaaaaagggtaactttaaacacatgtattcttgtctttcctgttatgaaaatagtatgtaatcattaaataacatgtctaaaagatagaaaagtagaaaggggaaaaaaattaaccatattgctattacctgcagacagctgctgttaatatttagctgtattcatctttttttccctatacgtatttttcttttcctttggagacagggtcttacagtgtcacccaggcaggagtgcggtggcatgatcatggctcactgaagccttgacctccccaggctctagtgataatgccacctcagactcctgagtaactgggatcacaggcacatgcaccatgcctggctaattttttgaaatttttctggagacgtgtttggttttgatttttcttctttattttttcttttaattgtgtgtatgtgtgtgtgtgtgtgtgtgtgtatcagtgtttaaaacttcaggttagaatattttcgttttcatttaagtttaatcattacatatgtgtctccagaataagattgaaaaataagctcccttactgttttatatggcagtatgattaatgtgggttttaaagaatgatttcttaaagcatttgttcattcagcaggcatattttgagtgtcttttgtgtgttgtaggccaggtgctggggtacagtaatgagcaagcagtggtcctgtccttacagaactcgcctgccagggtattcatggtagatacattagaaatggaagtaaaactcatgcacgcgtaattcactgtgaaacattccatacacaaaaacaaaatctcataccctgttgttatcacttaatcacagtttataaatctgtttatatgtgtgtttatttttttaatgtctgtccttactactaaattgtaagtgccatgaaagcagggaccatatcaattattcttagcacctggcttgttctgtgtctgacacagtgagttttcaagtatttgatgaatgaataaacagtagctattttgataatgagtagcttctgacctgtttttctgaaatcctggtaagattgattctagaggagcgggggtatagcggtagcagtaggagagggaagaatgaacagacgaaatgctttacttgccatatttttcataatatcaagtaatacgtgacatagattcaatgtttgggtttttttctttgacagaattatagtgaacattattcacaacacttccgattaccatccaaaagttttgcgatttttgaatgtggcttttgatggcacaggcgactgcttaattgctggggaccaccaaggaaatatttatgtttttgacttacatggaaacaggtaagcagataccattgatatctacgttatttaacaagttattaattcactgactgttttcgtacctgctattcattattcattcagaaagatttattaagttctattatatttcaggtaccttgcaaaatactgtcataagtgctaaaggacgaaagtgggaaaaaaacagaatgataacatggttcacattttaaagaattaaagtgctggttttaatagtatctctagtagtttccttttttttttcttaaatttaaaaatttattattgctaattttttttttttttttcttcagacggagccttgttctgtcgcccaggctggagtgcagtgggatgatctcagcttactgcaaactccgcctcccaggttccagctactgcacccagcccatagttgctagtttgtcaatttctggtacatcatgaggcaatgtagaaataacacagttttctttgcacattgttgttgtggggtgccagatctaagaattttaaagaattgattttcagctgggtgtggtggctcaggcctgtgatccagaaatttgggaggccaaggcgggcggatcgcttgaggtcaggagttcgagaccagcttggccaacgtggtgaaacactgtctctactaaaatacaaaaattagctgggtgtggaggtgcacgcctgtaatcctggctatttgggaggctgagacaagagaatcacttgaacccaggaggtggaggtttcagtgagccgagatcgtgccactgccactgcactctagcctgggcgacaaagcaagactccatctcaaaaaaaaaaagttggttttcactcttcttcctcttctcttcccttgtgaaacaatttagtccgaaagcaattaggtgggattgatggagataggtattcatgcagcggggctaagagggaaggacagctgcagcagcctagcagagaggcagagggtgtctgcatagcgaatggggcagtgatgggaagctagtttaatacagggggctttgatcaaataaatatattagggataatgagggccaagtttctcactcttagaaaagagacttacatatatggagggcagaaaactagaataaaccccatggtattgtattggaattagatatatcagtttgaacccctggttttgaatatatagagatagatatagcactaaatagaggtatgtacacatatatgtacacattccctagcttcgtacacccagagggcctgggagcaacagcatgccagcagcaatgaatatacccggtgttgagttcttgttttcaaaataccactttctactaaaaagaatcaaggatatttgcaaaaatggccaatttcagaatgcagacagggaaagtacaggatgagcctgtaacattttgtagccagaaagaaggaattgttcaaagaatgttcgggatgtgtcaaaaagacacagttgccagcttgaaggagctccctctggtcatattggagatgggtcatgcattgaataaaattgaaatctatgagttcatgttgtaaccagtatacaaacagtttagtaaggcatggatattgaatagtcacaaagtaccccccccacaaaatacttattaattatagaagaaaaaaaattatacaatgaagaagcctagcaaacactgccttaatcaaatgactaaagttaatataactagtagtggaatgaatcaaaatttgtgtgccacctgataggatgcagtgaaaagaacacggcatcatttctgtgatattcctcccaagatatataacctgaatctaatcagtgggatcatcacacaaagctaaattaaggacatctaataacaaaactgtgctgatatctctacaagggacaagatcatgcaagttgggtaaagactaaagaactcctaatctgagggggatgaaagggacatgacaaaggcatgaatctggactgatccttttgctataaagaacttattaggaaaattggcaaaatttgattggagttttaggattagatggtggtaatgtataaatgtaatttattggtgctgatggttatattgtgattatgtaggagagttttcttattatgggaaacttgatcttggtaacttaaatagttaaagaaaagatgtgacatataatttacttctctgtgattcattaggtaaaaatctgtaaatcattgtttctgccctttaccaaaaaagtaatgggcccaacttttctaccctttattcttgcttaacttacctcaccaattcctaatcttaaatcagtaccactgtctatttgctaatacttctgaaaaaaataaaaataattgttgattgatttcatgacagaataatgaacttcaacatcgaggactctttgcacttcatttgcttgtctacggttacttaacgtttcctattctccaccaagtgttgcaaacctttaccaatttccttgtctccttgcattggactctactcttattctgactgccaggcctcctgattcatgggaaaatagataccttcaagctttcctttctccttccccattgcagcctcaagtatattgtaagttcagcccacattaccttattcataaagttcagccctcattaccttattcataaaaacaggtgatcttaatttcttctagtgctaatccctatcttcgatagcctctcctgagatattgcaccataagtgttactattttgtccattcccttttcactgttggttgttggggagaagaaataatttttcctctacccttctagattctcaactggacccttgtaacaaaagatagattaacaagagaagaatgaataagttattaatatctatcatgcgtgtaacacattagaatacccagagtatccaggtattagtatgagatgttatcaacttgtgtcatgcatgtaacacgtgacagtatccaggtattgctaactcaaaaagtggcttatgctctggcttatatagcatcttcatcaaagaacaatacatttttagagaagtgacaagacaaaagaagaggaccttgagtctctaggggcagcaaattgtgggaaggcaaatatatgggaaactaatggtagttatatacatttctctggtgctattttcaggatgataaagatctaaagtcaactcctgtgatcaaccgttgtccttcctggtagagaagggaagagggacccctttgtaaatgtatgcaaatttatgtaaacttttagacaagagcagagagcttttcttttattcttttttttttttttttttttttttgagacggagtctcaccctgttgcccaggccggggtacagtggtgtgatcggctcactgtgcaacctctgcctcctggtttaagcaattcttctgcctcagcctcccaagtagctgggactacaggtatgtgccaccacgcccagctaattttttgtattttagtagagacagggtttcaccatgttggccaggatggtctcgatctcctgacctcgtgatccgcccgcctaggcctcccaaagtgttgggattagaggcgtgagccaccgcacctggctgagagcttttcttatatctgctttttctcatttacctttagctcaaagtaatccttatgccaaagtgggatgttcgggatggcatattctgccacccttcactaaaaacatttgtggctgagcagttagcagcagagctgggacttaaaaatcagacttgatcataaagcccagtatactgggctccctaaaaatcttcctaattgttcaatccattggtcacttttcagttctcattttactgaaacagtaaatactcttgtcttcccatcctgcctgaaattattttctttggcttcatggtacagcttttgctgaattttctacctctctgatcatttttcccccttattttactgactcttcttccagtgccttcccctttcatgttgtgctccccagacatctttctttggcttacttccttccatatttcaggtactcttttcgataatcacatcaccaccaagcctcaggcttcatctgccatgtaaacactgttgacttagacctacttctgctactactacctactagaaatcttctagattgggctctccaggagccactagcttgcatgtaagtcttgagcccttgaaaagtgattggtccaaattgagatatgaagcacatgtaaaattaaagtacacagtggattttgatgacttaatatgataaaaagtgtaaaatatctcaataatttttaattgattaaatattgaaatactaatgttttagacacatattgagttcataaagtatattagtctgttctcatgctaataaagacatacccgagactgggtaatttataaagaaaaagaggtttaatggactctctgttccatgtagctggggaggcctcacaatcatggcagaacgcaaaggtacttcttacgtagtggtggcaagagagaaatgaagaccaagggaaaggggtttccccgtataaaaccatcagatctcgtgagatttattcactaccatgagaacagtgtgggggaaactgcccccgtgattcaattatctcccactgggcccctcccacaacgtgggaattatgggagccacaattcaagatgagatttgggtggggacagagccaaagcgtatcatgtattatcaagattaattttacctgtttcttcttacttttctaatatggctcctagaaaaatttaaattacgtatgtagcccacgttgtatttctttcagacagcatgactctagatcagtttcacaagggccttaaacaacatgtttaaaagcaggtttattatttcctacccccaaacttattcctcttttgcctaagttcaaaagcttaattttttgtaaattaaactccagctaggtacccagtactctactgagcactcaacatgtattctttcatttagtcatcacaacagccctgtatctattcttatcttcattttacgcaagatcgggtcctgattccctcttcttcactccatgttgaatccataccgaacctctgcttggcttctgaaacctctcctatttatgctcccatatctctggctgagattttctgtagtaactttcttagtgatctcctttattccttgtccctctatccatttgccattgctgccaggatcgtcttcctaaaacacatacctgattgtgattctgctgtgctaacacttacagtggtttcctattctgataacatccaaactccttaatatggcacatagcacccttcataatctatttttggcctaaaatggtagctcatttttctgggtttcattttcttcgtctctacggactccttccacatggaatttgtaattattggaagaatttgtgatactaatgcaatgatctcttaataggttcaatcttgttcagcgaacagcacaagcttgcacagctctggcctttaatcttcgtaggaaatctgaattccttgtggcattagctgattattctattaaatgttttgatacaggtaagaagttctcctatttttcttttgaagcagagtaaaatataaactgaagaactgcaagaactttatcactctgtacagcttgagggggcagtccccatgacagccctcccttcagacactaggtgcaagctgagggtcctagaaacagcctcactttagatcagttgactacaaagtcagggtttcctgactactgtcaggtttgataatttactagaacaactcacagaactcaggaaagcactacacttaatgacagttttaatataacaaaaggatacaaagtataactagccaaaggaagagaaacatggggtggaatttgggaggcttccaaaagggaagcctccattgtcctcagggatgcattgccctctcagatgacactcccagcattggtgtgtggctggccatctgcgccaagcactgttgacgcagggagtcgacccaagctttggtgtttttggtgttttccctaccaagctgttttctctgcttacaaagatacacacaagtacatcagaatcaagtttaaaaaccaaatgtattatcagtatctcacactgataaacctgttcctcctcatgtatttattatttttttttattttttatttttttagagatagggttttgtcatgttgcccaggttggtctcgaacttctaggctgaagtgattcacctgcctcagcctcccaaagtgctgagattacaggcgtgagccaccgcccggcccctcctcatgtatttcctacctccgctaacagtatcaccatctgcttaaataactaagctggaaccactggagccttcacttctcttatatctcaggacatcaatttgatcactaatattttttgtttttctccttagtagctcttggatttgttcttttctccattgcctctttcttagttgaggccctccatatctcctgtctgaattattacagcaacatataaattagtctttcttgttcaatctcttcccctccaccagatatcctcaaagtgctctttctaaaacatagactagatatggtactcttttacataaaattacctgcaagagaaagcccaaactcactagcatcaattttgaagttattcttcatcaaagcctttgtcagccttgtctcctacatgaatgagatgttgctaacatgtcccgtcatacactttatcaactagccacaagcttccatttttgtggatattaatggaggtgcctcatataatacctaaccacccattggatcagttcatctatggtgtttatatgtaatgttacttctagacgtacagtgttttacctgggtaacaattttactttttaccacagtcaccaaggagctagttagctggatgagaggacatgaatcatcagtattttcgatctctgtgcatgcatcagggaaatatgccatcacaacttcttctgatacagcacaattatgggacttggatacctttcagagaaaaagaaagctgaatattcgccagtctgtgggtatacagaaggtcagtgagggggtacatcttggtctgttgtgcttctcgggctaatttcttggtcaacaggatgtatagatgatataagagtaatgattcactttgtccttgtagctctgtaactcagcaacaagcaaagcaaagtggccaacacaaagatgttgcctatagctacaatttataacttagtgagctcttttctaaaattatagctatgtaacttcaactgtcctaaggcgaaagttatttagttgattgcttttgttttcatttttaaccctctgacattttattatgaaaaatttgaaacatgcagtagatttgtgagaatttttgaacacgtgtacattcagtatctagattctaccattaacatgttactgtactatcctttactctactttacatggtaccatactctcttatgggtctatccatctttctttttttttttggtttttgttttgttttgttttgagacagaatctcgctctgtcacctaggctggggtgcagtggcatgatctcaacttactgtaacctctgccttacaggttcaagcgattctcctgccttagcctcccatgtagctgggactacaggcatgtaccaccatgcccagctaatttttgtatttttagtagagacagggtttcatcatgttggccaggcttgtctcaaactcctgggctcaagcaatcctcttgcctcggcctcccaaagtgctgggattacaggcataagccaccatgcccagctgtgtgtgtgttttaaagtaaactttggtcatcagcatactcccctgtgaatacttaagcctgtacttaattaactaggggtcaatatttgttgatttaaaatttatatataatgaaatatgtaagtcttaagtattcatttgttaaatttgacaaatacacacacctgtgtaacctatgcagctgtagcattacattatcccagaaaattccatcatctccctccctgggtgaccaccactcttacgttttcccaccatggactagtgttgcctattctaaaatttcatgtaaatagaactatacaataatagtttatgtaaggcttttttcactcagcataattttgtttgtttgtttgtttgagatggagtcttgctttgttgcccaggctggagtgcagtggtgtgatcttggctcactgcaagctccgcctcccaggttcacaccattctcctgcctcagcctcccaagtagctgggactacaggtgcctgccaccaggcccggctaattttttttgttgttagccaggatggtctccatctcctgaccttgtgatccacccgccttagcctcctaaagtgctgggattacaggcgtgagccaccgcgccgggccccactcagcataatgtttttgagatccatccatattatatttattagtagtttgttctttcttattgctgtttagaattccattgtgtaaatataccaccttttaaaaatccatttcttttgtttttttccaactatgtagaaacatatggtatataggcctccagttgtactcttgttctgagccccacagatgccccagtttggttctatcatttcttttaacagacaagccacataaccaacctctctgggcttccgtttcctgagcaggaaaatgggtctgtggtaaccaccttaccagggctggtgagaaaatgagataaaataaataattcatgtcaacggcttggccgagtgccaggcccttatatagtagctcccattgttattttgtcctttatgtcccctggctgtcatctcctgtgatttcctatatgacatccaaactggtctctttcatagggtttccacgctgctacccctcctccctccttaccacacccagtaaccttcccattctctccacctagtcaaatctaaccctttcttcaattgtgataatagttactgaagcatttactatgcttcaggcattgtattaagaactttccatacattatctcaactcagtcctgacactgcctcaatgaagtaggcagtgtttattgctccccaaacacaaagacacggggtctggagactggaagcactggcggctgcaagtgccagagccggcagggtgtgaagccagattggaggctttctgcagagtcaggcctcccaaatcctgggatggagtcaaggagcttttggctgtcccacccttttggtagtgccccggtcactcttcctcctccaagtccccatatccaagcctgtcatatctcttcagctctaggggcctgtctgtgacttccaccctaagggagctggcactttgtgtcatgctacattgtccacatcaccgattccccctccctctctccccttccttcttcctccctgttcttttttttttttttcctttgcaacggaatctggctctggcatccaggctggagtgcagtgacacaatgtcagctcgctacaacctctgcctcccagattcaagcgattctcgcctcagcctcctgagtacctgggattacagtcgtgcgccatgacagccaactaatttttgtattttcagtagagacggggtttcaccatgttagccaggccggtctcaaactcctggcctcaagtgatccactcgcctggtctcccaaagtgctgggattacaggtgtgagccaccatgcccagcctgggcacctgttctgtgccaggctttggtgttcaaaatgttagaagtggagaagtcagaggaagatggaattataggtctttcctcttcaaagctttctgtttggctgattttattcaaatgagcacacaggccctattcctcaaagccacttcaaatgtggcattgctaggttgttttagtccaaggaaggccgtctccttaactcccactgtcttttggttttcagggtttttttctttctatttcattagctaaatattattttcaggagtatctgagtctcttgtgtgattaattattttgcttcaggttgtattatgcatgcagtactgcttttaatttctaggttattaacatgaacagctagcaatgcatgtcaaccaaaaatttactttgtagtctccatggaaatcccagagttctttaatgtgcttttaacaattaaaaagagataaaagttgtgccagcttattcattagggatttaagccaaatgtcttttcttctttaatttaggccaaaggtcttttcttctttaattgctttagtacttacattttgaattttaagttccaaagaagagaacattgggagttgaacccacatggaaacagagttatgaaacaatgacacatgacacaaaagccatctgttctttttactatgaaattaaaatgagtatacgctgaatagttgccaacgcaaaccttgcttggacatttagacattttagtttaaaaattaggactgtggaaaatgtatgtatagtgtgatgtgtgcctaagtatattaatgttagtgctataagaataaaactaaatgtgaaaatgtatgtatagtgtgatgtgtgcatatagtaaattgctctaaaataataaaacaggaccgggtacgggggcttacgcctgtaatctcagcactttgggagtcccaggcggggggatcacctgaggtcagaagttcaagaacagcctcagcctggccaacatggtgaaacctcatctctattaaaaatacaaagattagctgggtgtggtggcacatgcctgtaatcccagctactggggaggctgaggcagaagaatcgcttgaacccgggaaacagaggttgcagtgagccgaaattgcaccattgcactccagtgtgggcaacagagcgagactcttgtctcaaaaaaaaaaaaaatacaatacaataaaatacactatagtttaagttatcagcaaatttttcttaaagggccagtaaatatttttgactttgcagttcaagagcaaaattatataaccattcagaatgtaaccatttaaagccaggtacccagctactctggaagctgaggtgggagaatcccctgagccccagaattcaagaccaagatgggcaacacagtgagacccatctcaaaaaaaaaagtgaccattcttagctcctgggctgtacaaagactagagatgggccaggtgatgaccacttcagttgtaaacaggaaataactgtaaccttaatattaaagtaaaacgttcggtttttaaaaaatttttttcccctgacacagccctcaggagagcctgagaacatgtgcccctaaaaacgttaattcttaccaaattcttactaaactcatatttttattacagattctgattctatattttaaatagaacttttatttatttgtttgttttgattgcacatgcgacccttcagtaacttgctttgggtcttttgttatggatttcatttttgatggctcttttaatctcacacagtcttctactttttttctcatgacattaattttctggagagatcagacagaccagttatctcagaaaatgccccacattctggagttgttttttctgtttcatcattattgtttaatttgtctgtctttcacctgcattttctgtaaactagacattaagtctaaaggtttgagtagattcctgttaaacatttttgacaagttatttatcttatgtatgggaaaaaatagtaaacaatacaggttgaggattcccaatttgaaaatctgaaatcccaaatgctccaaaatttgaaattttttgagtgctaacatgatactcaaatatcaagctcaaaggaaatgctcattggagcatttaagatttcagattttcggatcagggatactcaattggtgagtataatgcaaatattccaaagtccaaaaaatccaaaacatttctggttccaagcattttgcataaggaatactcagccgtagcacctccctcagggttggtttcaacattaagtgtgataatctatgcaaagttagcacagtgctggttgtatagtaagtgcttagtaaaattgcatctgttgcaattttaccatcaagcctatgataggattatctcagtgcagttagataatttgcttaagctgtagggtggcaggcacatgggctcatgcctgtaatcccaacactttaacacgcaggctgattgcttgagcccaggagtttgagaccagcctgggcaacatggctaaaccttgtccctacaaaaaatagcctggtatgctggtgtgtgcctgtagtcccagttactcaagaggctgaggcataagaatcacttgaacccaggaggcggaggttgcagtgaaccaagatcacaccactgtgctgcagcctgggcgacagagtgagctcctgtctcaaaaaaacaaaactgtggagtaactgttatttattttttagttacattatattaacaattcagaaacccaaaagtatttaaataactcagtggcaaaatgcgatctgacctcaattcatttggcagcaaaatctgaactgaattgacatgaggctgaaatattaatatatttgagtatggggcattgccccaggtctcctaaagttctacataatgttatagaatatacatcatactacctatctaaaattggaaatctgcattctgaaacacatctggccccaagggtttcagaaaaggaactatggaactttgatttcagactgtttttaaagaacctaccagtctaacctctttccgctgatttttgtaagcagtaatagcagtaattattagtaatagtaatagatacccgttatttagtatgttccatgaaccttcattttaaatagttattttaaagctttaatcctaaagggtagatattattatccccattttacaagaagggaaaccgaagttcagaaatattaagtactttgtccagaaatattaagtaatttgttcagtatcacatagtttaggagagaattgcagtttgaattcaaacctgtctttatctaaagccttactgcttctcaggtaaaccagttacacctcttcaaattagtacatttttattcttttgttgatgtttgggggtaagatattcagctcattagttaaggattttggaatccccgggatttgtgattactgtggttcagcaggtatcagaaaaggctttgtgatggatatcagaaaacatctaataaagagtgttttgctgaactcaattcagcctgtgtacccaggacactcactaaatactaaatatacaaataatacatttgaccttaacttgctaatattagtatcctaaactctttaaaccttgaaaaagggctgggcactgtggctcacacctgtaatcccagcactttgggaggccaaggcaggcggatcacttgaggtcaggagttctagaccagcctggccaacaagaccagcctggccaacatagtgaaaccccatctctactaaaatatacaaaaaattagccgggcatgttggcacatgctgtagtcccagctgcttgggaggctgaggcacgaggattgcttgggaggttgtagtgagccaagatcacgccactgcactccagcttgggtgacagagggaagactctgtctcaaaataaataaataaatcaataataaataaataaataataaggtaaaataaaccttgaaaagagttcatctacctcctaaaactgaattggaaagcttaggatttttgtgttctacaaggaaaaactacagctccgtccttgaacctaaccccccaaaaagtatactttgttaatgttttgaagtttttcctaaggtttttatgtttctcaagatatgacactatctaaataataatgacatgcttcattaggaacaattttataatcattaaaatatggcaattaaaatcacaaatctagtaatgaataatcatgtaggcaataatctatcacagttattctgctaaaatagcagttgatgctcattaacttttaagcttctgcttttcccagtaggaataaactttattacttttccagaaaaatgactgctaattataataataattttcttaagtcactttttgacatcagttttgaaacagtgttctaatgcgttcattatagattatagaaatctgtaaggccttcatattataaatcttcctaacagtgaatctaatagcaaaagatctaccacagattgtctttagcaaagtgagccaaggaagaagggaggagcttgatcaggcccttgcctgatctgtcagtatctgatgtagttgagttcgtattttttattgtcttattggcattaatcctgagtagattatttttgctaaccagtctgttctctagtgcattatatatgtgtgtgtgttgtacagatgacacacaaaattatattcaaggccactgaaacttttacgagaaaatattggttaatttccgttaataattttgcattaacaaaaggaagcattgtttatgcttatgtgatagaaaaatgaaaattaggagaataaagtgatgacattttcaactttactatcagtttcattctcagttgtccattaaatgaactgaatctgtaataagataggattatatatgcatttgcacctttttactcatataaaaaaatggcttaacacttacttatcctgaaacactttgcccagtattcccaaaggactaacttttttttcttgagatggagtttcactcttgttgcccaggctggagtgcagtggcgcaatctcagctcattgcaacctccaccctccaggttcaagtgattctcatgcctcagcctcttgagtagctgggattacaggcgtctgccaccacacccggctaatttttgtatttttagtagagacggggtttcaccatgttggccagactggtctcaaactcttgacctcaggtgatccacccacctcagcctcccaaagtgctgagattacaggtgtgagccaccgtgcctagccaggactaacttttaaaagcaaactgactaatttgggaagatatatattttaaggctgttgacacatatcatataacatctttaaataatttttactcccagcggcagtgtatgacagtgcctttttttactctatatatagtatatgtagaactatatactaatataaacactgtattaaatactaactactgatagatgtttaaaaaatatcaaatgttggtgaaagtatagggaaaagacactgtcatacactgccacggggagtaataaatacatacaccccattttgtgggagtaatatatatagacaaacaccccattttgtctatgcatgtatgtgctttctttttgaagacagagtcttgctctgtcacccaggctggaatgcagtggtgcaatcttgacttactgcaacctccacttcccaggttcaagggattcttctgcctcagcctcctgagtagctgggactacaggcacacacccggctaattttttttttttttttttttgagacgaaggctcactccctcacccaggctaaagtgcggtggcggggtcttggctcactgcaacctccacctcccaggttcaaacaattctcctgtctcagcctcccaagtagcagggactacagatgcctgccaccatgcctgagtaatttttttatttttaatagagacgaggtttcaccttgttggtcaggctagtcccaaactcctgacctcaggtgatccacccgccttggcctcccaaagtgctgggattacaggtgtgagtcactgcgcctggcctaatttttgtattttttcgtagagatagggtttcaccatgttggccaggctggtctcgaacttatgtcctcaagtgatccgcctgcttcggcctcccaaaatgctgggattacaggtgtgagccaccacacctgaccaatgtgctttattttaaaagtaaaattgatactcaaaattatatcttgttttcatttaactctttagtaatattaggtgaaattttttaaactgtcatttagaattttgtgacttgcctagtcattatagtgtacctagttttcgtttgaagggttttttttttagttaataataatttatgaaataatcagtattactccttgtcatatattagaaatgtattttccccagcttaagaaaataatattttaataaagaaaaatagactacttgtataattttaaatttaaagtctctatgtgaaccttatgtgaaaactaactttctctattcctccttaggttttctttctaccattaagtaataccatcctcagctgttttaaagataattccatttttgcctgggaatgtgacacacttttttgcaaatatcaattgccagctccacctgaaagctctagtatattatacaaagtgtttgctgtaaccaggtaatgtgcattttaagacactaggaatatttaagaaatttaatttctggtaaaaaattacaaattttcatttagtttttattcagtatctttttgtcatattagaaaaagttaccttcaaatttagatatgatctgctaactttttttattttgcaaaatatcaaatatacacaaaaatagaaaaatacatgaacccctaagaatttcttctttttttttgtttgtgtgtgtgtgttgttttatttataccagcctttcctccatcagaaccactaaatatttccataagctacaataatcatcaacgaatggccatttcttttcttttcttttttttttaaatggagtctcactctgtcacccagactggagtgtagtggcatgatctcagctcactgcaacctctgtctcccgggttcacgcgattcttctgcctcagcctcccgagtagctgggattataggcacgtgccaccatactggctaatttttgtatttttagtagagacagggtttcaccatgttggtcaggctggtctcgaactcctgaccttgtgatccgcccgcctcggcctcccagagtgctgggattacaggcatgagccaccgtgcccggccatttctatttttatcaataacttcacctacttctccaatgcattgtttgaagcaaaacctaagcatatcattttatccataaatatttcagtttatctctgaaagataagggcgcttttggaaatataaccatagtattatcacactttatttatttatttatttatttatttatttatttatttttgagacgaagtctcattcttgtcccccaggctgcagtgcaatggcactatctcagctcactgcaacctccacctcccagcttcaagcaattcttctgcctcagcctcccaagtagctgggattacaggtgcctgccaccacacctggctaatttttgtatttttagtagagacgggggtttcaccatgttggccaggctggtctcgaactcctgacctctggtgatccgcctgcctcagcctcccaaagtgctgggattacaggcgtgagccactgcacccgacctattatcacactttttaaaaattaataagaatgtcttaatattgtcatatatctagttattgttcaaacatccttgattggtctaataactggtttttatgattgatttgtttgaataagaagcaaaacaaggctcacagattgtattttgttgatatattcgtctttttttttccttatagtttattcattaaataactggtcatttctcctctagagttttctatattctggattttgctcttgtcttcatgtggtattgtttaatatgatcctctgttacctgtatttttcctgtatactggttatacctgtattttctaaaaactggaggcttgatctgatttaaggacaagaagacattataggtggtttgtgtactttcataaggaacaacatagaacagttttcttttgtgacgtcagtagccattagtgatcattccctagatctagtactgccttagaagttagcaaaatgctgctgttctaattctctcatttcttcttcacttattagttaataaccttctatagaaagaaacttcctctcatcaaccctttggttattttgatgtacagttgtaaaggaaaggcaggataaatgcttaattttcccctcttttttcttaaactagtttttgaagtaatgaattggtttattagcatctttcaaaagtggctaatgaagatttttgtcttgaatctttgtaaactcataggcttagagtagttgacaagttttaatacattgcagctgtcattcttagagatgttccaattctctcatctttgactaataggatcctcttttcgctgactttggcatccttttactacaactccagttgcctgtgatagctttcatgctttctggtatgacaagatgttccaagcttatcttgtacaattcccgccctaaccctggaatcagccatttctctaaagagtctgggttcttttttgggaaatggtatttcaagaccctaatccggatgctaggggttctcattttgactgggccaatcattgtttctagtcaggggaaagagttacaaaatagatgttaattcctctcttttctcacgctgttcttctaagtcatcagtaaataccatcaactcaaccaaaccatatagcaaattggtcaatttgtttttattcattgctgtggttattaccctaatccaagctaccctagcctcttttagactactataatagccttcttatttgttctccctgttttcaatctcatttcctatagtcattctctacacagcagataaagtggtttttataaatcagtaagtcagatcatgtcactttcctatttaacctccttcatcacttagagtaaaattcaaccccccacccctcatttcccctgaggccttctgtcacctggcctacgcctccctcgcttcatctcatttccttccttagtctgctctagccacatccgagtatagcagtgtactttcatatggcaatgcacttgagtatgacctcttacttacttttccttatatactaaccttattgctttttcagcacttttgtaccagccagtctggaatactgatcaggatagaattcttcctccaagtcatcccacgactggcctatttgtgtcattcaggtagcagatcttcctcctttcccagctttcatcaccttattttatagttctatatagaacttatcacctgctgagatcaagttcatttatttgtttgtttgccttcctctagaccagaagtcctgtaagagcaggattacttggcttgtgcagccttaactgactgtgtccatggcttctgggaccatacctggcttatagcagacacttgaaacataaccatagtattaccacactttttaaaaattagtaagtcctttacaagttcttgttgaatgagtgagcaacggccttgcaagtcaaaacaacttactctttttgtatcttattaaggtagctttctttgagcaggaaaaaagtttgggctgttttgtttttttcatatagccatgtaccaccaattctatatagctgtacgtgaaatatagaaagttggatagtgataagtgactttgagattatgctataaaatataagtgttatgtgaaaaacccacaatcaggtcattaaacaagtgtttggtaaactggtgccttagcacagtaggtaaaaaaaatatatactataaacctgagctgtccatgcaagtatttgaattaatacaaattaaataaaatttaaaaataaggtccttattaacattagccacatttcaagtgctcaataatcacatgggactagtgtgaccatattgcatagcatagacacagtacatttctgtcatcatagaaagttctgtcggacagtgctgctacaaacaattgaacccgtttttctttctcacttttttgtttatatagagatggccgaatcctggctgctggaggcaagtcaaatcatcttcatttgtggtgcttggaagctaggcagctctttagaattatccagatgcccactaaagttcgagccattcgccatctggaatttcttcctgatagttttgatgctggttctaatcaggttagtaacataaatgtagggcactgtactttttgagaaagaacgcatccgtctctgaactatattagctcttatttatttaacttacaccctggctgttacaataatttgaaattacaaatatgttatttttgtgaagagtctaggattgaaaaaaatttcaaaatcttgtattctttataccattgacaatttgctctttttataaaatcaacatactgtaaatttatattgtactttatggtttgcagtgtgctttagcatgcaatttttcatttgatccttaattctttggcataggcaggaaagatattctccccattttacagattataacactaacgaccagaaacattgactcgtcaacattcctgttaattgtaaggattaaagattggactagaactaaaatgtttttattgtgttgttattttatttatcttaactggttgctcactcctgtgaaacatgtttttattggtatctttccttagtttacagagtgcttcttccttcatcccccttcgcttattcctttttaagacttgagttctgtcaaaccttaactttcttgtttcaaatagactgtcgtggatcttgtattttaacagattagatatatgttttacatatatatgtatacatatgcatgtatgtatatatcatgtccattttacttactttttgattaggtaatatattaacatggttgaaaacataaaacagcatacagtaggaagtctgtcacgcctttctaccatttgtctagttgttcacctccccccatatccactgttgttatatatagtgttatgtttttcccattattttatacagccttgcaccttctattcttccagtttttttgttgttgttttgagatggagtctagctctgtctcccaggctggagtgcagtggtgcaatcttggctcactgcaacctccgcctcccaggctcaagtgattctcccgcctcagcctcccaagaagctggcactacaggcatgaaccaccatgcccagctaatttttgtatgtttagtagagacagggtttcaccatactggccaggctgacctcaagtgatccacctgcctcagcctcccaaagtgctgggattataggcgtgagccactgcgcccagtctaccttttattcttaagttggaaattgttctatatcagtgcagaacttctttctttttcacaactgcatagtgttgcagtttattttttaaaccagtctcctattggcagttaacctatttttagtcattttctgttacaaataatgctcactgaatgacttttcacaagtgtcatttcacacatcctctttgtaggataaaatcccagagttgaaatagtggcataaaggttatgtgcatctgtaatttgggtagatcttgcccagttgacttccagaggagttgcatcaactgcagatgaggggctttgtttcctacaagccaaccaacaggagaactttatagagtgtcacctccaaactgccttttaccatcttttgtatgataagtgacatcagcatttcaagcaatcacatggtggcatcacttaccagccactgccactgggaagagaacctgcacttagacaaggcagcatgggggtttatttgcttaaacttttttattacatttttttttgttttggtttggtttttggtttttggttttgagacggagtctcgctctgtcacccaggctggagagcagtggcatgatctcggctcactgcaagctccgcctcccaggttcacgccattctcctgcctcagcctcccgagtagctgggactataggcgcctgccaccacgcccggctaattttttgtattttttagtagagacggggtttcaccgtgttagccaggatggtcttgatctcctgacctcgtgatccgcccgtgtcggcctcccaaagtgctgggattacagatgtgagccaccatgcccagcctttattacatgttcttaatttttgaaattatgagttaaaatttaaacttttctctccccttaaaagcctagcttccctcctacccctccactacccttgcaactcacaaactctccattctccaaatgttacttaaaatatttgctgaaaacaggcagacagtggggagcctcagtgggagtgacaggtttgtgtgggggtagcagggctgttagctttgattagctatggaaagggtacaggaaggcaaaccctccaccctccttgtttctgatagccagtgtggaggcaaaagttgggaactgtctgtcttagtctgttttgtgctgctgtattggaataccacagactgggtaatttataaacaatgtaagtttatttttcacagttctggaggctgggaagtccaagatctagaggttggcatcttttgaaggcctttgttctctgtcataatatagtagaaggcctcatatgggtgagaaagggagggaggaatgggaggggacaagagggagccgaactcatccttttataccaaacccactcccacaataacagcattaatcttttcatgagggcagagccgtcatgccctaatcacctctcattaggccctatctgccaacactgttgcattgagcaagtttccaatatttgctgttggagagacgcattcaaattatatcattgtctaatcctctctgtcccctgtatatgtcatcagtgggcatgatctgcctgtgggaagggaagattcttagggcacctttccatagtctaccatgataggttccctcctggttctgattagagccagggcataatcaacatgagccataagttgtgattttaaaataggtaatatcaggccaggtgcagtggctcatgcctgtctgtaatcccagcactttcggaggccgaggcaggcagatcacctgacatcaggagttcgagagcagcctggccaacatggtgaaaccccatccctattgaaaatacaaaaattagccgggcctggtgacacatgcctgtaatcccagctactcagcagggtgaggctggagaattgcttgaacccagggggcggaggttgcagtgagtggagatcgtgccactgcactccagcctgggcaacaagagtaaaattccatctcaaaacaataataataataataataataaaataaaatatataatatctcactgagaatagaatttcctctaggtgtccctctcaaaatatatatatttatacacacatacacacatatacacacacacatacatacacaaacgttgcatacacgtaaagacgtgtatatagtaggactttcagacattgactatcacatgtttttaggaatttatattttttctctcttaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataaggtatgtatgatgaagtaatcaacatcagctttttataaacacttatatattatatcatcaagaataaaatctttatgctactatttctaacttacctggaacttatccatttttctggatatattttgttgctcttacccccaaagccacatctctggccttgatttctcacgtatgctccattcttaaattgctgccttcctgagggacatctccgtttgatgtctctcatttaggtgttactcattatctcgttcccaaaagagttctttctgcaattctctctcatgttttcttcccatctcataggctagaaaccttgaagttctatgacttcctatgcctttattttctaaatccagtcaatactaagtcatataacttgtttgtttttgttttgtttttgtttttgtttttgttttttgagacggagttttgctctcattgcccaggctggagtgcaatggtgcgatcttggctcattgcaacctctgcctcctgggttcaagtgattctcctgcctcagcctcctgagtagctgggattacaggcgcacgccaccatgccctgctaatttttgtatttttagtaaagatggggtttcacaatgttggtcaggctggtctcaaactcctgacctcatgatccacccaccttggcttcccacagtgctgggattacaggtgtgagccaccacgcccagcccaacttcttaaatttgaaatatctataaatgtgctgtctgttctccacttccataattgctatccttgtattggtcttcattaactactctggactaatggtaatttaaagaaatatcttaaactcagagccctcagtgcttgccctgcccatccttccatcttctaaaataattcatcatcatttcttaactagtgctactttagtggcttccttccttcgcctgttgaattaagtccagactcttctgcctggctctcagtgttctctctaatcttgtctacctgtctaacttatttcctcgaacttatagcttccctcattatccccatagacaccatccttatttctgcatctattatccacaccatccatttcactaaaatgcatgcctcacttctcttctctggttatctaaaattcccccagctaaccagtcatattgtccgtgtgtcttccagtctgaaattgcaccttggtagctctaacagagactttgatgatcacctggtctaaccctttcattttacacaggaagaagttcgtgctcaaaattaatcacacagcgagtaactagcagttctgggtgttccaattcttccaagatcacatgagattgggtgcatttggagtggcgtttgccacctttttttattctaaaaaaaagtttgtgcctcctcctttttgttttatcttttaaaaaattatacaagtagtgtcttattgcagaaaaaaataagaatgtacagaatagcaaacagacaaatacaaatcactgaaagtctcaccattctcagaagattctgatttatatgttcccaatttcttttctatgtgtgtaaatatatatagtcactcctcattatttgtgcattctatacatgagaattcacctgctcactaaaatttatttgtaacttcaaaattaatagttgcagtgctttcatggtcattcagggacatgcacagagcagtgaaaatttgagtcaccagataccctttttcccagctgaagtcaaatgaggcaacactctgtcttcttatttcagctctcatagtgtaaacaagtatcctttttgtgatctacttaataccatttatttttttgcattttgaagctttttgttaagattctactgcttaaagtggtccccaagcgtagcgctgaagcgctatttattgtttctaaatacaggaaggctgtggcttaccttacagagaaaatacatgtgttaaataaactcattcaggaatgagttatagtgctaagctgtgagttcaatgataaggaatcagcaatgtgtattaaataagatgtctttaaacagaaacacacatatatgtattgattgattaatgaggctctcaggaacctgactctgtgtttcccctaggagcagtgtttcagtattcactaatcgagtgttcatggtgactttatagaaccactgcaaatagtgagaattaactatacatatatgtttctgtgtgtacgcacatgtgtgtgtatgcatacttgtctctaaacatatgggattatactctgctgctgttttgctctttatgtcattatgtatactatataagtatatttttacattataatatgtgctatatattaataaatttttttaaatgtattaatatctgctcttactgagagagttttcagcctgctgaatagtcagttttacagtactagctaaaccttcttttctttttttttttgagatggagtctcactctgtcttccaggctggagtgcagtggtgtgatcttggctcactgcagcctccgcctcccgagttcaaacaattctcctgcctcagcctccctagcagctgggattacaggcgcgtgccaccacgcccagctaatttttgtacttttagtagagatggtgtttcaccatgttggccaggctgctcttgaactcctgaccttggtgatccacccgccttggcctcccaaagtgctgggattacaggcatgagccaccgtgtccagccttgcaaaccttcttaatagaggcaggcagagagctgagaaaaactatggtaagaatgagtcattgagttcctttctgcttgttatctgttgagcaaattgatatcacatgaatagaaaagctagcttggaagtagaatgatcttttttattttttgacccattcccagtaccatcagtgtctttatggctgttccaggctacattaatgttcaattctatattctctataaatcataactcacctttgtctcatttttaccagttttattttcttgtcattggagaatttctggtattgtggtaatagagtaaatgaattcttaagtgttgaaggtttaacactacaaaggtatgtcaagtcaggttgtttctcaggttcttttttgggaggttatacttcatggtagaggataaggctcaaacgggaaattgtgacattttaataaattttaattttaataaaattttagtaaatttcagctctcatggtgtaaacaagtatcctttttgtggtctacttaatgccatttttttctgtgttttgaagctttttgttaagattttacttgttaaagtgttccccaagcgtagcattgaagcgctatttattgtttgtaaacacaggctgtggcttaccttacagagaatatatgtgtttttaataaaaatttagaagaatggattgaagtcaaaaaatagtttaaggatattaaatatgggtaatattcataagtcagaccactattaatcccatcccatagatgaattgaagaattgaatcataaactgtaaatggtcattgtgttttaattgtatttagaacttagaaagcctgagttaccttatttgctcacttcctttgaagaaggaagatcttttgatttcaaagagaatattgtttatggagaaaatgttctagtgagtaatgttactttaagtaaattgaagttgttcaggtttttttccgtgtttgatgggccccataaaaatgaaggtataggttctaagtcacattgtctgaactgcttaagctgttgatacaataaggaactaatagtgatcactaagcagattaaaacatttaaccaagggatagaggggcagaggttccatgcttctagaagaaagtcatttggcagtttcctcttagaaatttcacttgaccccaaagaatattagggtacttctgtcagaattctagagggccatacctctaactgtaccttttttgctgtagataataatcaccatactaactttaccatgtatgtgtaaacatgatttggtattaaatgatttaaggccagctttcaaggaataattatatttattgctattgttaatcatgtatctttattatgttcttcaaaaggattcagcagaaatttgctttgatttattagtcaaagcaaatgttcctagacattttacttaagttttttgcctgaagaataattctacatattaaggcatgttattaaagcaaattttgaaaatcatacattaacaggcctgtcttccaaggatatccattagaatatatatatatttatttttccatttagccacctccgcctttagtgaaagttattgaagatttgcccaagaataaactgagttccagtgatcttaagatgaaagtaacatcagggagagtacagcagccagcaaaatctagggaaagcaaaatgcaaactagaatattaaaacaagacctgactggtgattttgaaagtaaaaaggtaagaatatttggtaattaaactttgtcatgattctgctgtagacaagtcttgtgatttctaagccatcaccactcttctctctcttgggaattaaagaaagagaataaaatgaagagaataaagttgtaacctaaattatgcacaggctggtctcaatcctggcctcaagtgatcctcccaccttggcctctcaaagtgctgtgattacaggcatgagctgccacacccagccatatggcagctttgagaaagaaagaaaatatagctattaatagagaagtgacattattttcaagggatttgaaaactttttaatgacaaatataatcacacacatatacaaagtacacattaatatggagctcagtgaactttcacaaaatgtacacaccatgttaccagcacccagatcaaaaactggaacattaccatcagcttattgctccacgctctctctccctcacccccacccaccccagaataactactcgactgatacactgtagattaacttagtaaatactgtcagttttcctaagtggttgattgaaaagtagttgatttacatccctaccagcagtatttgagagttctagttgctccatattctcactaataatacctgatatttttcacattgattttaatacagtgtccttccttatccatggttttactttccatggttttgtttacatgtaatcagctgtggtccaaatatattcaaaggaagatttcagaaaaaacaattcataagttttaaattgcacaccgttctgagtagcatgacgaaatctcctgccatcttgctctgttccacctggcacatgaccatcattctgtctagcatagtcactcagtagcctcttggttatcagatctactgtcacagtatcacagtgcttgtgttccagtaacctttattttacttaaaaaacttctgtagagcacaaaagtactgatactgacatattgtcagaattgtgctattttattattagttatgataatctattgttgtgcctaatttataaattaaactttattataggtatgtatatatagggaaaaacataatatatttagggttcagtgttatctgaggtttcaggcatccactggggatcttggaacatttcctcgtcaaatcagtggggactattgtaacttcttttttctttaagcattttttaattgtaaaatttgcaacacagaagagtgtctaaaacagattacagcttaatgaaaagtaataaaaagattacacatgtatcctgtgtcaggtagctgcaagaccatccttaggtttgatgatttattaggactcagcatgtagccatattcatagctataatatattaaagtgaaaggatgcaaagcaaaatcagcaaagggaaaagacacatggggtgaagtccagaagaaaccaggcacaagcttccgggaatcttctcccactggagtcacaggacatccttgattcctccatcaatgaatatgtgtggcaatatgtgtgaaatattgtctaccagggaaatttattagagacctggtgcccaggatttttactagaggctggttctgtaggtaccctgttttaacaggtttcaaatttcagactcccagaaggaaggcgggcattaagcataaaccacattgtacaaacagtttaagcacaatgagccactctttattggttctaggggtggtgagaactttcctgaaattcaacttctagacaccagccaaaggctgaccttgcaagtaagccttctgagggtagcaggctcagaccggcttgtgttcacttttttctgcacatacccatttccacatgaagaaatagagcattaccgtagctttggagccccgtgtgtgcttatcccccatcacatttttctccctaccccatatatataaccattgtcctcacttttgtgttaattatgccgttgattttctttatagttttataacttcttcatgtaactctaaacaaaatattacttctttaaagaaaaaactgaatagcagacacaagcctagcctagttgtgtaaagactgggcaatgttgctcctatttaatgaatgctttaatgcaaagataagctgaatggtatctctgagatgttctggcttcagagtttgcaggaccttttctgggaaaactggtgggaatggtcatgagcaactttgggaagtaaaagcctcatcatgtcagggtatctggcagcattgtagtgtggatccaatgtggatatcctacagaaatatgtcaaggaatggagctgcttccaaggaaaccatagccagttctaaaaagtaggtcaaagtagaacacttctatggcatgaagtgcaagtcctcaactaatctttgcattagcacgtggaaagaaaagaaggaactttatcagctcatggccaagacaaggacaggtcaaattgaggccaaactccccagggcatctttttctttgtttaaaaagaagcttcaatggcagcaggtatcttgatgatgaagtcagtcttcctggatcatgttgctctcatttgttctagttgccctctatacctttaacatggcactcaagtatcttcattcaccatcatcttaggttttcccttcacccttctcttacattggactacctgtttcttgttgtaaaaagagcactaaacgaaatcagaaagtctggcttcgagtcttgagccaagatttagcagatttgtgaccataagcaattcaccaaacttctctgattttcccattttttcaaataaaggaagacatttcatctgtttcatatagttgttagatccagttgagataatatatgcaaacagctttataatcctaaattctataaaatattttttattaagataaaaattgactttaaagtcttagatataagggactatcagcaggagctgatgtctgttaggataaaatgatgaactcccacatgtttttctgccagacttgtccttgatgctttaatgctaggaattgcctagaattttaaggaaagagagaggtgggggaggagcggtcagagtggattgctcttgatgcaggagtcccagatgacagccgatgggcctaattcggctattcaagctaagaatggtttgtgcatttttaagtagttatatataaatatataattttgatttttcttcttggcccacaaaacctaaaatatttactaactggcctgtattagtctgttttcacactgccataaagaatactacctgagactgagcaatttataaagaaaggaggattaattgactcacagttccacatggctgtggaggcctctggaaacttacaatcatggcagaaggtgaaggggaagcgggcaccttcttcacaaggcagcagaaggagagagaggaatatgtggaggagagactgtcaaacacttaacaaaaccatcagatctcgtgagaactatcatgagaacagcatgggggaactacccccgtgatccagtcacctcccaccaggtccatccttcaacacgtggggattgtggggattgtaattcaagatgagatttgggtggggacacagagccaaagcatatcatggccctttacagaaaaagtttgtcaagcttgtttagggaaggtactatatcatgaactttattggctatgtatatgcatgctcaagagagggagagaggggagtggggaaaagacctatgatacacaaatatgtcttactatgtgttgttttctaaagttgggaagtcactgtggactagattacctttgtcaccttttcagttttaatgattgtgtcatttattaatattgtctttttctttgtagaatgaattaccagatggattaaacaaaaagcgtttacaaatcttattaaaaggctatggtgaatatccaacaaaatacaggtacaatttaaattctgtatgttacatcagttttactcaaaaaaaattggggggattaaaatatatttttatttcagaatgttcatttggcgctctctgctacaactgcctgaaaatcatactgcgtttagtaccctcatagataaggggactcatgtggcatttctcaaccttcagaagaaataccccatcaaaagtaggaagctactcagagtattacagaggtatgttctatatattgcagcaatgtgtatgagacctgtaactaataattgcaatgttataaaatctcctgtttataaaatattgttttgtcagtttgattatccttatgtgatatgttggtttaattttaaaaatgtacatgcacatatattacatgtgaatattagtttgtgttgtgttctagaaaataggactctttcagttaatctgaaagaacatcccagcactttgggaggccaaggcgggcagatcagctgaggtcaggaattggcgaccagcctggccatcatggtgaaacctatctctactaaaaatacaaaaattagctgggtgtggtggcgggcatctataatcccagctactcaggaggctgaggcagggagaatcggttgaaccctggaggcagaggttgcagtgagctgagatcacgccattttactccagcctgggcgacagggcaagactccatctcagaaaaaaagaacagaggcatagtggaaagagctttgaatttgaaggcaaaagacctagttttgaattcttattctaccacttaatgattgtgatgtaagacgtgttattttacttcttagccttaattttttttatctaaaagtgggggtaataacaccaacatcataagactattgggcaagttagatgagaatctcttttagaatgcatatgctagagtccattcctaggaagcatccagtaaatgttaataataacagtagctcatcctttaacctgcttttcatgtgttaggcacatttgacttataggtaaagaaactaaggcatagagagactaggaaatatgatcaagtcacagcagtgatagagctaagattaagcccaggttccagagccgaagactttttttaaaaataatttttattatgaaaaatttcaagcataaataaaaaataatgtaacaaatatccccatgcccatcacccagcttcaacaattgccaactcatagccaatcacgttgggtgaatattcccactcactctacaccccacatcccaacatacacacactccccttgctaaatatatacatatgtatccctaaaggataaggactctttttctttaacataagtacactatcatactgacacacaaaaaagaattaataattcttcagtatgttcaaatattcaatcagcattcctctgattgtcttaaaaattttcttatgtaaacttgttcaaatcagggttcaaacaacatgtacacattacatttggttgataccccactgagattaatctatagactctgatacctctttttttcttacaatttatttgttggagaaaccagatcgtttaacccatacagccctctatgttctgggttttgctgattttatttcatagtattgtttaacatgtttctctatctcctgaatttactataaactggcagttagagctaggggcttgatctgagtcaaggttttttttttcccccctttggtatttgtttctttcacttgcaagaaaacttcctaggtggttttatgtacttgttaggcgcattataattaatacctggctgtctctcttttcgtgatgttgtccattgatgattattgcctacatccattatttcaccagagattagcaaaacagtgataatataattctgttccttctcattttataaaccgggaaatttctccaaagaaaaagttcttaggatcaactacttggttaccggaagatacaacccatgtaggaaaaggcaagttaaatgcttggtatctttttttttaaacagttttcagaatagtaaacttattaccttggagctccccagagcaatcagtgtattgattatgaactcagattgaacatatagaccttttcagtacatagaaccaggagttcatactaatattttcaattcagatttaagattacaaatttgcatagctgctttgattttatatttgtatttttttcttatgctaaaaatcttgatttctaacagcattgacataattccttattttctttaacacacatacacacacacacactcacacaatggtttttaagctccatatatttatgctgtataataaaaactatataactataaataataacaatgtgaatattatgattattgaaagcagtccaaaatatcttttatagttctttttgtccttaggttatatcccactaggcatatataatcaaattattgttttcatttttgtttttgttttttgagacagggccttgctctgtcacccaggctggagtacaatggcataatcatagctaactgtaacctcgaactcctgggctcaaacgatcctccccccttagcctcccaagtagctgctacaggtatgcaccgccatgcctggctagtttatttatttatttttaagtagagatgaagtcttactatgtggcccaggctcatctggatctcctgggctcaagtgatccttctgcctctaccaccaatgtattggtattaatgtattggtattacaggtgtgagccaccacacccagcccaaattattgttttaaaatgacttgaaataactcctcttcatatgataatgccactagctcactacacaggttaatttgtttcatttgttttcagttttttgaaaaatttttgtatttaatttaatttgttttatacttttataaaacatttacatgttttctaaatcaaatctacaaaataaggtacattcagaacaggctgacttctgtttcctttgtcctgttacttctcctcccaataagtcatccttttagcaaatatcttatttgtatttacaaatatgtttgtatttacctccttaggtaaatggttgtatactattacacttttctgtactctgctttttaaatttaacaacgtattttggatatcattttaaagcaatgtacagaaatattcatcttttttttatacctgcattatgcaccattatttatttggcctgtcccttaatgaacatgtagattattttcaatcttctgctgtcacaagcatgctgcattaattagtttggcccataagtctttttctattaagtgtatctttggaatagattcataaatgttagatgctgagtcaaagggtaaatacataatatactgcccttttcaattagagaaaacatcagataactttgttaagagatgacttagagatgggaatttgcttactttttctatttggtcttcacacttactatgcttcctgtctgtgtgtaagataacatcacagttcagacgtttgtcagaataccagtgtagactgtcagtgccttgcctttgctttttaggttcatattctaggttgagagccgtaaatatcttgggtagagagtgaagtctctcatcagatgccgaaggaattaaaagaggagagtacattacttcaaaaatgatgattttgtgcattcttctgaaataataaatttcctgagttcagaggacaaggtagaaaacattttctccttctgttgaccccctcactgtagggaatgaagaactgattttatcaataagtaaaagttactcaagtaactgtttaaggtatctaaaatttcttataatttttgcgtatcctaggattttagactttctaaattatgaatgcttttcttgggtacttgttgatgcttcttccttatccccagtagtacaacttaaaaacagaatattttaggattttttcactctttcattaagttctgttcacattcacattaagagcaaataatactgctctgctttttgggaaagagtgaggtaacacttttaatatcatagtgtaagctataaatttgattaaaaattcaaattatcagagaaataattttgatgttttctacctaaatacagtgtatacatggggaccttcttgagatgtattttccaaaagatcttcctaaagtgacaagaggttgctcatatcatttgaagtttctcataaaatgtaataagctgttacgctttatatacttatatgcctactagtacatttacaattaaagttaccattgtaactaattctgtgtaggtgtactttaaattataatcctagtttagttaaagcttcaaagcaattttttttgttggttctgaaatttctgtttttctaaatttttaaatttaaattttacatttctgtttctactaaaattcaaaattgtaacttaaaagggagggattattctacattaaaagagatagagatttaagggcgataaccaaattcaatgagtgagccttttttttctgctacaaaaatggatcaatgaatgagtcttgtttagacaattggggaaatttgagtcttgcctgattatgaaacaatactacaaaataattgttaattttatttacgttacagtggtgttgtgactatataagaaaatcatccctcccccacttttttaaagagttgtagacttctgtattaaaagaataaagtggcatgatgtctgggatttgctttataatagtctagccaaaaattgaggggatatagtcaatgaaagaagtataataaaacatggatttattgttgtagccaggcgacaggctcatggggcatgatcgtgctttctagttttatatatgtttggaattttttgtgatacagttttttgttgttgttttctgtttgtttgttttttgttgttgttgttgttgttgagacagagtttccactctgctgcccaggctgaagtgcagtggtgccatcttggctcactgtaacctgcccctcccaggttcaggtgattgtcctgcttcagcctccagagtagctgggactacaggcaccccccaccacacctggctaattatttgtgtttttaatagagacagggtttcaccaagtttgccaggctggtctggaattcctgacctcaggtgatctgctcgcctcggcctcccaaagtgctggcattacaggtgtgagtcactgcacccggcctgtgatacagtatttttaaaagtaactttaaagtattcattttcaatgacaaaaagaatattccttctttgtaaaataattcaaacagtacagaagattatgaagaaaaaatcagcacctcttccagccccaatttgacttgctagaggtaattgtttggtttacttttgtatagatatttttgtatgtatataatgcaaaagtattcacatacatttaacaagaatggaatcatactatacatactattttgccgcttatcttcctttttactttcaagtctatcatggacctctttctctcagtatatgtaggtttacttctttctaaaaaatgcacatggatggatgtttcaggatttaagtcttcatcttgttaattgacatttaggttattttatgtttatttgcttttcagacaatattataataaataccctcataaatatcttgtgtgaatatttttgtgtagacttctagaattgaaactactaggtcaaatcattcattttttctttctctctcagaaaattctgccaaccctgggaaatgccagtgttactgtgttttcaccgacactggatgttatcagtctttatttgttgtcagtctgagagtcagtcaaaagatggcaactcagcattgaatatgtaacttctgtaattatgaaagtactatccttaggataatatgttcttgtatttaggttgatttctagcccttccaaaaatgaggatttccttacattctctggaattccatgtcctaggctcagtaatgaagctaatccctccctcctggggttgttctgagtattgtatcgaataataaaaaatgtctgacatagcttattaactccattaactatgttagttctctattgctgctataacaaattaccacacatgtagtggcttaaaaacaacacaaatttatccttagagtttggtaggcagaagttcaccatgggttggatctcactgggctaaaatcagagtgtcagcagggccacattcctttctagaggctctggggagaatccttttctttgccttttccagcttctgcaggtttcccatatttcatgactcagacccaccttttctgtcttcaaagcacctctctaaccattcctctgtagtcgtatctccctctgaccgcaaccaggaaggggttctttgatattaaggacctatgtgattagattggacctacccaggtagtccaggattaatgccctcaccccaaggtgcttaacttaatcatatctgcaaaatctcatgtaaaataatatcttcatggattacagggattagagcatggacatcttttggggagggggacagttttcattattctgcttgccacattaactataaagtatactcagaaaaataatttatatttaaacagtaatgaaagggaattagccttaaaaatattaaaagctattataaagcattgaaattgctgctgacatataaatagatatgcagagtctaacaatagacccagctacattccaaaattgacttgtttttaaagatgtcatttcaaagtaatgaagaaaagataggttatttagtaaatgacatggaataactagctagccatctagaaaaagttgaaagcatacctcatatcttacaccatataaattctgcttgaactaaagatttaattcctttttaaaaaaacaaaaccatcaaagtattagaaataaatgtggagttagcaagtctgaaactactttatgtgtagaagccactttttgtatacaaatagctaaatagagacgagagccaggtttcttactctcagagaaagaagataaataagcaaaagggctagaatgaatcttgcagtagttgattggaatcgatagtgttagttcttaacgtatatgcagataaatagacacagaaaggaatatagatatgcatgtatgcaggagttagtatacatgcatatatttcccagctctttctaccgagaaggcctaacaatgacaccctggtaacagtgagcgcacctactggtgtggggaaaatacaagatgaacctgaagcatcttttagtgccataaagtaaggaaatgctctgaaaggatgggcatgtcacaagggcacgtgactcaacctaaaagtttccagtggccaaagctggaacaatttgaggaacaaaataaataacaatcaattataacttgtagaataaaataaatatccatgagttcatcctgacataaataattgaataaataaagatacaaatgagggagaagggacagttctaataaatatagaaggaattagagatatagaaaatcactatcgggacaccacagtgataattgttggaggcaagatccaccaattgatgctaaaattactggacaaaagttctaggagtgcctgggcacggtggctcacgcctgcaatcccagcactttgggaggtcaagatgggtggatcacctgaggtcagaagttagagaccagcctggccaacatggtgaaaccgtatctctattaaaaatgcaaaaattcgctgggcatggtggcatgcacctgtaatcccagctacttgggaggctgaggcaggaaaatcgcttgaacctgggaggtggaggctgcaatgagcccagatcacaccactgcactccgcctgggtgaaagagtgagactttgtctccaaaaaaaaaaaattctaggattcacaggatatttgcatagtcttaaaatatctcccccaagacagttattaatggcaaatggaaaaatagtaattttgtagtagataaactcagcagataacagcttaaccaagtaagcacatttaaaatcactagtacaccaggcgtggtggctcacgcctgtaatcccagcactttgggaggccgagacgggcggatcacgaggtcaggagatcgagaccatcctggctgacacggtgaaaccccgtctctactaaaaatacaaaaattagccgggcatggtggcgcgcgcctgtagtcccagctacttgggaggctgaggcaggagaatggcgtgaacccgggaggcggagcttgcagtgagtcgagatcgcgccactgcgctccagcctgggcgacagagcgaaactccgtctcaaaaaaaaaaaaaaaaaaaaattaattgagcgtggtggcacacacctatagtcctagctacttgtggctgaaatggaagaattccttgagtgtggagattcaaggctgcagtgagccatgatagcaccactacactccagcctgggcaacagtgtgcaaacctgtctcaaaaattaaataaataaaatgactggtaataagatgtcaatatgatgcacatcacttttgtgatattctttccaaaaatatgtaacctcattctaatcataagtatcagacaaacccaaattgaggaacaatctagaaaataactgatattcctcaaaaatggcatcatcatgaaaaataaggaaagactaaggaactctcatattggaagaaactagagagacaaaacacatgtaatgttgaatctggggttggtgaaatgaaagaaataacggaaaaatgatatcagtggaaaaacggtaaaatctgagtaaagtccataatttagtgaatagcatcgtgccagtgttaatttcttagtactgatcattgtactatttgcaagctgttaacattaggggaatttaggtcaaaggtatacaataactctactatttttgcagttttttttgtaaatctaaaactatttcaaaacagaaagttaaaaaaaggaaattaacagtacaggtattagaagtacatgtgggagaattataatcccagaggtaatgaaggcctttctgagtatgacatatccagaagaggttgataagaataaaaatctctacatgtaaaaataatttccaaaacaaagactcatgtaaaactgaaaaaacatatgcaaaacctgacaaatgaaacgctggtttctttaatgtatgaagcgcttatataaataaacatgtaaaggaccagccagtaaaaaaaaaaaatggataaacaatgtaatatacagtttacagtggtaaaatggttctttctatttattttagttttttgttttagagacaggatcttgctctgtcacccaggttggagtgcagtggtgtgactatagttcactgcagccacaaacgcctggacctaggcaatcctcttgcctcagtctcctgagtagtaggcgtgtgccaccacacctggctaatttttaaaaattttttgtagagatgaggtctcgctctgttgtccaggctggtctcaaactcctgggcttaagcagtcctcctgcctcaaccccccaaaatgttgggattacatgcatgagtcactgtgcccagcctagaaatggttcttaaacatgaaaagatgcttaatctttctcatagaaagagtaatgccaattggaactacgttgaagtaccatttctcacctagattaaaggttttttaaaaatcattgataatatgcggccaagagtatgaaaaacaggcatccctttacgcgagtcataggaacgtaaatagacactttttgtgggggctaatttggcactgactttcgaaattgcaaatgcacgtattcttgactcagcaattccactttaggaatttccaagtctgtattctcatgtgaagaatgatacacactgtgtggcacatacagtggcattaagcacagcattgcttataaaagactgaaagcaaatgccctacgatagagatcatgttaaagaaatgaaggtggctgggcacagtggctcacgcctctaatcccagcactttgggaagctgaggcgggaagatcgcttgagcccaggagtttgagaccagcctgggtaatatagtgagaccctgtctctacccgcaagaaagattagccaggcatagtggcatacatacacctgtaggcccagctactcaggagactgaggcaggaggaccacttgagcctaggagtttaaggctgcagtgagccatgattatgccactgcattccagtctgggtgacagagcgaggccctgtttcgggaaaacaaaagaaaaaaaagaaatgaaggtgtatcggtacgaagctatcatatccatctgtaaaatgtaaggaagttctgcatatactgatataaactatttccaagataccattaattgaaaaatgcaaagtacagaacaatttttataatatactaccatttgtggttttttaagaaaggatttatacttttaacaatggttacttctggagaggtgaactagatgataggggtacaaggaagaattttcaccaaatatactttttgtatcaaatttttatcatgtgaagatattatttattcaaataaattttaatgctaagttattttattcacagaaccttatctgcattagctcactggtctgtcatttttagtgacacaccatatcttccactcttggcatttccatttgtaaaattattccagaacaaccaactcatctgttttgaagttattgctactctcataagtaagtaaatacttgttaaagtataagatcaagaatggattcttatacattttcctgatgtctttgcacctttgcaacatttaacaattctagatgtctctacttttaagtcacgaaagtgtgaaacaataaggtatcaaacataaaatagacaattgaagcatttatatgtaaacctttttatttagaagaaaatctggaggccgggcacggtggctcatgcctgtaatcccagcactttgggaggctgaggcaggcggatcacctgaggtcaggagttcgagaccagcctggccaacgtggtgaaaccctgtctctactaaaaatacaaaaattagccgggtgtggtggtgcatgcctataatcccagctactcaggaggctgtggcaggagaatcacttgaacccaggaggtggaggctgcagtgagctgagattgctctacagcactccagcctgggcaagacagagcaagaccccgtctcaaaaataaaaataaaataataataataatttattgtctgcataatatagtatttcatcttatgaatatatcatttatatattccccaagtgcaagaattttatttttctaatttttccacacttttaaagcagttttttgttgttatactacttttacttcatgttatatatatttcccttatttttataaattaaatttcataaacattttttattggctattattacataatgtgcatgtactagtttaatcttcttggatatttagattgtttctaattttaacctcttttttttttttttttttgagacgggagtctcactgtgtcacctaggctggagtgcagtagtgctcactgcaacctccacctcctgagttcatgtaattctcctgcctcagcctcccaagtagctgggattacaggcacccgccacaccatgcccagctaatttttgtattgttttagtagagacagagtttcaccacattggccaggctggtctcgaactcctgaccccaagtgatccgcccacctcggcctcccaaagtgctgggattacagacgtgagcccctggcacccgacattttatctattaaaagtaataatgttgtaactatcttcgcatgcaaacataatagttccctttgcgtagatttccagaattggtgttatcgggtcataaaatgtgaataattgattccccaaaagggttgtcatatggtttggatgtgtgtcctctccaaatgtcgtgttgaaatgtgatccctgatgttggaggtggggcctagtgggaggtattggaccatgagggtgaatcattcataaatggcttagtgccattcccttggttgtaagcgagttctcgctcagttagttcacacgagatctagttgtttaaaagagtgtggcaccacctgccctgtgctctcgttcctgccctcttccagaggccctcacctcatctgtcgctcctgctctcttcacttcctgaagcaggtgctggagccctgcttgcacagcctgcagagccatgaatcaattcaacccttttctttataaattagccagtctcaggtatttctttatagcaatagaaaatcaaactaatacaagtattagtttacctgccaatagcactaccgtgttttaaaagcaaaagaaacacaataacaaaaagacaaacaagccaattaaaaaatgagtaaaggacttgaatagacatttctccataggcagtatacaaatgaccatcaagcatatgaaaagatgctcagcatcattagtcattagggaaatgcaaaccaaaaccacagtgagatgccacttcatacctactaggacagctgtaatttaacaatgttatatacatgttaatgaggatgtgggaaaattgggaccttcatttattgctggtagacatgtaaaatggtgcagtcactatgaaaaaacaatttgccatttcttcaaaattccaaacatagaattaccatataacccaaccatttcactcctgggtatatacccaaaagaattgaaaactgagacttagacagatacccacgtgtgaatgttcatagcatcattattcccaatagccaaaagatggaaacaatctattaacagattaatgggtaagcaaagtgtggtaaatacacgcaatggaatgttatccagctgtcaaaagcaatgaggtcctgccacatgctagctactacacgggtgaaccttgagaacatcctgcttagtgaaatacactagatacaaaaggacagttattgtatgatttcacttaggaaatatctagaataggtaaattcatagacacagaaaataaattagaggttacaagggctagggaaagtgggacagagagctagtcctgaatggatacagagtttctatttggggtattgaaaggatttggggaatagatagtataaccctgaatgggatcattgtataaccctgaatgggattaatacctctgaattgtatatttaaaaatggttaaagtggcaaataacatctattttactataattaataaagaaatggattgtagttaatttaggtatgtatgccaaactaaattttttatttctggtaaaatcttgttacatagctaaaatgttttatactaaggaaattgatttttctcttctaaacaaacatgcctgaaatctaaatttgggagattattgtttcctcttggatggtcagcatgagtggtggatttttatcaagggtctcaaggtagttttactcaataaacatttattaaagagtaacatttcagaggggagcaagtgaggaggctgcgtctgactcctgctttcacggccattgcagtacctggagctccacttgcacagatgcaagcccagtggacactgggtgactctacccttgctgaggaaaaagaactaaacactggcaaggcaattccaagaagctgagaggcagaatgtcatcacatgcgttctttgtgcagatttgccaggagaagcataagaagcacccagatactccagtcaccttctcagagttttctaagaagggcttcagagaaatggcaggccacgtctgctaaagggaagggaaaagttgaagacatggcaaaggcagattaagtttcatcatgaaagaaatgaaaacctacacccctcctaaaggggaaacaaagaagttcgaggatcccaatgcatctcacaagaggcctcctttggcctttttcttgttctgttcttaatattgccttgaaatcaaaggagaacattcagcctatccattggtgatgctgcaaagaaactgggagagacgtggagcaacaccactgcagatgacaaacagccttttgacaagaagtatgcaaagccaaagaaaaaatgtaaaaaggatattgctgcataccaacctaaaggaaagcttgatacaacaaaaatgagaaccatcaaggctgaaaaaagcaagaaaaaggaggaggatgaggaagatcaagaagacaatgaataagttggttctggcacagaattttcttcttgtctatagagcacttaacagtcctgtacacactcacttcttttaaagaaaaaatttgaaatgtaaggctccagaacatttgtttaaactgtacagtgtctttttttgtatagttaacaccctatcgaatgtctttggatagtcttgtcctggtgatattttcaataggattaacttcgcttggtacactatggggattataaattggcatggaaatttaaaagcaagtttttgttaatccacagcacaaattagttattttgaatggggatagtagtttttcatcttcagttttctctaatgtagcttatacaaaataaatgttttgttaactgaataccactccataattgaaaaaaaaaaaaaaaagttgcaactgttttgttgacattctgaatgcttctaagtaagcacaattttaaaaaatttactgaacttcagctaagcactagcactgctgggatatgccatcgttttggcttttaggtttgtagtctagttgggacttagaagacattttgaaggaaaagtcacatctacatataatttggaacgtatttgtaaaagtcttttttagacactagagtctcttttatgaccagacataaagtcttttggtttaacaaagactctccacacaattatcatttctctgtattttgctatctgtcagttctctctctaggtcctctacccatgcttttgtggtggcatcaaagcagaataaaaatacttaagagcaggcagacggttactgtatgcagtaggatatcctcttgctaaggaaaaacagcgctctcttaatgaagattgtaaggatcaggcctttgggtatatgtgtggtgttttaagttctcagaactaccagtgtcagagacataacaagtactcaggtgctgaaccatatttttccacttaaaattaagagctgggctgggcgcagcggctcacacctgtaatcccagcacttgggatggccaaggtgggtggatcaactgaggtcaggggttcgagaccaaactggccaacatagtgaaaccctgtctctactgaaaatacaaaaaaaaaaaaaaaaatgagctgggcatggtggtaggtgcctctaatcccagctaattgggaggctgagacaagataatcacttgaacccgggaggcagaggttgcaatgagccgagatcgcgccactgcactccagcctgggccacagagtgagactccgtctcacaaaaaaaaaaaaaaaaaaattaagagctacagagaatttgaaatattttttaaagctcagtctttgcaagattttatttctgacttcattattaactcaaatttaaatgatcaataataagtgaaataatggaactccagaattggaaagttcttataaaccactgtaatctaatattctgctgataaagccttcttttgctattttgagataggagatcttattatcaaaggatgaatctacaactcaatatttaaaattaaaaaaattttaaaattaagttaaacatagtcttattgaacaaaacaaaccgatggtcttatatacggctttgagaacaatctgtgggtcgttctactgattacagagtgcaagtgagtcaaagtcagccttagagttagttgaatatattctactttggactaactgactttcaaagaatgccactgttaccgattggttggttttcaagtcaagtttactgaaacaagttgtcaatgatcagttagatataaaaccagtcctggtggctattcctggttattccttattaccatgcttatagaacaatcagtcttttcctcagaatgaggacatttttattgtcattataatgtttaagggattagggatacagtatatacacatttgtttttatatattgctgatgtaattttgaacattttccttaagttttctaattttgattacatgtgaattttagtagatttgaggagattggcatgctaatgttgattacatttaatgaagggttaaataggggccctttttaaaaagatcatttcattaatcaggtgatgaacaaagcaggagtcaggagccagaatgccatcaggagtactttgggaagttgtgattgtttgttttaattaacactttttcattgactactgtaaggaaatttgcaaaatttctgtaaacatactatgttaacatgataggattttaaaatcgattgtcatacaatataaagagtttttttttattattcatggacatattgagaacataaagattggatacatttaagaattgcaaagagttttgataacatggaaagatatttaaagatatgttttcttttttttccttcatagtcaattggtgtcaacactggtttgaatattttcctaatcctcctatcaatattcttagcatgatagaaaatgttttggcatttcatgacaaggaactgctgcaacacttcatagatcatgatataacctcccaggtaagaagcataaggtttttagaataacatgccttattttgtaagctaacattggttctggtataaacagtcttttcttgaaggagtataataaaaagcatactacatgttgtatttttaacagtattccattctttttcttcattaaactgccttcctgaaagtctgtaaagaagggtccaaattaaggtagttattttcataattatgtatttaatatgattttcatagcttaaatcgaatgtaagggaatattaccaatgactccctttttacttttccctagaaaaataataaatttttccttatctgttttagctatatgcatggcctcttcttgaaactgtgttctcagaagtgctgacaagagaggagtggctgaaattgttcgataatatcttttccaaccatccttccttccttctaatgactgttgtagcctacaacatatgttctagaacacctctgctcagctgtaatcttaaagatgactttgaggtaacggtccttgttcttaagagaaggttctcaaatatcagttatttctctctattttttttttaattttttgagacagagtctcgctatgttgcccaggctggagtgcaatggcgcgatctcagctcactgcaacctccgcctcccaagttcaagcgattctcctgcctcagcctcctgagtagctgggattacaggtgcgcaccatcatgcccagctaatttttgtatttttagtagagatggggtttcaccatgctgtcagggtggtctcaaactcctgacctcgtgatccacccacctcggcctcccaaagtgctgggattataggcgtgagccacagtgccaggccatatcagttatttcaattgaaaaatccatttatttattgagtccctgttatatgtcagacactggtgctaggtagtaggaatataaaggataacaagttagaccacatccctacctgtgtacagtttatagacaataaagtaggcaattatagcaggctagtagtcttataatcatagcttaagaaaagaatcatgataatattggggtttgtgctttttgcattttttttttttttttttttttttttttggagacagagtctcgctctgttgcccaggctggagtgcaatggcacagtcccggttcactgcaacctctgcctcccgggttcaagagattctcctgcctcagcctcccgagtagctgggattacaggtgcccgccaccacgcccagctaagttttttatatttttaatagagacaggatttcactaggttacccaggctggtctcgaaccccttacctcagatgatccacctgcctcggcctcccaaagtgctgggattacaggcatgagccaccacgcccagctgcttcttgcttttataaaggatgtttaacaggttattctgttattctgtgcataatcttatcatgacccatctggtcttagagggtctgaatgcttattacacatgcaaaaggtaactatgagagttttgagacttggcaggaaagtgtctgaaagaaagcattaagatcattataaaaagtagacgctcttttggtagacaagatgaattagttgggttcttgtgtgtgtgtgtatgtgttacttatttagtggttactgtccaattaaactttatttttacttcatgatcctgtgatacattaatttggatcttccagcaaaacaagataatgtggaaactttttagatatttttaaagaagcaagctaatttattttcaaagtctaatttataatttattttggattttgaagaaaaaaaaaatccaagcagagtttgttccattgttgaagcattctttttctattgtaagaaaagccttcattttttaattttatgtcagaatttcttatgattgtgaaactcttacattttttaaataaattgtctttgttgtaaaacttgagtaaagaaaagctttaatgaatttgcaaaaaaatatatattcttaaagatagatacactttttttaaattcttgttttaattctacctcataattgctttgtcaggtaaatctcgatttaaacaccaagttttcttacagtttttttttcaccatcggaataacctggatataaatgttgtgattagacaagtttatcatctcatggagaccacgcctactgacattcatccagacagcatgcttaatgttttcgttgcactgacaaaagggcagtatccagtatttaatcaatatccaaagtttattgtggactatcaaacacaggaacgagaaagaataaggaatgatgaattggattacttaagagagaggtaattatggaatagtttttctttttctgatacaatgaaatatgttataaacataaaaagaaagttttaatgaaaaatacatttggctgagcgcggtggctcacgcctatagtcccagcactttgggaggccaaggcaggtagatcacaaggtcaggagttcgagaccagcctggccaacatggtgaaaccccgtctctactaaagatacaaaaaattagccaggcatggtggcacgcccctgtagtcccagctactcaggaagctgaggcaggagaatcacttgaacccaggaggaggaggttgcagtgagcggagatcatgccattgcactccagcctgggcgacagagtgagacttcatctcaaaaaaaaaaaaatgcatttaaattatgagtatttgtgtaaaatcagagtttgaaggctagaactattaaagatagttaattcttgcatatggaaataaaatagattatacattaatcggtatacattttgtgttttgatgattcttagctttcttctttgtgttttcataataatattacctacttaaggcagacagttgaagatatgcaagctaaagtcgaccagcaaagagttgaagatgaagcttggtaccagaaacaggagctgcttcgtaaagctgaagaaacaagaagagaaatgctcttacaagaggaggagaaaatgatacaacaaagacagaggtatgtgttatcactttaaaaaaaaatctggacatataagttagttgaataatttttatgttctttcattttttcattttagaaacaacattatatataggattacccagctgtagcatttctataaagcaactattaagttaataaaaagaatctttatataccacttttcaaaaaaaattgctatgtagtaaaatgtaattctgaagctatgctgaatataatatagctttgcatggattaatgttccttgaaggacattatttagaaacattattctatagtgggcagaaatgctttgtaatagaatgctaggtacatcacctttagtagagtataatttttttaattgtgttttaaacatacctgtgtgacctgacagttgtaacatagaatgattatgtcattacccatttaacactttggaggacaggggaatgagtattaaatgcgtattcaaaagtacgttagctgggtgtggtgccacatacctatagtcccagctactaggtaggatcacttgagcccaggaggtcaaggccagcctgggcaacatagtgagaccctgtctcttaaaaaataaaaagaaaaaacttaaaaataaatacataaaagtatgttaataaggtaaaatgtgtaaattaagtaaagtaatgggataaacattgagactaagcccaatagttgggaaactcacttctgtgtttattgattcctattcttagatggaactttatgtaacagatttatagtgtgggttaaaaggaattactgaactgagccagtgagctttctactaaaattcttaaagcataagtatacatcatctttggtaacggtggagcagttctcgcattcttctttcaaataaaggatatcaattgtattgaaatgatcagcatggcagacctgttatgaaaaaactaaatcatattaggaattgctgtatttgttccacttgatgtattttgtatttaaggctagctgctgtgaaaagagagctgaaagtaaaggaaatgcacttacaagacgctgcaagaaggcgttttctgaagcttcagcaagatcaacaggaaatggaactaagaagactggatgatgaaattgggagaaaggtttattattcttaacttagttctcatacatcatctccatttactctcacttaaatgtaatgaacaccttcaaattaaataatattcttagagtccaccatgaatactaaatagccgctttaattttatttacttttcccctcagctttctcattctcttttgtatttcatgaatggctaaatatttaagaaatgccaggaaaattagtcaagtgtccttggtgactatttctctaaaactagaaatatcagtatcagttagccattaagttattttttcttttcttttcttttttttttttttttgagacagagtcttgctctgttgcccaggctggagtgcagtggcgtgacctcagctcagtgcaacctccgcctcccgggttcaagtgattctcctgcctcagcctcccaagtagctgggattacaggtgcacgccaccacacccagctaatttttgtatttttcttagagacgggatttcatcatgttggctaggctgatctcaaactcgtgacctcaggtgatctgcccaccttggcctcccaaagtgctggggttacaggcgtgagccaccaagcccggcagttaatttttaattaggggacatattcttttttcatataaaaattatctgtggccagtataaaaataatttccagtacaaaacatacagaattaaaaattgaccttctccattagttctcatgtcatccccagagaaacactattaaaaaatggttaattggctgggtgcggtggctcatgcccgtaatcccagcactttgggaggccgaggcaggcagatcacctgaggtcaggagttcggaaccagcctggccaacatggtgaaaccctgtctctactaaaaatacaagaattagctgggcatggtggcaggcgcttgtaatcccagctacgcaggaggctgaggcaggagaattgcttgaccctgggaggtggatgctgcagtgagccgagatcatgccactgcactccagcctgagcgacagagtgagactcagtctcaaaaaaaaaaaaaaaaaaaaaaggttaattacatagactttcaggtatgttctatagatagaggagtaattatagtcatgttttcctatatttatacaaaaatgggattattctcattatacattgtttttgtaacctgctttttaaaatttcatatgctgaatatcttttcatatttgttatatgtgtatctatttctctttttgtggttgtataatattccattgaattaatagcttatttaatcctttgctattggacatttcggttatttgcagtgttttgcaaattacaaaaccatgctacattgtaaaagtctttgagtacttgcacacatacttttgttgagtaacttctaaattatgacaaattgttctctaaaaatgaaacagtttcagcggtttaaatctgtaagagtacccactccctagtatagtcaattgtactgcatcagtcttaatatttgccaagcagatagatgacaaatcgtctattttaatttgcctttttttattgttagtgaggttaagtatcttttctgttacttatcttccatgtgtagaattacacattacatatttgtatcatttgtccatctttttgtcaagttagacttaactttctgtcaggttagcttacttatttccaaaaggcaagtcaattgtcccaacaccatttgttgactattatccaagtcatttgccaactgatggtttttacatattaaattctcttacatatttgatctccttcctcgctttttctattcctaagccagtaccacactgtttgaatgacagtagctttgaagtgttttaccaactaggcctagttctcactcattagtcttccttttcagagttttcctcagtattctcaaatgtttatcattccaagtagactctaagaattgtttcacttttggaattctcacctctcccaatcctattggaatttttattaggattacactgactttatgcactaatttagagtttcaagcctagttttgataaaatactaagtattttttaagtctttttttttttttttttttttttttttgagacagggtctcattctgtcacctgggctggagtacagtggtgcgatcccggctcactgcaacctccacctcccggattcaagcaattctcatgcctcagcctcctgagcagatgggattacaggtgcctgccacaacacccatctaatttttgtatttttagtaaagacagggtttcaccatgttggtcaggctgatcttcaactcctgacttcaagtggtctgcccaccttggcctcccaaagtgctgggattacaggcacctggcctaagtctttcaaagtatttttaattcaatagtattagaaatctatcatctctttatagcatgatacttcttgttttgtttaaagcttgttaattttaaattggttttcaaaatccaagatttcttttaattttctcatctagtgaatgacattgatatttcattactgtagaaaagtgtatgttcttcccgcaaagtaagctcagaactctgatgtctttattccaaacccctttgaaacaggaggaggcattttttggtccaagaattctatagactcctttcagcaacatgatctggcctccgcctacccttccagcctcctgtcctcccagctacctgttctgatgttgtgctctgaccctgccaaactgcaaaagctcttctcatggttcagactctagcaggaaaggctgcttgaatctgaagtgacaagtacatgtgactgtgaacatctgttagcagcaagcaaagctgatcggtttttgctgtggcacatagctgtttgtatctctgaaaattcataagcaaaagagctctgtaattgaaattcctaaaaagcgtgatttgctaggccacacctctcctccacttcctggcattattactgttcttgcttcacacaatcaagcttcccccaacctttgagctagctcctttcccaataacctctttaaattgaactggtcctggtccatgtttctcttttagtctttggatatatatgtttgcacatccaactgtattctcatttagtgtttctcctattttaggtattcgatagcatgtcttttaccataatgacaatatctaacatttcactttatatctaagatcatttctaagagtctctagagagttccatatcccatatccaaagcctctagtatataggaataaaaagcctccaactaatcaaattttggaaataggtgaactctaaattaattcacttggagcagaacacatacaggttgaaccatctgcaagaaatttaaacctagaattgttaattgtcaaaccatacttataaaagtagagaagtttagtcaaaaagagcattaaataaatgttatatttttatctaccccagatttaaattgctcaagtttttctaactcatgatattggttactgtaatactgtaagaactgctatctgttcttccagtctgagtagatgggcatatggtattgtgctttttatttttaaattaaacttaactttaactgagagattattcctaggttctgcagtgaatattaatctttgtctgttactctggtttcaaaaacccagttgctgttattttaaatactgttagtaggtcgttcagattacaggattactaaatatattaaaaattattttgtaaattctttttggtatttacagtttgttgtttggccataggtatatatgagagatcgagaaattgctgccacagccagagacctagaaatgagacagctggaactcgaatcacaaaagagactttatgagaaggtataattcagttatttccaacataagaaaagcaggttttggccaggctcagtggctcaaacctgtaatcccagcactttgggaggatgaggtggaaggaggatcacttgagctaaggaattccagaccagacctgggcaatatagtgagaccccatctctactaaaagtttaaaatttagctggttatgcttacctgtagtcccaactactcaggaggctgaggcaggaagatcacttgagccctggagttcgaggctgcagtgaaccataatcacatcactgtactccagcctgggcaaacagagcgagaccctatctccaaaaaaaaaagaaggaaaaagaaaagcagggtttgtataagcccattttagactgtatttattcatggttttctagcgttcattttattcactttttaagcagaatatagtgccacacaggattgtaaggtagccaaaatgtctgaatgtacagtttgttgtaattatttaattcatgtttctgttagcagcttagtctagtgtctgaagcaccagatgtaggccccagattttgcctcaggattttttaccaacttactaaattttcctgtaattacgtaatagtgactacaaaattatctcaatacctcacaaggatcctgaaaggtaaatcagtcaggagctgtaaagtactttctttctttatttgtatttttatgtatttatttttgagacagtcttactcagttgcccaggctgcagtgcagtggcaccatctcagctcactacaaccttcacctcccctgctccagtgattctcccacgtcagcctccccagtagctgggactacagacgtgcgccaccaagcctatctaatttttgtgttttttgtagagatagggtttcaccttgttgcccaggctggtcccaaactcctgggctcaagcaatctgcacacctcggcctcccgaagtgctaggattacaggcatgagccaccacgcctggcctgtaaagtactttaaattggaatcttctggagttaactcagcaaatatctgcttagtacttactattcagttttcaagacactggaaaaaaggagctttgttaatataaatttttattatttaggaaaaatgttttgttactcatttagtgttgaaactgtaagttttcacttctttcagcccacttaaaaagtcagaccttttagcctgggcaacacagcaagaccccatctctactagaaatacaaagaaatagccaaatgtggtagtgcgcacctgtggtgccagctattcaggatgctgaggtgggaggatcacttgagcccgggggacggaggctgcagtgagccaagattgtgcacttcagcctgggtgacagagtgagaccctgtctcaaaaaaaaagtcatacttttagtttgaaattagtgataactgtgaattcacaacacataacatatatgtttgatatccacattaggtgagatttaaaccatatagcatccatttacacctataacacttttaaagtctccacactgaatttcttctagaacagagcaagggatttacagtttggctgagtctcccatgatttggaattagatgtaattcatttggactaagctaaactttactatattttctttgggggtggaggatagtggcaatcgaagggtataattttagaactaacagggaatttgcaagaaaaatactaaaaatttccagatatttgtctctcagatttttaaacactaacattctactaaatttgctttctcttcctctttttctttacctatgcacatatatacacacaaacatatacttgtttttctgaactgttacagacgtgatgctcctttacctctaaatacttcagtgtatatttcctaagactaaggaatcctcttatataaccaccgtacagttctcaaaatcagaaattaacataagatgatctgatatataaaccttattcagatttgatccattgtatccaaaatgtcctttagagcaaaagaaaatctgagatctcatccattgttttgttgttgtcactttagtctcctttaaaataagaaatgttcgtgactctgtctttgtattttatgacattgatattttttgaagcatgtaaaccagataatttgtagaatgtcccttaattagcatttggctgttgtttcttcatgagaagatttaagttacccataggagtgcataactttaatctgtggcattcctgcaacagaagttatgttttgagatggagtctcgctctctcacccaggctggagtacaatggcgcgatctcggctcactgcaacctctgcctcccgggttcaagaaattctcctgcctcagcctcccgagtagctgggattacaggtgcccaccaccgcacctggctaatttttgtatttttaatagagatggggtttcaccatattggccagcctggtttcaaactcctgacctcaggtaatccgcccgcctcggcctcccaaaagctgggattacaggtgtgagtgactgctcccagcctatgctgagttttttttctgtgtatcagaatgggaggcaaatgtttgttaatctctttttgctgtcttttgaaggaattatttatttaaacaaaccaataggattagagaagagttaaactattcatcaaaacaaatatatgaaatcctgaactttatctggtcagttaggtacggatgtgctgccactacctttttcaaattggctgtagtgattgccactttacctgcccaatttatctcttacattaggttgattaaatgtgtctatttctaaagaaattatgtcccagaaaaccaacaatattatgattacctccacatgagctcaacattccatacgtatctaatttgaatcaaattattgttcaacaaaagaatgaaactaagtataaactaaaagaaacaagtaaatactaacctgtactccagatcccatcccctcataatcttctaggacctcatttatcaagtctgttttctatctgtctttcacatgtatgtaccttctccttcgcataataccagtcttgcaaagattgctataaagattaaatgagttaatacgtatttgtctgtgtcaggggtccccaagaccaccctcaggttcagtgattcactaggactcacagaactccagaaaagctcttatattcatggttacattttattatagtagaggaatacagattaaaatcagtaaaggtaaaaggcacatggagtggagtccaggagagaccaggcagaagcttctagttgtcctctcccagtggagttgtacagacagcatttaatttcctgcaaagatgtgcgacagtatgtaagactattgcctaccaggcaagctcactcaagccttggtatccagggttttactgggggtcatgtagacatggagtgcatatgtggctgactttagttactttctctacagcccatccaaaggtcaaactgatagagcatggcccatggttcccaccagatcccatcatttagcagaaaccagctggcatggccaatatctccaggtatacagacactcttatcaggcagagtattccaggggcttagagattatctcccaggaactgatcaagggccagtcttttctttagaatgtgcaggtttttaattactcaggcctactgagttaaccctttattgcacagtgtctgatgtatgatacatattggatagatactagtttccctcttttccctttggcctaaaaagctctattattttaaaaagctaatggacaactccagtatgcacacgtcgtccaatatgtttcttcataccactacccaatctttgatcctcttcaccatttttagagttccattgtttcctcttagtccttaatctctacacatacatgattttacttctttatggagtagctaaaattctatgttctgcttttcttcttcgcttaataaaattctttttaaaattctttttctaaatggctacatatttttgtaactgtcattggtagtggctgctggtgaaccataacttatttaagctttcttctgttgttagatgtttaagtggtttacaatttttgataataagcatcttcacatatatatctttttgcatataattgaaagatatttttatttttagcaaattataaaggtaattatgctgtctatagatgattagaaaagtagaaaaaatccctcgagaaataacaactgctaatgtcattaatagtgatatgagattatttggtacatacaatttgtgtttggcttttttaacctacattttcatgaaggctgtttactatccttctcccaactactgtacctgttagcatttactctcctatatccctgcccctggcagccacgaagctactttctgtgcccatggatttgcctattctggatatttcatataaatggaatcatacaatgtgtgattttttatgactggcttctttcacttagcatgttaagcatcttttcatatgtttattggccattttatattttctttggagatagtgtgattaatgtttacttaaagtatgtatgggtcatatttcttgttttgttttgtttttgagacagagtcccactctgtcacccaggctggagtgcagtggcgtgatctcagctcactgcaacttctgcctcccgggctcctgcaatcttcctgcctcagcctcccaagtagctgggactacaggcgcacaccatcacaccctgctaatttttgtagtttttatagagagggttttactatgttgctcatgctggtttcaaactcctgggctcaagcagtcctcccaccttggcctcccaaagtgctgggattatacgtataagccactatgcctggcacatatttcttgtttttttttttttttcaaacagtcatgtgattttttgttgaaaactagacattttaaatacaatgctcctcaacttatgatggggttatgtcctgataacttatagaaatattgtaagttgaaaattcatgtaacaccctgatagacccatcataaaatcaaaaaatcattacgtcaactcaaagaccgtctggaatataatgtagcaattttggaaataagattgtctcccctccccagggtttcttcttgtttctttgcttagtgacttttctgaactaattttgaaagtccctattctttgttgtatataaccactgatgtctctactcaggtagtttgggggtcagcaaatgattgaacagagattttaatatattctttgaaccagtaagcttctagtagttgttgaggggctctgtgtgcatgttagggcacgcctttatcactcagctaggcggtttatactttctagattccgcttcctggttatgcaaaacctcagagttgaccagaagtgtgagatcttaggtctttctgtggtctgagaacacagcccgtagcatatacacagccttacacatgcacatgaccttccaggaacctatcagcttttttaagcctcctgtggacatctgattctccagtttttcctgttaagctttttacttagcctattggttgctcttctaagatctactgccccaagtagccaagatactcaacagtttgctctaattgttttcagcaacttccccagggataaggctattctgcactaggtgagctctgagtgagatcaaaaaagacagccttaggagtggtctttcagggaccaccagacaggtcaaacagtgacagttctccagcaatggtggtttgaaggagctccgtccaacccccttttgcttggcttccttccttggcttccaggctgctggttttcaagactaatgtataggctggacatggtggctcacacctgtaatcctagcattttgggaggccgaggcaggccgatcacatgaggtcaggagttcaagaccagcctagccaacatggtgaaaccctgtctctactaaaaatacaaaaaagttaaccaggtgtggtgacatgcacctgtaatcccagctacttgggaggctgaggcaggagaatcacttgaacccgggaggtggaggttgcagtgagctgagattgtgccactgcactccagcctgggtgacacagtgagactctgtctcaaaaaataaaaagactaatgcatagcttgggagtggggtgggaacaggaaaaatgcaagatgaaatgtcagagagctagctgttcttaccaagattcagccatttttataagtaaatgctccccagatagctccaagcctttggttaatttccagaatgctgaagaagttcattttgacatttttttttatcagtgttctcaatgcttttatggatgagaggatttccaggggtccttactctgccatttttgctgatgtctccagtcgttgaattttactttgaaaattagatgattacagcttttatttgtgtgcatattactattctgaaaaaagtcatttttgtattctagcgttatataaattagtgatttttttttacaaatgattttaacagaatcttactgaaaatcaagaagctcttgcaaaagaaatgcgagcagatgcagatgcctatagacgaaaagtggatcttgaagaacacatgtttcataagctgatagaagcaggtgaaacccagagccagaaaactcagaaggtaaaaatatgatccatttagtatacatgcagaggagaaattttcatctgtcaccctcttaagagaacaaaatcgaaattaaactctgtgaagttgagttagtttgtttctttgcttcagttgtcacagttcctagaatctcacattgcttccttttatatatgggatgcttacttcactgacaatcacatgatatgcatgtctttttcctacagtttgaggaaatacaaaggaatagtgacttacaagaaaatacaaaggagtagtgacttagaagaaaatacgaaggaatagtgacttaaaagaaaatgcaaaggaatagtgactttacaaattttactgtccttctgtgttctgcctctgaaattgtccctgagttgattaggttcaaagcatcaggtccctgcatggtatggaagccagcacttccaagtgtattgtgtggactattaactattattcaataagatgggggatggtcaaataagtattggaaatgctgtcttaaagtgaggtatttttcacgccaaatttgaggatttaagagaatttccaagatgtatttcagagaatttcttacggagtacactttcagaaatgctgacttaagtgaattgaaatagaacttgagactttcaaagaagagctttctctattatctctttaacaaaatgttaaatgggtatgtgtaccggtctgctcctattccaaaaaccaggaatagtgtaccgtagataccttctgttgtacaacagtctcttaggtgatttcctcaagatattccatttttttttaataggcttgtgtccagtctgttaaaatgggctcttcttcagagtctcctcttcagagtgctgaaaacatggaaattgttgaatcccacccataccctagccgataagttcttaaccttggctgtaaattagagtcacttgaagagctctttttttttttttttttttttttttttttttgtagagatggagtcttactctgttacccaggctggagtgcagtggcacaatctcagctcactgcaacctccacctcctgggttcaagcaattatcctgcctcagcctcctgagtagctgtgactacaggcgcgcgctgccacgcccagctaatttctacatgaagagctttttaaaggtgctggtaccccgctgtccagtgattggtttaactggcttgtggcagggcccagtcatccgcttattttaaacactcccaggtgattctaatatgcagccagagttgtgaacaactgccccagacacttggatacattgaatggttataccttcattttatgtactagtagtttgaccttgtttctgaaatgtataactttttcctaggtgattaaagaaaatttggcaaaggctgaacaagcatgcctaaataccgactggcagattcagtctttacataaacaaaaatgtgatgatctacaacgaaacaaatgttaccaggaagtagccaaactccttagggaaaacagaaggaaagaaatagagataataaatgcaatggtggaggaggaagccaagaaggtaaaaaatagtgttataaactttttaatatcaagcattgattttttttttttttttttaagagacagagtctcactttgttgtacagcctcgaaattcaaactcggggccttaagcaatctgcctgcatcagcctcccaaagtgctgggattacagacgtcagcccctttatccagcctaagcactgaaattttgaaatagtacagagtcaaatgacaaaagcatcataccaagtcgtttttgctggaaaagataatctgattttaataggtgtttgtcagagacgtcgtctaatattgattctacctaaaaatgactaagcgtctttctcatttacattagtgtgcttcaatttctcaacttcctggatttttgttctggctgattgaataatattagtactttaatttagctaattctttatacttacaatgtaaaagatgctgaataggtagaaatggtacgtagctgctagtaacaaaaccccaaattacagtgactatgaacaggatagaaatatagtctggaggtagggagtctagggttagtattgtggctccaaggttatcagggaaatgccatctttcagcctttctgcacctcttcttagtgtatggctttcattttcaaggttaccttaccatccaagatgactcctggagttccagccatcacatacacattccaggcagcggggagaagggagagcacaagtgcgaatgttctgcctcccatctgagtcacactcccttctaacttctttccaggagttccatatcatatttcaagccacatttgtcagcaaaggatgctgagaaaaatagtattcttcacagggagcattatcatcccaaataaaattaagattctgttcctatcagttaataagatagctaaaaataaaaacaaaagattctactgctaaagaagaatcaaagaatggagtccgaggaggtaattaatagtatatgtcacacgtgtgtatcttttggttgatcctcgcaaagactctgggatctgtgctctggagatattatcgcaggtaccatagactttcctaaggaccctgaggagctggggaaagatcaagatgtagatacctggcttaattgcttctctctgttgctgtatcacaatgtctattctgaaagctggcttcttacagtgtatttccttcaagtcactattccagattcattttcctcctaccccatcccagtggcatggagccttatcttataacccttccattctaggacaggaaagaagggcttggagagggtgggggtaatatccagaaccctgaggctgttctcaggaaaacaggggtggaagctcacattctcatcctaaacattgctgacactagggctatactgtgtgaaattcactgctgctggactttgggtaaaatggtacttttgagaattggctgagaatcattgtaggggcccttcacgttctgcagaaatccttccttgtgtctagtgtcttgcgttgtaaagctgacttgactactgcgtggccttgggaaattgctcagaatcagccccctcatcagtaacatgaaagggatggatttctgtgatccttccttaccctattttgtgattttttaaaaaagtttttgttatttaatgcattattatttctatagcataaaaattatgtgtttccatgtaaaagctgtagcttttccagaatttcggcaaactttaggagttggattttaaatttattttagttaccttctgagctaattttaagattattattttctcattttatggagaagaaaataagggtgaatagaaatcacttgacttccctgtggtcatcatgtggaccagagctgggcaaagagttcattctctgaattttgtagattttattattaagatagagcattcaaattaaataaaatgcaattgccactaattcaaaactagcttagtctcataagatttgagatttgaaacttattgaaatgcattattatttcagcaattattgggatatagttgtgtgctttgtggcactctgcaatactgggggttggataaaacctgcctctgctttcaaggctcttaatagccttgggccaacacaggcaccccagttaccataacaccaaacagatcctacttgccatgggaatataaaggaaagtggatagagaagacagaagtggctcattccactgtgaaatgtgtattactatactttttatgtaatctttttttccatttatttgaatttagtggaaggaagctgaaggaaaagagttccgtttgagatcagcaaagaaagcttctgctctttcagatgcgtctagaaagtggtttttaaagcaagagataaatgcggctgtagaacatgctgaaaatccatgtcataaaggtgagtgtctgagaggcctttctctccatgatgttacagatttattcttttagtagggtctattattatgatttttttttttttttgagatagggtcttgttctgtcacccaagctggagtgtagtgatgcaatcatggctcagtgcagcctcgacctcctgagctcaagcagttctcccatctcagcctcccaagtagctgggaccataggcgtgtatccccacacctagctaatttgttaaattatttgtagagatgagatctcactatgttgcccaagctggtctcaaactgctgggttcaaaccatcctcccgccttgcctctcaaagtgctgggattataggcgtgagccactgtgcctggccagtgaataaattattgggatgtattttggcacttctattcaatctactgctcaagtaaaaggtaatcactggttaccatatttttggtgggaaagggtgggctgaggtgggactattacagaaacagagtcccagtcgaggaaaaagtttgtgcagactatcctgtggagttctgtttgattctgttgctccaaggtaaaatatgtactttgccaaaagctggtcctcagaacaacagtatattcaagtatcacatggaaacttctcataggatttgatccaacattaggtttcgatacaaggcttacagtggcatcaactgaaaaatcaaaattataatttaaaactgtaaaataccctggaggctgaggcgagaggatctctttgagcccaggagtttgaggctgcagtgagctattatcacaccactgaactctagcctgggcaacagagaagaccctgtctctttaaaaaaaaaaaaaaaaaagatttccaaaaattatagagtacagttaacaaggagcttttattttactgtgttttattttgtttcagtcttttataatgtgtatacattgctttttaaaataatagctttgttgatacataattcacatgccctataattcaccttttttctttctctttttcttttttttttttttttgagacagagtttcgctcttgtctcccaggctggagtgcagtggtgcgatctcagctcactgcaacctccaccacccaggttcaagtgattctcctgccttagcctcctgagtagctgggattacaggcctacaccaccatgcctggctaattgttttattttagtagagatgggttttcgccatgttggccatgctggtctcgaactcctcacctcaggtgatccacccgcctcggcctcccaaagtgctgggattacaggcgtgcccagcaccgcacgcagcctaattcacctatttaaagtgtattattcaatgtcattatattatcatgtactaaaaaatacacttacatagtcatgcagccatcaccacaagcaagtttagagcatttttcagcacttcaaaataaacccagtacccattagcagtcactccccatttccactcactcccccaagcccctggcagctactaactaccttgtgtccactcacctattcaggaagtttcatgtaaatataatcatgtaatatatggtcttctgtgtctggtttcttgtacttggcataatgtcttgagattcaaccatgttgtagcatgtaccagtacttcattcctttttattgctgaataatattccattgtgtggatattatgtatttttttaatctattcatcagtcgatggacatctggattctttccaatttttggcttcatgaatatgctatgtgcattacttttacatttcacaaatttgaagagtgaaaatataggttaggtcatttaattatgcctacctttttttttttttaaagacagaacttcactctgttgcccaggttggagtgcagtggcacgatcttggcttactgcaacctctgcctcctgcattcaagaaattctcctgcctcagcttcctgagtcgctgggactacaggcgcatgccaccatgcccagctaatctttagtagagatggggtttcgccatgttgcccaggcttgtctcgaactcctggcctcgagtgatctggccactttgacctcccaaagtgctgggattatacctcacccggccaaatcatgccgactcttaaaaccactcattaccgctcatacttgagatttagtggtcccaaatagcaccaagagtacttcagggaggtggagaggagtagaatgtgactctgcacgaattaaatatttaaaactggcttacaaaagatactaatcatgggagctgtcacttctccctcaccctctcacacttacccttgttttttttttttggttgtttgcttttttgagacggagtctcgctttgtcgccaggctggagtgcagtggcacaatctcggctcactgcaacctccacctcctgggttcaagcaattctcctgcctcagcctcccaagtagctgggacaacaggcgcccaccaccacgcccagctaatttttgtatttttagtagagacggggtttcaccatgttgggcagggtggtctcaatctcttgacccttgtgatcctcctgcgtggccctcccaaagtgctgggattacaggcgtgatccaccgcacccagccttacccttgttttagaaagaaaaatagaaaatctttagagagctatctacgtagaaatagagaaaggtaagaaactgtgaaaagctttcgtcatcggtagttttcctacacctttgcccctctgcctccatgatgtcttcccttcgtgctaaattttttttggcagaccagtcagccatgtatgttttttaaccttgctgaatttcaccaatagagataatttgattaataaacatccagttttcaaaagtcttaagtttatgactgaatgatgtgtcagtcatgttcttaatcagggtatatagatttaatcagattcatttaatcctaaaagcaggagataatcacctaccattaagaaaatgacatttttgagcccggcgcggtggctcacttctgtaatcccagcactttgggaggccaaggtgggcagatcacaaggtcaggagtttgagaccagcctggccaatatggtgaaacccccgtctctactaaaaatacaaaaattagccaggcgtggtggtacacacctgtaatcgcagctactcaggaggctgaggcaggagaatcgcttgaacccaggaggcagaggttgcagtaagccaagatcgcaccactgcactccagcctgggcgacagagcgagactccatctcaaaaaaaaaaaaaaaatacaaacctatatgtgttcaaaaaatacacatgttcaagacctcaccaatagtgatttaattcagtagatctaataatagtaataattccgtcagtagctctagggtagaaactagggagctagatttttgttttaaagtttcatgagtgaatatccccagccagtgtttgaaacattgctggagacaaaaggtaatcattagttgtttgaacagagataatatttacaacacagccctttgggaagatgaattgaacaggagtgggcaggttgaattttggaggacagatgagagggagctgtgagatctcagctctggctgggcacggtggcgcctgtaatcctagcaatttgggagactgaggcgggaggatggcttgagcccaggagttcaagaccagcctgggcaacatagtgagactgcctctaaaaaataaagaaacaaaaagatctgaggaaccacacctgattcgcgtcttgtctgtgcagcaaatgtagcagtggccagcgtgcttgtgccagaatgctggtagactgggaagctcgtgaccttattccatttgctacaagtattttattttggagttatttctggccaggcgcagtggtttacgcctctaatcccagcactttgggaggccaaatcatgcctacttttaaaacccctcatacacctgaggtcaggagttcgacctggccgacatggccaacatgaccaacctggccaacatggtgaaacctcgtctctactaaaaatagccgggcatggtggcgtgaacctgtaatcccagctactccagagactgaggcaggagaatcgcttgaacccaggaggtggaggttgcggtaagccgagatcacgccactgcactccagcctggggtgacagagcaagattccgtctaaaaaaaaaaaagtgttatttcttagtaaaatagttcaatctgctttttcttttctgtttttctttttccgctgagttctgtccgcagaaaccgttctctggaacagtgcagattgcagattacgtttactacctccgccatgtcccgcccttcagatgtttgaagatgactcttagattccagtcccccaccagttcaaattagtcattggtgattagtcacattactttaatgactcattgagctaaaactatgaggtaaaaccattagctaaagcttttcagagaggtaaaaggcagacatcttaccgatttaatgagactcccagcattctgggctcgacacatggagcttagatgctagcggtgggagtagaaaggaagggaccattataagccatgtcaggatgcaaatgtttttaaaaacaccttggtgtcatactggatgtgctgctgtaggagttagggaacagtgaaaacacagctgagggtgagtgtaagttttgagatgaggagagtaattgataaaagtaggggaggcaccactagttgctagggcactgccctgcctgctactctaagaagggttcgggtaaaacttgcctatggctggctctgatttgctgtatgttgtgatgaggccctgcctagctaaaaccagtagtgatcagctcataatagtttccagggaagccttgctgatcacatttcgtaatctctatcttaatatccatatttttgagtttgttggctttttgttttagctgaaagtgtttttaaagtacgttttacagaaatcagctcagctcttaattctcactaatgacacttccttgccttttgaatgttgaccgcattcttcttaaaatagaaaagaaaggagtttttagccatccttggtgattgtaacttactagggaccatttggaattagtaagcctttctactcactcccaaacatcatcttaatctcctcacttttataacagaagaacccaggttccaaaatgaacaggactcaagctgtttgcctagaacctcacaattaaatgactcttctgaaatggatccctcaacacagagtaagttgataagcaagaaaatgttattctgccattttaaatttcacaatatttaagcaaaattgtggcttaaattatatttatagcatgtggacgccattttcccagggcactgataatggaaatcctaaaagggaggcagcaagattctctcagattcctcagtgggagaactgggtgcagaccaaattccaagtaaagaaaatgtgctgaatccactaaagccactccagttcttgagcaccagcactgctgcccaaaaacatagttggaggttctaacagaagtctctaactaggttgataatatgaaattcataactattttgacatccttgtgaaaaaaaatctcagcgttgtttttcaaagctattgcatagttgaattttcttgactctgttcatttgggctgggctccctccaacaaccattgaaaacatgtgtctgccctgggcactccgatggaattctgggccccagcagcagtagaatggccaaaggcaaatggcttcatgctgatgagctgacttttgatccctggacgtggttcattggagggtttggggttttttagaagggacagggtagaaacatcttacagaaatgtaatcacagcattaggccatccataaagaagctaacaatcttcccagtaaagtatattatttatttttaaaagggaggaggagaaaagacactctgttaaacttactttcaactattttttttcaataaaattgccatatagatgaagcagtatttaacaagatcttttgacttcttttggaagaacaaacttttatacaatgtcccaaaaagacgagctttataagaaatatgcctaataccaagtcatgagattccagtattgtgtaaaatatttttgctaactcacatttttatatgcatctataaattctgtgccagaatatgaattaaaccaaaaatcattcaagagtcagatgaagtatgagagattctcagctactctctattctgacatatcaaatggttatttggtaaccttaggttatttggcagcaaaatacaaaagcatgaaagttgtatttctttgggaggaaaaacagtttttcagaaattgaagctgactgactatttgaatatgtaactaaatttcagagaagtatatttttaagggcttttaaaaaaaatttcagtgttcactagcccctctaaatcagtaacgctcttacacttggacatgttgtagtattttaatcttgattctggaccttcctgatattagccaatattaaaaagcatttgatttacttatttttatttatttattggaaaggtaatcatggtatatatttcacagttttatgacttggaatgccttttctcattactattaagcatcattgtgaggaagcttacagttgcacaaactcaaattctctcttaaattaacaagctttgtttctaacttaagattgtttgtatcccaagtatttcaaagcagagaagttctctgttagcattcattcagtccaacaaataattatttggcttgtaaatggaaccacctagggccaggttatatgtaaaatttaggttttagaattgcatttcattatttgtttttacaacacatttatctttaaaataaatgctgtatcaccgctaacatcagaaaactcagcttttctaaattttaaatttcgttttcaagtttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcaccttgagacggtcgagagagagacctattttgcaatcagtgacattgatttttagattatttatttaaaattcctataaagatcagccctttgtacagaaaaatgtgtctataaaaattatgtgttatttaattctgatactttttggcttgtaaatggcttcttgaactttttacaataaaaatgttttagaaactgttaaagctgtgttaagctttcaggttgcagggaccagcataaacctcagtaactttagttgataaaggtttatcttaaagatgaatagagaaataaagaacaggaaaccatctcaacagctctatagcctggactgagggagaactcagcagcaggtggagagcgccagcagcgtggagtggcctatatcaccatcttcctgcccacccccgcctctgccagcgggaccccctctttgtcagggaccccaccggacttgtaacatctcatctctgcccagctccttctgccctctgcctgcttcttctggcagcaccgactgctcttcctccctccctccacttcctagctccagagtggggctgcttgtgacttcctgaaccttactctctaaaaggagggtagaaatacttgatatgacgattcagtaagatcaggcaggccagacgtggtggctcacacctgtaatcccagcactttgggaggctgcggtgggtggatcacttgaggtcaggagttcgagaccagcctggccaacatggtgaaaccctttctctactaaaaatagaaaaattagccgagtgtggtggcacacgcctgtaatcccagctacttggaaggcagggggaggggaatcacttgaacccaggaggcggaggttgcagtgagccgagatcacgccaccgcactccagcctgggcaacagagtgagactccatctcaaaacaaaaacaaagatcaggcctaaaaagttcctggcccagtgcttgacacatagtaagtatataatatgtagtactaattattttttctggggccacgaagcataatcttatggtttatcaaatattttcagcaaagtgctctcttgcccaataagcaaagttctaaaatgatctcctggcattatacacggcattggtttcccaagagtatttttctcagcctagttttccatacgtttttaggtgactgcaaacatatgcctgcatgggccaagctggtgtgtgttttttgacaacaggaatcccaggatatagaatatgtagagtgtgatgggaactttggtagactagaattgcctgctcaccggaaagcattgaaattctaaaattctgtggttctgccacccagaaacagctgtctattgcagttttttacctctatttcaggtcctctttgactaggatttatacctagtcaggtctcttttgcagctacacacgccacatacgcatacaaaaccctcttttttatatatagaactgcagtagttaatttttgaaaaaagttcctgttcattcagtgaaagtgcactatgaatgctctcacccaaatgaagttctttttatcacatgcttccagttgtctctgagcctacgtttctccagtaatcttgatgcaatcactgccttagcacgtttcagatacttggttgaatcccctcagtcatatgtgctttgttgacattgcaaaggttatcacatttaatgaaatatgtgaaagacatttctgattatttcttcctgcttcttgacattatatcttcaatcttcaatttctttataatgtgaattctctggaattgaataggggctgaacttggctaaaattccttgctacattcaaaaagtttctctccattactcccttgagtttgttaaagaagagcggtccctataggccttttcatatttattacatccataaagtttctctctggtgtgaattctgcaatgttggctaaatgttgggcttcagctaaatcactctccacattgggctacatttggaaagttattttccaatatgaattcagtggtgctaaataagttattaagttggttaggggccttttcaaatttatttacattcatagagtttttctctagtatgaattctcccaggttgagcaagatttcggcatttgtaaaggtctttccacagtcattgcatgtgggtcgttaacagcagttgactgcaaggactgcataaggcttaatttattaatatgggtgtgcttatctgagagtctggatttaatgtttaatctcattgtatcagtctgggtccagtcaggaagcaaactacacagttgtttggataaggaaagtttaatgtaaagactaaactatgatgggagcaactatgaagacgtaaagagaactctacagggtatgtaggactgaggagagtactcaaggaaggacagacttggaagggaggctcctccctcccccaggcttaggtcagacctggtcaaagaaggtgtggttgcagaccactggatactggggagggtctcagagttggccaggccaggggtagtccatgtccccaggcagcaggaaacaaatctgggcacagaaaatccaaggctggtaaaaatgcacagggaggcagggcataaggaccccgcttgtcagggtagtgtgcaggctggccatatccagagagccacaagaaaccaccctcaggcacaggcaaacaggccagcaggcaggtgctcagagtgcatcagggtggtactgctggcatgagacccggaacatgccagtgtccatgctgggaagactatagtgacatggtcattgggctaggactgtgaagtcataaggcaattgtgcacactaggcacatggttggggcagagcacgactagatgtcccccatgcacacgcaccactggtgggccgtgaagcaagagcaagagtaagccaaacagcacattggagcaaggaagagaagccttgtttctcctgcagtgtccttccagcaccctctattgacagctcagcatcatgcgcattgtaaggagaaatacctcaagagcccagcccatcactgcagacctgagatgattgataactgccacgcttataccattgaaagtggctccacagtttacttggttggttgacaggaatgtggactcaatgttggcctctatctaatgagacagatgccagaatttccctggcatgatgtggatgcaggtatccaaaggctcagggaggtaggaatgtaggggtggattgatcacatctggcctcctcactcacctcccaatgccatgctctgggcccaaaagctacttcctttatgaaggcactgaacaaggagcacccccaaacctgaaaaactctgtggtgactcatgcaacaagacatgatggtgagagatgccaccaccacagatgtgttccctggtttcagtgggaataatggaattctggggcagcagaggccaggcagaagcatttaattaccagacaaccatttacagtaaagggcagcagggcggtagtagtagtaaaggatttggggctactggtaattgactacactgtccctaagaatgaaatagataggcagcctactaaaatgttgcttgagatatgtaacaggaaaaactccagacctggtagccgaaaaactgactcgagtcatcaccatggagagtcatacctgtcacccagtttccagtatgaaaataattctcagatccaaagcctcttgattgaaggggaggccaggtccccctgaggaaggaccctgaagcagtgccacatatacatgcttacgagtattctttaacccttccccaaagaaacctcttgccatttacttgaaggattgcatactagggaaaagaaaacacccatatctcacagggattactaaacatggtttctgaattgacactaattactatggcctaccagtgaaagtcacagctaatggtggtcagttgatcaaaggagtcttgagcaaagtttgaattacagagggtgaatagggccatgaaaccaacccgtggttattttctgagtacctgaatatatcattgaaataaacatacatgaaaaatggcagactctcctcgttggcactaagacccattgagtaagagctattatcctagaaagattcaagtgaaagcccctggaatttcctccttaccaggatagtaaacctggttagtaaaaagttatcgcaattatccccaggggccgggcgtggtggctcacacctgtaatcccagcactttgggaggccgaggtgggcggatcacctgaggtcaggagttcgagaccagcctggtcaacgtagtgaaactccgtctctactaaaaatacaaaaattagccgagtgtagtggtacgtgcctgtagtcccagctactcgggaggttgaggcgggacaattggttgaacctgggaggcggaggttgcagtgagccaagaccatgccgctacagtccagcctgggcaacagagtgagaccctgtctcaaaaaaaaaaaaaaaaaaaataccccagggaaattgaagagactcatgccaccagcaaagagttgaaagatgaagggctggttatagctattccatcataatttaattcgctgtttgacctgggcagaagggagatggatctttgagaatggctgagttatcaagaacgtagcaggtgaggaccgcagtagcagcgtctgtttcagatgcagtcatgacacagcttccggcatatggtataccgcagctgcctgcatgagctccctgacacccctctcccagaccctatcatgacctgcatttccggataggttcagtgcccaccgctggcctctctcatcaatgctgcctacccatcccgcagctccctcgccggcccacaccgtgttcccagccactcctctgttgcctccattagacggccttgaactcggccgcgctcgcagcgccgtcctggactgtgaccacccggactcctaccctaacccagagctgtgcgcgacaccccctcctcccccccgcgacggccagtgcccaagggcaagggcaagggcaagggcgagggcaggtcgagcagtcggggactgctccaggcccttacacgtgctctttcctggacactcgggccgcagtgcgagggtggtcttggcgggggtacttatcaggttcacctggtcccaggacactcgtcgcagatatgtcttttccccttgttgtcacccccggactttgacaagcaaacaacgcttctttccggcggggttgtacggacagcaaacaaaattattgtgccccgtgtgaggatcgaactcacgaccttcagattatgagactgacgcgctacctactgcgctaacgaggcacctagtaagggtttccggacggatcattctgaggctatacagctggtctgctgcgcatgcccacttttacttttactgctgctgtaaatcccgtccagaatactcggaattctagttccgctgcgtcctgcccctgtcccgtttgtcaattaacaaacactgtggctggcttgtcaatgcctcactgggtagcgacgacacggagaagggggatttttcctcctattgttgtgaaccgttatttttgtgtagtgcgtacaaaccgtttgcacactcgtgaacgcatgaaacacttatcaggcacccactgtgttcccggccctgtgctgggtgctgcgttcacaggaacaaacccagggtcaaggagttgggcgaagatgcataacgattggaaaacacacacgggcgcgcgcgcgcacacacacacacacacacacacccgctgttacggcccccactgcagaccccagatcccgccagtccccggactcctcccggcgccccaggtttccacggccgcctgcagctcctcggctgaggctgcgcttcgtaggggctgccgggctccgggacgcagtcctgcagtctttttctgactgcaggactgactgcaagactttctgactgcaagactgcaggactgcagtctttttcaccaccattcctgtggccagtgccctgttgcacacttgagctgcttctgattttttcttccttttttttttttttttttttgctgttcaaacaggacttcaggaataaccgtggaagcggtgagttaatgtgttaactgggaagcccgctctcctttccctttcactcccctccccttcctcccagccctttatataagctcatttacctacattattgctaaaggaaactgcgtgcccctatcataaatggaaaacaggtaagggtttttccctaacacatgttcagataaatacatacataactattataataaaaaaaaagactcttccacttactgtctaaaatcagccagacagtggcacattgaggatttgtacttttcgccgtatgtacatttatacggcgtttatacggtacatttataaaaggaaattgagacagaactctgggcaaggccaggcgtggggacccctggggagagtgtgtggacgcccgcgggtctgggtgcctcccagggaaaggacgagtgatggacagaccgacggaaggacagggagtggggagaggttcgtgtggacctaggtgggtgtgcggatattcacggcacaactctgtcaacttttctgtttgtctgaagtttttccttagaaaatattgggggtggaattttgttaatcacctagaatttgagagatacggcggggtgttaagggggcaaaaggcagtatgagtacaagcaggtagggacataccatcttgacagcaggcaccacaattgctgaggataggcgaagaggaatctcggagtggatgggggtggggcctgctccacctcccagtgggagaaggactgggagctgccgggcgggtggccgaggggcgaggaaggaggagttggaggtggggcaggctgccgggaccccagacccggagactgacacccagtcctcgggaagctcctggatcccacggtctagggtgggaagcccaggacctctgccagcctcgggaagcgcgcatccacacgcaccggcgggaatccgacccagggggcttactccctggtaaggttgctggggcatcccctgcggactgcggactgggagtgtcacctagatccagctgtttctcccagatctgcaggcccgaggagatgctgattaacatgcagattaaatcccaacggtcctgtctaccacaattacaaacagccccactttcgggtgtagcagtcccaggactggcaagctacccaacatattaactcaccacttccacagttattccctgaagtcgtatttgaacaggaaaaaaaaaaaaaaagaaaaagaaaaaacgaaaaggaaacaacccaagtgtacaacagggaactgactggtcacaggcataatggtctgtccaggctgtaaacaagaaaaagggatgctgtatgttgtgacatgaaatgagcgaagaacacaactgcagaactaacaagagtatgagactatttctgtagaaaggggtagatgtttatatttgctagtatttgcacacagaaagctaagattgccggacgcggtggctcacgtctgtaatcccagcattttgggaggcctaggcgggaggaccacctgaggtcgagagttcgagaccagcctgactaacatggaagaaaccccatctctactaaaaatacaaaattagccgggtgtggtggcgcatgcctgtaatcccagctactcaggaggctgaagcaggagaatcgcttgaacccgggaggcggaggttgcggtgagccgagatcgcgtcactgcactccagcctgggcaacaagagcgaaactccgtctcaaaaaaaaaaaaagctaagatcaatgattaatacgctgaggggtggcaactgtatggttggaggtaggggtgagaggaagactctttttaaaaaaaatacactttattttctaaacagttttagcgtcacagaaaaattgcaaagataataagagtctccataaagcctgcacccaggttcacatattattagcattggtcgttggtatgggttgtttgttacaagtaatgaactggtgttgatgctttaactaaagtccatcttgactcagatttccttagttttcaccaggtgtccgtttttctgctccaggacctcatccatgacacattacatttaatggtcctgtctccttaggctcttcttggctgtgacaatttctcagattcttcctgggttttgatgactttgacagttctgaggagtactagtcgggtattttgtagaatgcccctcaattttaacatttggctgacagtttttctgggatgaagacttttcactgtatacctttgaacaggttttttaaaaacatacttgaactatgttaatctataagctatttaaatgttgacgtaccttaatttaaaaggcgaactgtaggaattagaagaaaagggaggagaggaggggagggagaggaagaagggaagttggggaggagaaggagaaagagagagagaaagggggcaggggagcaggaggagcaggaggaggaggaggctacctggaggggctgggctgatcctgccttgggcccactctcccggcgacctcccggctcccagacctggctgagcccggcggccgccaggggacgctgtgcccaggggttgccgccgctgccccgcaggtttcggctttttccaaattagcctagggacacaccgcgccactagccggtacagggtaccaggcccgatccccacgccaaggtggccccatcacccagacctgcccagggaagggaggtagaacaggagttgggggtgggggcggtgcagatatttcgctccgtaaagtgtctccagcttttaaagatgtatgtccccaattttccaagaccttctgagccttcgagtggaatgaaactcgaacggcttcccagctgcggcgatgaggtcccgctcctgcagaatcccggcaggagcggagactcgggaggggaccgctggctgcaggcgccctgctggagtccggaacgagggtggtcagggtcgcctccccacggggtcgcagatgagggagtggggccgcgcagggaggctcctgcaggccgtgacccccaggcctggcccgtagagagtgactgatggcgaggacccgctggggacccgagggcctcagcctgcgcctgcgccggggctccccgaccaagaccttccggcccccaggcctttgcaccggcagctctaggcctgatgtgtcctgccctcaggcccctctgtagagacggggatgtcttccttgccctacgtcagccgggtcggaggtcacctacccccgcgaaaacctgatccccattgccttcatctgcctccttctcccaccctcctccccaggctgaacgcgctccttcctcccagctaagcgccttgccggcggtggctgatttacttccactcctagagcaacccgaagggctcagtgcttcaattgcccctcacttacgaaagcgaaactcaaactcaaggtcaggcgacctgaccaagttcaaacgatcaccgccccccttctcagcagtttccaaatccttttcctcacttgcattccctaaaataatgttgaaaaacttctgggcatctcctctcataatgttaagttgatatcaaaacagtttcattataaacaattgcaaaagacgtaattaccagtgtatgtaaatggtgatttttttaaaatataaaattgagtatatgacatttaaaaatatacccaatgggcccggtgcattggctcacacctgtaatcccaacgctttgggaggccgaggcgggcggatcacctgaggtcagaagtttgagaccagcctggccaacatggtgaaaccccgtctctactaaaaatacaaaaaattagccgggcgtggtggtgggcgcctgtgatcccagctactcgggaggctaaggcaggagaatggcttgaacccgagaggcggaggttgcagtgagccgagatcgtgccactgcactccagcctggataacagcgtgagagtccgactcaaaaaaaaaaaaaaaaaaaaaagtacccaatgacatctatatatgctatggattccatacaaaccaaaatctattttgaatatatataaatatgtctcccaacatttggaaagtttacatttaactgcctccttgaactcatttccattctacttccccccacagaatactatccccctacagtacatattttatgtttgaatgcgttcattgatcacctagcatgcctctgagcaacaaaaaatagagtttattagaagcccattttacagagtggaaagtgtatctgtgtgtgtgtgtgtgtatgtgtgtgtgttctgggaggcgggctcctggctgactgagcagggtaacttaatggaaacctgttgagagtgattccttttcccttgcggcaaatggacccaggcagggagacccccagcacacccaggcaaccatccaggcccaggtgatgaaaacacatcctggcaggtggttacagagagctaaaggagggagccatgtggaggcacattccacagacacaggacttgggtctggctgtcaagagaagccaagtcactccaaacagggatgagcaatgtccagaaacattccagtgccaccgccggggaggaaagcaggaaagaggggcctgtttggatgaatgcaataaattctggttttgcttattttcaattgcacgaataatatgtactaattataaaatatacgcatacagccatgctgtattagtcagctcttactgtgctaatgccgcttaacaaaccacccaaaacgtaatggcttaaacagcaagcatgtgttttcctttttcttttctttttttttagatggcgtctcactctgttgcccaggttggagtgcagtggtgcaatttcagctcactgcaacttccgcctcccagattcaagcgattctcctgcctcagcctcctgagtagctgggattacaggcgcgccaccacactcagctaatttttgtatttttagtagaaacagggtttcaccatgttaggcggctctcgaactcctgatctcgtgatctgcccacctcagcctcccaaagtgttgggactacaggtgtgagccactgcgcccggcccattgggtatatttttaaatgtcatatactcagttttatatatactcggcctcccagagtgctgggattacaggcatgagtcaccgcacctggccttttattttttaaacagctttactgacatataattcacataccatataattcacctattttaagtgtacaagtaaatgagtttggttatcctattttttttaaattgtggtaaatatatgtaacacaaactttatcactttaaccttttttttttttttttttgagatagagtcttgctctgtcacccaggctggagtgcagtggtgtgatcacagctcactgcaacctccacctccccagccttagtgatcctcccacctcagcctcccaagtagctgggaccacatgggcgtgccaccacacccggttaatttttgtattttttgcagagacagattttttgccatgttgcttaggctgatcttgaactcctaatctcaagccatttgcccacctcagcctcccaaagtgctgggattacaggtgtgagctactgcacccagcccattttaaccatttttaaaaattttttatttcaatacctttggggggtacaggtggtttttggttacatggataagttctttagtggtgatttctgagattttggtgcatccgtcacccgaaggagtgtacccaaagtgtagtcttttatccttcaccattttaaccatttttaaagtttataattcagtgacactaagtacattcatagcattgtgaaaccattgctactttctagctccaaaactttttcatcaccccagacagaaactctgtgctcattaagcaataattcctcattcctcctcccttagtgcctggtaacctctaatctattttccatctctatgtatgtattctagatattttatataagtaggagcttgccatatttgtctttttgtgtctgacttgtttcactcagcttcaggtaagcacgtctttttcttgctcatgaatctgtgtatcagctgggttcagctccaggctgagcctgggttcagtctgctcttcaagtcttcgcattctccttggaccagccattcactaaggtatattcttctgaaagagtcacaacagcccaagggacaaagccatgccaaggaggcacatttaaggcccctgctctgggtatatacatcaaaactcccttggcccaagcaagtcacatggccaagttcaacattactggggcagggaaaaatactcagcttactgtggcagagggtgcagagtctcaggccaaaggaaaggaaaaagaatgaagaataatccaggccaggcgcagtggctcacatctgtaatcccagcacttcaggaggctgaggttggcagatagtttgaggtcaggagttcgagatcagcctggccaaggtggtgaaaccccacctctactaaaaatacaaaaattagctggacatggtggcatgtgcctgtaatcctagctactcaggaggctgagacaggagaatctcttgaacccgggaggtggaggttgcagtgagctgagatagcgccagtgtactgcagcctgggcaacagagcgagactccatctcaaaaaaaaaaaagaataatccaatgtgccacacatatagatgtacacaagtcaagtcccctcaagtcactcctaatactgttccccttccatagggaagccctgtgagtggtcttcctacacacaaacataaaaataaacacttgggttttaggtatctatgtaagatcatatggtacttattgttctgtgacattttccacttaacagtaagctggacctctttccttgccaatacatagatatcttccctgttcttagtaactgcagtagtgtctctgaggagaggagatctggatacagatacacacagagagaagatgataaggagacccaggaggaaggcggccatctacaagccaaggagagagaatgcagaagaaaccaatcctgtcaacaccttcaacctagcctccagcattgtgcaggaataaatttctgttgtttaagccacccaggctgtagcatttttgttatgttagccctagcagccctaggtcttctaattctagaacatctcattcttcccaattagtaacaaatactaagtgaacatcttatgcatgtatttgataacaaatgtctacggagcttgtggacagccaaaaaatctgtgctgtcctagattcggcaggtttgctctttcaccccagggaacccagaataattttccgtctccctgagggtgaggaccggaagccccgagaatggcctaagccgagccagggcattcacaggcatcaggagctggggcttcgcttttcactcccggcctcttcctgcacttccatcccaccccgccacaggtcactgtctccatctgcttggcaggggtcacagctggactgtgggctgcatctggcctggccacagccacagcctggctttcttgaaacagttctctgcaggggctgctccagctggagggacgtcagggtgagttggctccagaatctatgcacaccatgactcccctctcctttccagttctctctgcttaaaataatagccgggcgcggtggctcacacctgtaatcccagcaccttgggaggccaaggcgggcggattgcctgagctcaagagttcgaaaccagcctgggcaacacggtgaaaccccgtctctactaaaaatacaaaaaattagctgggcgtggcagcgtgcgcctctggtcccagctactcaggaggctgaggcaggagaattgcctgaactcgggaggcagaggttgcagtgagccgagatcacgacactgcactctaggctgggcgacacagcaagaccccatctccaaaactaaaaataataaattaaaataaaataaaataataaaaataataaagatacagagggagtcgggggctgggtgaggggaaggattatcagggccgggagggggctggggaggaagggcctgtggtgggtttcagttctcctgtggagctttgggaagcagcgaaggtttcccgggtctggccttttccccgtaggccttggtgacatggcaggacttggcggtaagcccaagtgtctcagctcctcattctggctgtgacaagccagctgggcaagctgagggaggcccagggagcctggatgtacagagcagggagcagggttttctccagacgtgccctgcaggaagcagccagcagttcttttgccatctgtgcaggggagcggaaggccatggtcctcccagctcaacttcctactcaacaagtggccggcgaggtgtgagtcagcctgttgttgctggacgggtctgagagccatcgctctgcgtggtgctgacagaggacccagaagaagaaggaaggcctcgcccctgcaggcccagatgctcccagaggggctccattgtccccacactgtggccagagggagccgtcataaaagctaacgtgtcctgctgaacagcctcggaagctcccgctgaccatgacatcgaagccagggtgcccacgtgcccttgcgggctcacctcccagcccatctcttcccactcctcccccaccccataccccacggaatccccattccctccaccccacccacccggctgatgactgtcctgctgctctcctctgtggccacagagaggcctcctgagctggctccctgctgctcaccctcccagccctgtactccccagaccttagcctcatcaccgtgcggtgccatgatttctcagttactgccgttcccaccggatcacaagcaccaggcacacagcaggggccatgcggtacccactgtgcagagcccatggtgggccctcgagcatttgtgtgtttgatgactgcatgcaacattttccaccctgcactgtaatggctcagcttttcttgaaggcagggactgttgttgattcatttctgcatccccaggttttagtctgatcagacttattttctagttccaaaggcgtgcaggctctgatttctgtaactgagtaaacctttccatggactggcccagagtgggctctaaggccattgccctctctcagtatacttggtggggagacagcgaggccccctagccagaggagaggaaagagtgacaggactcacctcacagggcccttctgacaccttctgactcacctactgacagatgagataagtcggagtgggtgtgttcccagcagccctggggccccaaggaactgtgggcctgctccttccaagttcaggcctagaacaacacagtggttctgcccacagttccaacaggtataacagcaacggggtaatagtatgtgtccccatcaccccaggccagagccatgagaacacagagccatgaggccccctccttcacaaggctactgggtctcatggttcttatctccaggagccaggcacacagggactgggctgtctgagtaccaagcctttgaaatcatatcacgaaaatctatccctgagcctatatctcaaacatagcgtttgtgcctgaaattgcacaattggattgtggcagttgcatcatctggctcatagtttaaggcttagaggtttcactactttagatgacagctcgatggcccaagggagaaagtctgattacaaagtggcatttactgggaggtccaggcccccaaaagggattgatctgggggtcccagaaccaggactccagcaacccccacatacatacacagtaggcactcactgagtgtggaatgaatgcatgatataagtttataagtgaatgcatgatataagtccatcggccttttaatattcaaacatctgcccccacttcacacacacacacacacacacacacagagagagagagagagagagagagagagagagagagagagagagagcaggtcttttcttattgaagggaagcagggaattggtcacagtgagttgattcatccttacaatttgcaagtgactagagccaaagaggggtgtaaaccagaatcttctagagcaagtttgtccaacccgtggcctgaggactgcatgcagcccaggacagctttgaatgctgcccaacacaaattcataaactttattaaaacattatgagatttatgcacggacccttttttttttttctttttttagctcatcagctattgttagtgtcagtgtattttatgtgtgtcccaagacaattctccttcttccagtgtggcccagggcagccaaaagattggacacccctgttatagaacattgcctttctctgcaaaaagaggcagtcggcaagagttggcaatgagggtggcgagaggttgtacagtacacataaaaggaatacaacccacttggtccacagaaggggctgaagctggtattctgttctcccttgggacagaggctgctggaaggtgaccagatgtttcactcaacagacattgatgaagtgaagctatgagacagccactgggattaaactggtgaacaagacagacatggttcctccctcattaagagacattatgtaggtaaacaaatacataaatgagctaattccacattatggtaagtgctgtgaaggaggtgatgagagttaagctgaagcctaatgaataagttctttgttgcagacaacagaatccactctagctagctaagcagaaagggatttgttacagagtgttaattcattacagaatttccaggaggatcagggaaccatgcttggatgccacaaaacaaggacaacccagccaggaggaggcccagccacaccatgggacctccctgcttcgactctcacctccccctctgacacacggcctggcaccagcacttgctcctgtctaagctgctgaagaagaaccaatacctgcatgtgacctgctcagatggctcatgtatgccttccaagtcatgcggggatgctcctgcttgtcagacccaggtccgtagaagagctctggctttggggagggctgggaaaaggctttttttttttttttttaatggagtcttgctctgtggcccaggctggaatgcaacggtgcgatcttggctcactgcaacctccgcctcccaggtccaagcaattctcctgactcagcctccccagtagacgagattacaggcatgcatcaccacgcccagctaatttttgtatatttagtagagacggggtttcaccatgttagccaggctagtcttgaactcctgacctcaggtgatccacctgtctcagcctcccaaagtgctgggaatacaggcatcagccacggtaccccaccagggaaaagacattttgagcttctcagatgccttggaagagaaccctcgagggaggttgcagggaaccccaaggtatctaatctacactgttgctgcaacacacagcaaaatggtaacaggtttttgttgttgttgttgttgtttgagacggagtctcgctctttcgcccaggctggagtgcaatggcacgatctcggctcactgcaagctctgcctcccaggttcacgccattctcctgcctcagcctcccgagtagctgggactacaggcgcccgccaccaggcccagctaattttttgtatttctattagagacggggttcaccgtgttagccaggatggtctcgatctcctgacctcgtgatccacccgcctcggcctcccaaactgctgggattacaggcgtgagccactgcacctggcctgtttttgtttttttttttttccgagacgaaattttgctcttgttgccgaggctggagtgcaatggcgcgatctcggctcaccacaacctctgccacccaggttcaagcaattctcttgcctcagcctcccaagtagctgggattacaggcacgaaccaccacgcctggctaattttgtatttcttagtagagacagggtttctccatgttggtcaggctggtctcaaattcccaacctcaggtgatctgcccacctcagcctcccaaaatgctgggattacaggcgtgagccaccacacccagcctaactattttgatgtccagtggtgcagctatgaaagatgttctgttgctttttaaaatttttattttatttgtttttgcttgtctgtttttcccaaatttttacaatgaacatgtaatatttacaaaacaaagtgcaaacgccagtagtgttattttcaaggaaaggagacacaatggagtcctatggaagaagggtttcccagcccagcttggagggacaggccttctgattacccctgccagcctgagggccactttgggcaggttctgactgtttgatggcctgaactatttactattcatgagaatcatctctaagttgttaacgagatggcgttgggatgagctccttatacattccttcctgtgccgtctgacatcttcaacctttcctcgcccccactcacagctgtatgtgtgtgtgtggtgcagggggcttcagtgctattgctccccacccagcacccagacaaagctagggtggctctgggagcttattccagtacagtgtgtgtgagacgttgtgatacaataagaaagacatatttggtctttgtttccacttcccagcacagagctcctgaaaccctggaatttcctgagtgacaggggtgataggagtaccttttgttgtaatatttggtcttagtcctccgttcctgatacaagagcttctaagaccctaggaatctccagagtgacaagggtacctttttgatgaaagtaagatgactggtggctgggggcccctagatagcttcagaatgggagctggtcatgagaaagatcaagacatgattagatagctggaactttcagttcctacccctaccctctggggaggacagaggctccacaaaaaccctaaacccagttggtaaacacatccatattcgaggaatagggtgcaccccagctccacaggggcagaaactcctgtgggtgggacccttctgcacctcaccctttgtaccttttcatcggacagttcatttatatcccttatgataatctagtaagcataagtaaagtgtttccttgagttctgtgagccattatagcaagcgaccaaatgagaagagaggattgtgggaactcctgatttgtagccaagccagacagaaatgtgggaaaacctgaggccccactgcttgcagctggcatccgaagtgggagtggtcttgttggactgagcccttaacctgtggggtctgtgctaagtccaggtacttagtgtcagagttgaattaaatggcaggacacgtctgggtgccgtggctcatgcctgtaatcccagcactttaggaggctgaggtgggtggatcccctgaggtcaggagttcaagaccagcctggccaacatattgaaacactgtctctactaaaaatgtaaaaactcagccaggcttggtggtgggcacctgtagtcccagctactctggaggctgaggcaggagaatcacttgaagccaggaggcagaggctgcagcgagccaagattacaccattgcactccagcctgggtggcagagtgagactctatctcaaaaataaaagtaaattgcaggacatccagctggtctctgcagagaactggataattgctgggtgtggaaaaacccacacttttggtgtcagaagtttgctgtgggtgaagaaacggtcttcctttagtggacttccccaaaaagcagttagtcccttctgaattcctgagcttctgaactgggtcctctggtctcggccaggtgctatgctggatatgaaagagcagaagttattatcttcgttctagaaaaagagacaatttcaccagagagacaaggcacaagttagatagataaacacaaaaaactccccaaatgatgcaactagatgggacttcggggatttaatatttttatattacaaaaaatattttaatttggtttcacaaataatgcaatgtgagaaaactaatttccttatgctgtcacccaaggctggcttcatgtgtgcagtcccacaggccccacattcagaaggaccccacacttggtttaatactctgttgcaaatgtctcaaaattctcgatgatttgatcattgaacttggatttcataagtgaggtctgatgctggtgtgaacagaaggataagtgaactcgggcatctagagtcccttgctgacccatccccatatagcattcacattgtcctgtgagcacttaattccaggagacccatgatgcatgggaggtcagcgagactcaaagtgagcacaaggtaagtgttctacctctgtgactcagtgggtgtgacagagctgagaagccacactttctgttcaaaccgcaacttgcctaaatgcagaaaaaaggcaatggcgttccaagaaacataaatgaccaaggaattctaccatatgctttcttacttgtgttgtttcctcacactgaccaaccaggttacactcaaaatgatgacacagaaagaccaagaaagataaggctgccaggcctggtggctcacgcctgtaatcccagcactttgggaggccgaggcagacagatcacctgaggtcaggagttcaagaccagcctggccaacatggtgaaatcccatctctactgaaaatacaaaatttagctgggtgtggtggcttgtgcttgtaatcccagctactcgggaggctgaggcaggagaatcgcttgaacccaggaggtggaggttgcagtgagccgaggtcatgccactgcactccagcctgggtgacagagcaagactctgtctcaaaaaaaattaaaaagataaggcaacccaaagtttcttttctgctctgccgttcttattcatcagtaagccaaaggtagagagtgttggtagaatgtgtgcatatcaagaagtgaaataaaaatagttgagctcattttgtgaagcatttctactttctggtaagaatgaaatacatatgcatgtacaaacaaaatatgggttgtgtaatttcagtaattccatgtacaagttaaacactctgatatttgcatttaaaatgtcattgcacaatgtaaacatgaatgctaacaatcttttttttttttcctgagacggagtcttgctctatcgcccaggctggagtgcagcggcacaatctctgcttactgccacctccacctcccgggttcaagcgattctcctgcctcagcctcctcagtagctgggattacagacatgcgccaccacacccagctaattttttgtatttttagtaaagacggggcttcaccatgttggtcaggctggtctcgaactcctaacctcaggtgatctgcctgcctgagcctcccaaagtgctgggattacaggcatgagccaccatgccccgccatattctgtatctcgaccatggtggtggttacacgactgtatgtgtttctcaaaactcagagagctgtacactaacaagggtacattttattgctaataagttatactttgatttaagtttctgcaatgtcctaaccaaccatcagaggtcccacggtttttatgcatgtcggaaattctgagcaatggaatggggactctgaactgggaaactccagagggcaaaggcatttgcagctgtggctctctgggaatggagcagtgcttttgccagatgctgaagatggaatcgctgaggacaaccctgcagagacacggctcccatgaaaagcaactgtaaggccaggtgtggtggctcatgcctgtaatcccagcactttgggaggccgatgtgggcagatcactggaggtcaggagttcgagcccagcccggccaacatggtgaaaccccgtctcaactaaaaatacaaaaattagccgggcatggtggcatgtgtctgtaatcccagctactcaggaggctgaggcaggagaatcacttgaacctggtaggcggaggcttcagtgagcctagattgtgccactgcactccagcctgggcaacagagtgagactctgtctcaaaaaagaaaaaaaaaaaaaaaaagcaactgtaaaggacctgtggatgggggagtggggtctagggtgcccggcaggacaccctggcctgttccagctgccactctctgaccttgcctgccagcagaggccagcgctgcaggggctccttggcctgccttcgctgagctgattttaggcagaatggattgattgatgttgacagggagctatttacccgtctaattaattatgccaactaattttcaacttaactgcacttctcgggtcattgggtaaggagactgtatgattttcatgctgctgcaggccttgatgaggaagtggcaggagagggtggcagctgctcctggaggtcaaacaggcaccctgttcctccacgtcgctgtgtccctggcctgactcctgccccgtggacaagctctggagtcctatttgtgtgcattctatccgcgtgagctggcctgtgattcaggagctttttgctgtctattcacctaagtgctcattcggtgccttcgacgtgccagccccaaactgggataggcacttggagttccaagaagctaagtcatgcctgaccccacccccaccccaaattgctcacagcctaaaggaggagattcccgcttaaaccagcagttacagacaaacgcaatccaggctctgtcatggggcccttaaggaatttacttaacctccctgtgcctcagtttcctcatctagaaaaacattaccgggctgcgccaggatgcagagtatatgcaacaggactatccgtccctgctgctgccctttctacccgccctgcccgttgtcttgtagattgtcccatgttctggatttttctgattgtttccttctcatgggatgacctaaaaaacatttttttttttgagacggagtcttgctctgttccccaggctggagtgcagtggcacgatctcggctcactgcgagctctgcctcccgggttcacgccattctcctgcctcagcctcccgagtagctggactacaggcgcccgccaccacacctggctaattttttgtatttttagtagagacggagtttcaccgtattagccaggatggtctcgatctcctgacctcgtgatctgcccgtctcggcctcccaaagtgctgggattacaggtgtgagccactgcgcccggcctaaaaacatttttttaaatcaaaagcttattgaagcagtgcaaaaccaatacaaagtatttcctttctccttctcctcctcctcctcctatttctttttcttcttcttcttctttttgagacagggtcttgtttcttttttttgagcagggtctcactctaccacccaggctggagggtggtggtgtgatcatggctctctgcagcctcaccctccacgactcaagcagtcctcccacttcagcctcccaagttgctgggactacaggtgcatgcaccaccacacctggttaatttaaaaagaaattgtagatatgagggtttcactatattaccaggctggtctggaactcctggcccaagcctcccaaagtgttgggattacacgtatgagccactgcgcccagccatttcctttcttttgaaccattgagagaaagctgccgacagaatgtgccatcatccctattattttttgtgtgtttcctacaagctaggattctctcttacaaactacaaatcaaccatctatattgggaaatcaacagtgataaattgctgccctttaatcctcaggtcccctacaagttctgccaactgtcccaatatgtctttcgtagcaaaagaatccagtgcagaatcacacgttacatttagttatcagagctctttagtctccttcaatatggagcagttccccagacctccctaagataatggctttgatagctctgagatgagagggcagttactttgtaggatgtcctcgcatttggctttgtctgatatttcctcctaattctattctgatcatgtatctttgccaggaacatcacagaagcgattctgtcatcttgttgcatcctctcaggtggctcaagatttcagtttgtccctttttgatgagggtcactttgatcacttgattagggtggtgtctgataagtgtctgtgttgtaaagtttcttgttcccctttgtaattatcaagtattttatggggagtttatttttattttattttatttttttgagacagggtctcattctgttgcccaggctggagtgccttgcacgaagatggctcactgcaacctggacctcctgggctcaagtgatcctcctgccccagctgcccaagtagctgggactacaggcacgcaccaccacactaatttttttttggtagagtcgaggtcttgccctgttgctcaggctggtctcgaactcctgagcgcaagcaatccacccaccttggcctcctcaaattctgggattacaggtgtgagccaccacgccctgtagggagtttatttgaaactttatcccattccttctcaaactttcaaaatctgtattcatttgtattaatctggtcttgtggtttcctactttatttcatgcattataatcctttatggccatgattttcatgctcagattgtcccaggtaagccagtgggaaccccttcaagctggcttctaggtctttttgacatggcctcatcactctttgaactccttcctgctttctggcatcagatgctccatgatcactttgtactttgtctgctctggacttgaaattggccatttctccaagaagccctgggcactaggtacacacattgcagtctgagcatcgctgttagcagacagaacaggagaatatatatatatatacacacacacacacacacacacagagatatgtgtgtgtgtatatatataaacacgtatatgtatatatatttctagaatttgttttctgtatttatattctattcatttataatatatattatatattcagatttattttttatctaagtttatctatctgtattgaaagctgtgagttcaaatctgtgtctccaattcatatctaataagtccatttcagtttcccccttttctctacatgctccctgctctgacaataagaaacctggtttcccttacctttaatctctttatttgctcaatgctcctgtatgtaaccaatctcccacctttccccacctcctccagctagagctctgacaccccttacaggcagctcccctgcccacatggacaccctctttgccctgtttgggctctgactggcccctgtgaggacacaccctcacaccctgtgcaggcattccctcaacccctcagccccctgcacctcctcacctggcctgggctccgacacatgctctgagccaccaagcccattcccaccactgacacccatcttgctctgacccacccagtggctttaggactgaattgttccagaagaaaagagaggggaggtgtggagcagggaagcgtgcacacttttaatgacatggaaaatacacttctgagtaatgctaagcaaaaaagaaggcaaaatatataaaattgcacagagagtacaatatcaatgatgtagaaagctcagaaacattggcactctctccagctaaagagccaagcagaaactggacaaggttggttcactgaccacccagtgcagcgccctaagatctcacgtcctttgaggttaccgctgtgccttatttccttcatccatgaaacggaatgctggtagcacttactcacagggttgtcgtgaggctgaagtgagttaacacatgaaaagcacataggacaccaccgcacacacatgggacgtgccccacaaatgttactatagggatgaggaaagtgaagttcagtaaggtcctctatgttaccttcctgaggtcccctatcataggcacagtctggacacagttgtgcccaactcaaagttcatgtaagccttttgctgttgcactgctcaaggaattagaagcagtgggagatggggtaatacaccagtaaccaggacaagactccctgagacatattctacaagcgccttgcggaccagaagaggagtagttacagtcacttggtaattcaccacgagggcttcccagcataggtcggattcaggatatagaccttgaacgctgggaaagatttgaataagttatgatggtggaaggaaagactggagaacagactgaacaatggcaggggactgggatccccacatcagtcaccgggtgagggcccgtcacctgtgagtgtgttcctcagcctcagcgctgcaggtgttttgggccaggcagctctgtattgtgggggactttccagtgcgttgttggttgtagcaacacccctggcttattctcactaatgccagttagcaacccaggcccccagaatgacaaccaaaaatggctacagatgttgcctgatgtcccctggatgggggtccaaaatcatctccagctgagtgccactgtcctagataaatggaattttcaggaagccccaatgccactcatttattaacaggagcccggcttctcatcctttctcttattgttggatgacctcatgaaaaggagacaaccacacttcagatggccacaggaaggaagaagggaagtggagtcctccataatccacagtgcctgtcactgagggctccttgataaggatttttcaaggtatgaacgtgcagttcaacagctggccagacttcctggttcagaagtgtaatcctaggtggggaagtttgttattacagccggcaagaacgaggacacttcacagggctgggctgccgaggaaagatgagagactaaactgatgagaatcaccaaccagtttgatgacttggagaacagtcacttcctctttctgggctacagttttctcatcagtaactgaagagcttgcagtaccttcaacattccttcaggtgaggacttctctttgatcactgctatggtttgaatgtgtctcctaaagttcatgtgttggaagcttgatccccagtgcaaaagtgttgggaggtggggcctaatgagaagtaattaggccatgagtattctgccctcatgtattcatgagattaatgtcattatcatgggagcgggtttgttaaaatgagttcggccccttccttctctctctttcttctgccatacagtatgggatgcacagtgcagaaggtcttaccagatactggcaccatgcttttggacttctcagcccccagaaccatgagccaaataaatttctgttcattataaatcacccagtctgtggcatcctgttagagcagcataaatggactaagataatccctataaagagtggcaacagaacagttcccagctcactggcagaatcctatgatcaactagtaatgtctgccagggaaggaggatgagtggcactaacatgtacggtgtgtttgctcactgttctacaggattcaactagaatctctgggtctgtgtgaagaccaagagctgggaacagaagcagggctctagagggaaaagtttctttcggattccttttttttgttttgttttaaagagctgctctgtgagaagacaaggagaaaatggtccctacaggatactcacctctgtctcagggagacactcaagcatttattcaaccaagaaagagaattagttccaggtgaaaggagaaccccagaatacccacctacttttaaaattctcccctatgcatattcaggaaccaatcagaggatctgtaatgcgctgtgagtagaaagggaaggggaatgggaaagaaaaaagtgaagcttggaatggtggaaagtacatgggctctgccatttaccagctaagtgatcttgggcaagtaacttgacctttctgagcctcggtttcctctttggtgaaatgaggactaataatccatttctccctcagtacagacagccagcatgcagtgagcactcagcgatggccaagtatgggagaagccatgctggaatgaacatgtgggaccattttgtgcagtttctcaggtaggctcaagacttggtacttagtttaacaggcaatggggagccattgacaacttaaaaaaaaaataacataaatgggaaccactcagactgtgtcctcttcctcttccagaggaagataacaaccatcttcaatggcacatggcagttgccaaattgccatgaagcaatatctaaagccacctcatgctcaggagaaaacgctcaccttcccctcctggctccccgtgctctacacgttcagagaaacttctctagtaatgaactcaggaactggtcactgagagtatagtctctatggacagcttcggagccatggagtgaagccgagcaaatccatggaccactgccctgcccccggtctatctcgctagactagggacaggacttgggtgatgcaggaacagagaatggcctgaggaggacacagaccagaccagagaggaaggaagatgagaggaggatgcgggaaaggggcttacatcaatctccagaagcaagagttggcaaaaggcagaagggaaaaggcatagatccaaaaaggcaatgggagagagggtttattggatttgtcctctttgacctccagggattgtagggaggagataaaatggaataaagagaggattgctcaagattgtgaattggattccttcgatgttccaaaaaaaaaaagagaaagagagagattccttttattttatattattttattttattattttattttttgagacagagtttcgctctgttgcccaggctacagtgcaatggtgcgatcttggctcattgcagcctctgcctcctgggttgaagcaattctcctgcctgatctcctgccccagtagctgggactacaggcgcataccaccaggcccggctaatttttgtatttttagtagcgacagtgtttcatcatgttggccaggctggtcttgaactcctgacctcaagtgatccacctgccttggcctcccaaagtgctgggattacaggtgtgagtcactgcacccagccgcgccacactttaaaaaatactgtggtactgctgggttcaggcacaagggccacagctacagtagggttacaggtgttcatagctgtttttctccaaagaatggctctgccactgacagacatcaggttcttaccatatcctggctctttgaagaccacacaatcctgatttcttggtgtcgtccctgagcagatagcgtcagggccttgctttcatttctttactttcatttattcgctcctcaccactcccacagcactctgcctgtagcacctgacactgcctgaaggctttctctgggttcagggctgtgcttggtgaactggccccgggagcagccctcagccaatgataactaggactccttagataaactccgcagctttctcaccctttgggcaggaaaaccttgagatatatttggcaccatcacccagaggttcccacaggctggaaccccctgatgtccccagagatgtccatgaacccagatgtccacagcagtggcctgctcctcaacttcacctggcctggcttccttcccttcccgtttctcttccccacttctctctgtacttctcagaatgatcttccgaccaaccacttgtactgaaatcctagtctcagagcctgtttccagcagagcccacccaaagagagtcagggttctaggcagtccatcccattgccagatcacgatctgatctggaaagaacacgtggtcactcccctcagagttcatagatttcaaacccacgtgctgctcctctcactccagcgccaacactgactggtcccctgggctcgtgggccgccggcagcctcggctcgttctccagacagtgttccaagaagccacttccagcgaggaagcgttggcctgagaactggaacctctgcggtctctgcaaacacgacaatgacaaacacttgagagggcatgggagaaaggagctccttcatagggcagggaggggtgggcacttgggtgtgaccaaggagaggaggcgcgcctggtcaacagctctccctggcccgtgtccagctccctcctcacacagagaggggggcgcatctcagggatggcatctttcccccccacagggaaattcttatctttgaaacagcatgggaatcgaggcacccaggaggggagcagaggcaggcaggcctccttcaggcccatcctccagctgggctggtggtgccagggaggctccctgcttggtaacaaaggcctgagggagagttgcgaaacccagcaggaaagccggctcaccttcgcctccccctgcggctgggaggagaggaaatatcccatggctgactgtgccaaggaggtgtctgagccagccctcccggcccgagggcagggcaggtggccctgagagataagccaatcccgcagctgcagatgaggagttctgagaagcattgctcaggacagcggtaaatcacttcttggaggtgccctgcacgccggtcctgggagcaggcggcctcccgggggtgcgggagccccactcctccgtggtgtgttccatttgcttcccacatctggaggagctgacgtgccagcctcccccagcaccacccagggacgggaggcatgagccggtcaaggcacctgggcaaaatccggaagcgtctggaagatgtcaagagccagtgggtccggccagccagggctgactttagtgacaacgagagtgcccggctggccacggacgccctcttggatgggggttctgaagcctactggcgggtgctcagccaggaaggcgaggtggacttcttgtcctcggtggaggcccagtacatccaggcccaggccagggagcccccgtgtcccccagacaccctgggaggggcggaagcaggccctaagggactggactccagctccctacagtccggcacctacttccctgtggcctcagagggcagcgagccggccctactgcacagctgggcctcagctgagaagccctacctgaaggaaaaatccagcgccactgtgtacttccagaccgtcaagcacaacaacatcagagacctcgtccgccgctgcatcacccggactagccaggtaccgatggcaaagcccctgtctccgtggccaagtagcagggaggatcgggggctgatagagcagggaggggggtgcattttgctcccagggcgagagtccagataattggggcttcggatggaggggctttgctgtccgccttgccctggaccactgacctcctgatcccacctgtcacagccagggtccaggccaccaacacttatcactggaactcccgcaatcgcttcctgcctggccccctcttccattttgatccccagcgtcacagtctccatactgcagtaaagtggcttttcctctctttctttttttttcttttttttcttttctttttttctttctttttttttttctttttttttgagacagagtcttgctcttcttgctctgttgcccaagctggagtgtagtggcactatctcgggtcactgcaacctccaactcccgggttcaagcgattctcctgcttcagcctcttgagtagctgggattacaggcgcatgccaccacgcccagttgatttttgtatttttagtagagaagaggtttcaccatgttggccaggctggttttgaactcctgaccttaggtgatctgcccacctcagcctcccaaaatgctgggattacaggtgtgagccccagtgccctgcaaccttttctgtacgacaaatctaatttggtcttttccctgcttagagccttcggtagctcccagttgcccataatgggaagaacaaactccttagcatggcttccacctcctcctgctccataccaagtgccctgtagagcttgtctttgggcctttgcgtgtgctgttccctctgcctggccatgcttgcctgccctgcttttcatttgatacacacctactcctgcttcaggacccagcatgaaagcctcttccccagaaaacctttcctgaattccccaggctgtgttaggtgcccacctctgcgcttccaaatgtaacggggccactccgctgggctcacctttgccccttctcctctcagactctgctaagacctgtctgcccacagatgaccttgtggctcttgaatccagccagtggccaggcagaagatggagtaggcagcagagggggtttctctctccccagaatattcacactttgataagtatctttagatagaagagaaaaacccttcaagcccagagctgggctggtaggatttcaggcaccgtgagagctggatcaggagttctcccaatgccccgagatctccaccctcaagtgatatcctgctgtcagccggagacaagtgaagggacttgagctcaggggtcttgttcaaccccaggtgcacaaaatgactccagcaccaggctgtgggtgcccacacctcactcctgctgctgcagaggggcaggggagaatggaccccaaggaaaaacattcatcatctgtaaaatcctctctgtctccctctctccctctctctcattcaaattatttattttgttacacttagaagaagtcataaaagaacatgctgatgtttgggttggttttttgctagggtcccagtctcataactgaattccctcccaagttcaataccgtgtgaaatcttaagcttccagataaaccatccaagggtgaagaggccatgtgtggaggaggagggagggagcagagttctggaaaatttagtcgaaggtaacaacaggtggggcattggcttttagtgtggctgggctgcttggagcagtatttcatgtttctgtggcagggcggcatttgaggatgcatccaggcaagcggccaggagtgcccacgctgcctttgtggcccggcgctggctgtatcccctcaggcaagtccctggactccttagggctcagctcctatgccggactaaagtccctccaggctccaaaggcctgttcctgagtgtgccagttctggtctttccgcatgaagttcagtgctctcccgaggggtggggaccaatgctgttgggggaaattgtcaatcgcagctgctcgaagggtgaggaaggatccctggaaggaagcctggttagggcttgtaaaacacagtcccctggctgagtccctctcctccccactccacacccagtgaggcttctgcatccacctctaggaccctgacaccgctgatgtcctttggaccaacacagcgtgttacgaacttaggacaacacttaaaaatctgaagatttcacctgaaagttagaacttccagctcctcttagcaggtgggctctgctggcatggagtttggctgcttcgttgggtgggtcccctttgccacagtccccaccattccctgttgtcctgggaccctcaggggttcacccgtttgggtgtctgccaggcacccaataataattaattggttataattattggttaacaggcactctattaataataaagaactatttcaaacaattcacagttttaatttcattttgagacggagtctcactctgtcgcccaggctggagtgcgttggctcgatcttggctcactgcaacctctgccccccagattcaagcgattctcctgcctcagcctcccgagtagctgggattaaaggtacctgccaccgcaccaggctaatttttgtatttttagtagagatggggtttcaccatgttggccaggctggtcttgaactcctgacctcatgatccacccacctcggcctcccaaagtgctgggattacaggcatgagccaccgtgcctggccagttatagtttctaatatggcaaacataaatagctataatccacatgaagaaaagctctttgagatcaccaataatttttaagagtggaaggaagggtttgtgatgtccctgtcacacacacatgcacatatgcacacacaaacacacacacgaatgcacacaaatgcacctacacacccccccacgtgcagggactcagggacagccagttcccatagacacagctggggagctggagcctcagcctaggctgtccttggaagtaggtgatgagaagaataggagagagtggggaaatatatttgaattctccctctcctaagcctcagcccccgagcggagccggaagggaaccaactgagagtcccagcatgagagatgtttcctggagcagtttcagctctggaagaagcaggaattctctttccttcccttcatgcccaaattcctttattccaggctgggcacggtggctctcacctgtaatctcagcactttgggaggctgaggcaggtggatctcctgaggtcaggagttcaagaccagcctggccaagatggtgaaaccccgtccctactaaaaatacaaaaattagctcggtgtggtggcagatgtctgtaatcccagctactcaggagactgaatcaggagaatcgcttgaacctgggaggcggaggctgcagtgagccaagatggtgccactgcactccagcctgggcaacagagcaagattactctgtctcaaaaaaacacttcccttattccacaaagcctaatgtgcccccacacccaggacggcagagtggaccaagagggatccttccctctggggagctccctgccaaccacctgctccttaggagagaggagaaagaattagacgatggcagtcccaggcttgggcaaccctcggtgcctggaagtggaggaagggattagggcaggcttcacggaagaggtggtctcggagtagagtctcaaaggctgagtaagcgtttgctgggcagagaaggaagggaaaggaattccaggcctaaggagggtcacatgcgaaagtcaggaggtttgagagggcccatgtgtcttggaggtgatgggaccagagcttggggatgtgataaagggtgaagacaggaatagaggctgtcggggccagagccaaagactgagagcagcggttcccaaagcatggtgtgggggatccctgaggtccctggggccctttcagcggccgtaagaccctgccctttcgaaccacttatcccatgtggggctggattattcccatccacttcctcccagacaacccttcgcagcagattcacgcagaagcggctctgaccaggtgaaggtgcggacatcagagatttgcaaaaacgcaaaacagtgccgccctgctcaccacatttttgttattgttttggaaaatgcatttctttttcattaaaattgttattttatgttaacatacgatgggcttattactgatattttaaaataactattaatagtaaagaactatttcaaaaactattcagttttagtttctaatatggcaaacaccaatagctgtaacccacacgaacaaaagctctttgagatcaacaataatttttagagtggaagggggtcctgacacaaaatggacagggagtttttcaggcaagtcagggccagtggagaaagtgaagtggggacgaggcaggatgatgttcctggcagggaaactaggggctggaattattgctcttttatttttattttttatttttttattttttatttttctgagactgagtctcgctctgttgcccaggctggagtgcaatggcgcgatctcagctcactacaacctccgcctcccaggttcaagcaattcttgtgcctcagcctcccaagtagctgggattacaggcgcatgccaccaccccagctaacttttgtattattattatttttttttttagtagagatggggtttcaccatgttggccaggctggtctcgaactcctgacctcaagtgatctgcccacctcggcctcccaaagtgctgggattacaggcatgagccactgcacgcttctggtagctccaggcattcctggttcatggccgcatcgctccaatctctgctttaggcttcacacgacggctttctcctcttctctcggtgcttctttctgatatctctcataaggacatgtatcatcggatttagagcccaccagataacccaggatgatcatcttgagatcctttactgaattacatctgcaaagaagctttttccaaatgaggtcatatgcacaattctggtgtttagggttggacgtatcttttgaggagacaccattcaatgcaccttctttttcttttttcgtttctttttctttcttactttttttttttttgaaacagggtcttgctctgtcacccaggctggagtgcggtggtgagatgtcggctcactgcaacctctgcctcccaggttcaagcgattctcctgccccagcctcccaagtagccgggattacaggcgtgcgccaccacactgagttgattttgtatttttagtagagatggggtttcgccaagttgcccaggttggtttcaaactcttggcctcaagcaatacaccagcctcggcctcccaaagcgctgggattataggcataagccaccgtgcctggccttcaacccactataccttcttaggaagaacagtggtccaaaccagttactggcttcaaattaatccagctggaagacaatcccaacaggaagcaaacaagataaacctagacagggtgagcctgtatttccaagcatcctttaattcaagatgctgggttatttccaaacctgcccctgtctctgttcaatcaccagctcaccagccctgtctcaggaaaatgatgattcattggcatagaactggaagtacttactgacctatcagggagggagggaattgtttcttttgtcaataccttggaagaggaggcatttatctttcagcaaacagggaaagcctaagctgctttcagtgctataaggctaaatgtgtgcaagacaattaattgtgtgattacagggccatggttctaatgatcacagcctcattattagaacatcttttccgatttcctgcccagggtgagcaatctctgaggagttccctcccctgtccagctatccatccacatcacagaaagttgattccaagtggataccagccatcagtttggcctgccagtaagacacctctctttccttggctacttcccagatggcggtggttttaaaaaatatattgcaatgattagaaagatagtggaaacttattattacaggtaatcttgaagaaagggaatggccgtattccctgtgaaaggaaagtatctttggcccccaaaatcactaaggaaaactcaagctggaaactgcttagggcaaacctgcctcccattctattcaaagtcaccgctctgctcactgagatagatgcatatctgatgcctcctttggaaagactaatcagaaactcaaaagaatgcaacagtttttgtcttacttatctgtggcctggatgctccctcctggctttgagtcttcctgcctttgcttccagttgtcccacctttccagattgaaccaaagtacttcttacatctattaattgatgtctcatgtctccctaaaatgtataaaatcaagctgtgccccgaccaccttgggcacatgtcgtcaggacttcctcgggcatgtcctcaaccttggcaaaataaactttctaaattaactgagccctgttttattttctgggttcacatcccccatcctaacatgactgttagtttttgctttgggcttacctacaatcatgtacggaataatgacattttggttactaacagaccacatctatgacagtgctcccataagattataatggagcaggtggggtggctcactcctgtaatcccagcaatttgggaggctgaggcttaaggattgcttaagcccaacagttcgagaccagcctgggcaacatagtgaaaccccatgtctacagaaaaaaaatgaaagagagagaggaagaaaagaaagaaaagaaagaaagaaagaagaaagaaagaaagaaaattaacattttaaatttttatgtattttcttatttttttattttgagacagagtctctttctgtcacccaggctggagtgcagtggtgcgatctcggctcactgcaacctctgcctcctgggttcaagcgattctcttgcctcagcctccccagtagctgggactataggcgtgcactaccagtccagctaatttttttttttttttttagtagagacgagctttcaccatgttgatcaggctggtctcgagctccagatctcaaatgatccgcccgcctcggcctcccaaagtgttggtattacaggcgtgagccaccgcgcccggcagtaattaacatttttaatgactgcctaataagctgcttgtcagtatatcacaattaaggtattagaaaggactcatgactgggtgacagagagtaaacccaaacaagcttaagaagaagagaaacattcattaacatccacagtggaaaagtcaagggtggcactggtctcaggcatggctggaaccaggtgtccaaatgacaatgctgggactctgtctctacctcctggctgctttctccagggatggcttcattgtcaggcaggctctccccaagaggtagcaaaaatggttgccagcagccattgcttataaaataccagctaagcaacctcgtagaaagaacacctccttttcccaggagtcccagctaaagtcctgggctgactcttattagaataacttagatcatgtgaccacctctggaccaatgtctgtggccaacaggggatgccatgctcccattggtctagccttggtcatgtggtctccccatatccagtcaaagaatggcaatagacccttccaaaccacattgattgtggaggggaggcaattacttaaagtcagattgggatgctgttgacagaagaagggagaatgaatgcttggcaggaggaacacagatgtctctcctgctcactgaaggtctagaactcccctccccagtttctactgtgacacatgatgcagtagctgtgggtagagcgtgactcccttctccatcccacggggagcagcttgctctaggcgcttatatacggtgcctccacatgggattttgtttgaggataggattccacggcttaacagcatttgaaaatcagtggccatagtgtgccctctagctccaagtggctgagaatccataaccttaactttattcctcttctggaaccggttgagatgcttcttcttgttcttctctgctctccttctctttctagacttttcccttcctcctctgcactccccactcccacaatgggcataggggccaacagataggtggtgggactggagagatggtatcaggacaggcgcaggggcctccactccagctcttccttttccttccattaatcctgcccagtcagacccactctaccccatcctctcccctctggcccaatgggaacagctctcccaggcccactgggactcaggcagtttgggtgaaaccagttagcacctgcccctgacctttctggtaactgagcactctgccctggcccaggtcctggtcatcctgatggatgtgttcacggatgtggagatcttctgtgacattctagaggcagccaacaagcgtggggtgttcgtttgtgtgctcctggaccagggaggtgtgaagctcttccaggagatgtgtgacaaagtccagatctctgacagtcacctcaaggtaggggccccaatgagagtcctaagggtactcatattagcccagataggatagtctatgcaatagtaacaaatgtccctcatcttgtgttaatagcttaacacaataaaggttcatttcttgctcaaacaaactcctatgtaggtcagatggccctcctccatattgtagctacatcatgagaaatacacggcctctaagataaccatgacagggaaagagaaggctgggagactctgcaggatgtttccaggatctgacctggaggagatttccatcgctttctcttataactcattgaccttacccagatgcacggatgctgggaaatgtaaagggtcatgggtatctggtgagcagcatctctgccatgtactccagttctcctctcagctggggaagcccagggattgcatcttacagggcaggcaacctccagggtctgtgggtgcatgttcagaactccctggtcccaacaagacattgatcctcttggacttaactgaaccccgtacttccctctcctggcaaagagaaaagaaacccagcgataagggtttgattcatcacataaatttgaggacaactaattcaaatgtgaacaccacccatagctttcatgagtaggcctgggtgaacagctgattggtggccctcagagttcttttgatcagtctcctctagttcaggcaagagaggttctgtcctctgggagaacctcccagataagaatgaagcctcctccctccctcccttcccctctgcacagatgcagctgagttcagtgctgcctcctgctgccacaggccttgggacctctggctgctggtctgtttggcatgacgtagatcatacctccttggcacgaggccattgaaacaggtcagaagtgtcagaactggccttgctttcatggcctatgctggccacacctgacagtactctgctcaccataggacaatggtgtccctcctctcaagatctcacagagctatggagaagcccaggggaagcggctggaggcaggactgcccttcccaggacctgccaagccaccagcagtcttttgaggaatccagacagtattccacctccctcagccttaaccctgagactcccacactttacccactcttccatttctccagccttccagctgtacggcgggagcagcaggtgctacagggaagacaagggataaatagagccatggtagggttgcagactcacctttgcttaagacaatacagggtctattgctacctccacaaaaccacctcctctggctgcaccgagccttccctctgaacagcttagggtcagggactcaggtcaagccacttacaaggcagggctgggcttgcctccaagtaactgccaggccacctgtggctcatgggggcctagactcggggctccataggcattaggcccttgcttttcttttatttgctgccttatttgaattctaccaccttcctttttttttgttgccagctgatgccaggacagtgaagacaatttagacaattcagcccagggaaaatattaatatggtccagaatcccaccaaccagagataacacatttccatcttgatgaacattctaccagacattttcatgcacaaattgtcttagtccatcacagctgctataacagaagtccatagactggtggttcataacaacagaaatttattcctcatggttctagaggctgggaactccaagatcaacgttctggcagattcggcgtctggtgaagcccacttcctggcttataaatggctgtcttcttgctgtgtcctcacatggcagaaggagtgaggcagatctctaggcctcctttataaggcactcctcccattcatgagcactccatcttcatgacctaatctcctcccaaaggccccaccttctagtaccgtcaccctggggattaggtttcaacacagaatgggggtaaagggaacataaacatccagcctaaagcccaaatgtatctctataaacagaattaggaagtgacaccttgactttccctccaacagaacatttccatccggagtgtggaaggagagatatactgtgccaagtcaggcaggaaattcgctggccaaatccgggagaagttcatcatctcggactggagatttgtcctgtctggatcttacaggtgagccttggattcatctcctgtcaaggattcatggagaacaagggctgagtgaggtgcagaccagctcccgctgctcagacacaaacacccccagcagctcccagaaggtctccctctgcccggagctggagctgcatcacatagatggggtgagaggcaagaaatgtggaccctttctggcaagaattccaggtagagaggcatttccaggtgcctccgtttcccttgatattgcaataggacgtagaatcctcttcttttccctcctcggatatcttagacgtgattataaagtgatgcaatttgtttagttgtgtgtgtgcacatcccattgctttttttttttttttgagatggagtctcgccctgtcacccaggctggagtgcagtggtgcaatcacagctcattgcaacctccgcctccaggattcaagagattctcctccctcagccccccaagtagctgggattgcaggcacccgccaccacgcccagcgaatttttgtatatttagtagagacggggtttcatcatgttggccaggctggtctcaaactcctgacctcaggtgatccacccatgtggcctcccaaagtgctgagattagaggcgtgagccactgcacccagccccgttttattttttaaatttttattatttgctcaagcaacccaccagcctcagcctcccaaagtgttgggattacaggcatgagcccctgcgcccagcctcaatttgtgtttagaccctcacacatagactcctacatccaaatgactgaccacccatttattctaacaatgctaccttgcctgagtctgcctttgaaacttgacttcagagcttaaaagatattctttgaaatgttctcagtggcggcgctagggaagtggatttgatggtggattttgtgagagggatgaaatgagagagcaattgaggaagggaggaacagccgaaggtcatttgggaacatttgtttaggaaggtgatgagtgtgacagagagtgcagaggagggcaactggttacatcttttcttgcttcctctgctgcaaacacatagtagtgaccagtgaaatatgagcacaaacattgggataagctgggagtggaaggcaggtttccagggggtgttaaggatgcagtctttccccagggagcaggagcccgcaatgctgttccaaagctaggtgaagccaactggcaaatctctagccagagacaaatgagcataaagggaaagagagaagggagggcggaaaaacccctacatttaaaatgtgctatctttctttagccttattagtgccgtttagctgaaattccacttttaatgatattaacattgctacctccagtcttccttgggcttaaatttgtacagtgtcttagtccatttgggctgctataataaaatcccatagactgggtagcttataaacaatggaaacccattactcacagtcctgaaggctgggaagtcctaggtcaaggtgtgggcagattcagtgcctggggaaggcccaccttctgtctcatagactgctgccttttcactgtgtgacacagtgaaagtgtatctttatcccttcatggtaaaaaaaaaaggtgagggagctcactggggcctcttctgcaagggcactaaccccattcctgaaggttctaccttcatgacctaattatgccccaaaggccctacacactaatagcatcacattggggattaggatttcaaatatgaatctggaacagaaacagacattcagtctacagcacagagtataactttctctccatcccattattttcaaacttgctgatagattttaagtgtgtcttttgtgaacaacatatcattaatttttgtttttttgagacggagtctcgctctgtcacccaggctggagtgcagtggtgcaatcccagttcactgcaacctctgcctcccaggttcaagtgattctcctgcctcagcctcccttgtagctgggattacaggcacccgccaccacgctcggctaatttttgcatttttagtaaagatggggttttgccatgatggccatactggtctcgaactactgacctcagatgatccacccacctcagccccccaaagtgcagggattacaggcatgagccaccgctcccagcctcattaaagtttttaaaagtatagttttatcatctctgtcttttaataggtctaatccagttagttattgtgattgctgatgtatttggatttatttctaatatttacattttgactttgctttgcttttccccttttgtgtttgcagttgaatggagaggttttcatattacttcttttttagatagctcctttttttctctgcttgctacgaagcttaataatttatatttttactcttttcttttaatgggactccttcagtttttaaaatactttacacattttccaaacaaagtccaaaattgtgtgataattctcctctcttcccaaatacaacaaggaccttcctgcactgtttttcgacattttggttcctattaagttcgtcaaggctatttcaccgtaaggcacagaaaatctacttaaactggctaagtaaaggcagaagggagggggtgttgtaaggctgtggcaattaatctcaggcacagccaagggcaggaccaggggctgccaggcctccccaagtctgggaaaagctagggtaaaagctgctcactctggctttcatgggtccacaggcctgttgtttagctacttttcctggttctctctcctgcctcatggattgtataagttaaatctgacctcctcatccctaaactttggggctgcccagcccagcccccaccaccatcacccctggtccaaccattctgtcagcccagatcacccaccagtggatgagctgtctctgagtctggtgtccacccctgagccagttacctgtggctggggcaggggtggcagaagggaacttggcatgtggcaaaaacatggctgcccttcactcaggcctagggtggggcaagttttcagagaagaatctctaaaatatgtcattccgtcctcaaacgttatagaatttgaaggtaggagaacaaggctatgggaaaaaaagagaatgtggcttaggaggcacattcacacaagtgcagttcacaccttccttcccagcttgccttgaggtctggaatgtccttcatagcaccgagggtccccatgtaagtgcctgtctcatgtaaatggaattatcattcaatatgtggcattttgtggctggcttccttcacttaacataacgttttccaggctcatccgagctgtagcgtgtttcagtgctttctcccttttcatggctgagcaaatattccatggacaggatggaccacagttggtttatctggtcaccaatcaatagacattgggttgtttccccctttcggcgattgtgaatattagctgaggaattcttgcagcgctcttgacactccatttcaaggcacacattcttccctggggaactcaggttttgcatcactaaagggaagaaggaggttgagccaagggctagaatagctgaggattcccgaagaaatcaaagaacaggtgcagtttgaaatcaaagaacaggtgcagctgagctgtctcctcagtagccccaaagcacatgatacactttaaagtgatctgggccgggtgcagtggctcacgcctgtaatcccagcactttgacaggccaaggcgggtagattacctgaggtcagtagtttgagaccagcctggccaacatggtgaaaccctgcctctattaaaaatacaaaaattagctgggcatggtgacaagcacctgtaatcccagctgctggggaggctgaggcatgagaatcactttgaacctgggaggcgtaggctgcagtgagcagagatcgcaccactgcactccagcctgggtgacagagtgagactctcccttaaaataaataaataaataaataaagtgatctgaacttcagtagatcaaggtttggatgttttttaaaaaaagtcttcttacccggaggctcttatctataatgtcctgccccaaagttcaagattaggcaattatttttgagaaacgttacgccctcccaggacccactagctgcattgcacacgaccatggggcagttatctctgtggaaaaaaggagaaggcctgggaacacaggcatttggaaacaaagatgtaaagataaaaggctgagaaacaagttcttattatctgtgtgcatgatgaaaactgatgaaggagcttaagcgaccgggagggatttcaaacatttcagggagatcagaactgcgctaggagtgggggcttcctccctctaccaaatggtgtcaaatgctgggcagattaagctgaaacacattcccaagataaacttccctttaacaccttcaggaaaacagaatgtctgtcttcagcttctcgaaatatgaattgttccaccctcgaatcctcaaatccatatcatttcacttttaaaccaaacaatatctcatacattatgctttctcctagaagaagaataatttgaatgtgttaggtcgtaccccactcttttttttgagacgctcttttgcctagcgtggtggtggcgtgatctcggctcactgcagcctcagcctcctggttcaagagatacttccacctcagcctcctgagtagctggaattacaggcgtgcaccaccacacccgggtaattgtcttgtatatttagtagagacgggggtttcactgtgttggccaggctggtctcgaactcttgacctcaattgatgcgccctcctcggcctccgaaagtgctgggattacaggcgtcagccactgctcccagcttctatacccaacttttaatagctgtgtacctgccatctctctgggcctgtttcctcatcagaacaaaatggaaaacaataacgcactccatttgtattagaattgttgtaaaattaagtaaaacagcaagtgtaaatacttcgctgctgggcatctgagatgcactaaaaaaaggtcacttgagagtgtattgttaagacattggtattacttatactttcaaatttattttgatattaataattataattccaagcagggtctgtttgaaaaggattcgtgagttttaccaggcaggccgtgattattactgttaccagcatttttatgcttaactaacattggtctgttgtataaagtggtttgacctcactttccagtgggtttctgtgaattagaaaagagctatcattgaccaggcgcggtggctcacgcctgtaatcccagcactttgggaggccaaggtgggcagatcacctgaggtcaggagttcgagaccagccagaccaacatggagaaaccccatctctactaaaaatacaaaattagccatgtgtggtggcccatgcctgtaatcccagctgctcaggaggctgaggcaggagaatagcttgaacccaggaggcagaggttgcggtgagccaagattgcaccattgcactccagcctgggcaacaagagcgaaattctgtctcaaaaaaaaaagaaagaaagaaagaaaagagctattattatgaaagtatactaatttttttatttgtgaagcattattccaggaagtaagggcccttcctgtgtgttatccttctgcagggtttgttagagggaaagtgctggaaaacatgccttcccccagccctcaacccttaacagctctcagccccgctgcccagcccactctccaactaaagaagccagcagagaagtctgaaaccatttccacacaagacagatgggagtggagttcatctctccctgtcttatgggagctactggggaattaaaatgaaaaacaaaatcttctctcagaaaacttccctacgaaagtagaagtgaaggaaaacaattgtgttatcaagtaagcattggaccagaatatgatgcacatgatgggcaactcactacagagacagcaggcagaacaaaacctctctttcatatagcaaagtggatccaacccattacagtagggaggttctgcttgtggagtcagaggacagctgcagtcaggcccaccttcttccagaacaccggaggatggagtgtgatttacatacagctaaaatttttgaagtagaaaaggaagaaggggaaggtctcttcccttattttcagtgggaagaattaagcatctcatctttaatttgcacttgcccttccagagtccatcacgcagctggggggccctcgccctgggcaggggcaggaggaagcagaactaacattgctgaaggatgtcagggactgggccaggtgtgatcagaactttaataagggccaggtgtggcggctcatgcctgtaatcccaacactttgggaggctgagcggggtgggtcacttgaggtcaggagtttgagaccagccaggtcaacatggtgaaaccccatctctactaaaaatataaaaaatcaggaggggcgcgatggctcacacctgtaatcccagcactttgggaggccgaggcgggtgaatcacctgaggtcaggagttcgaggccagcctggccaacatggcaaaaccctgtctctactaaaaatacaaaaaattagccagatgtggtggtgggtgcctgtaattccagctacttgggaggctgaggcagtagaattgcttgaacctgggaggcagaggttgcagtgagccgagatccactctagcctaggtgacagagcaagactctgtctcaaacaaataaacaaaaaaaaaaaatatatatatatatatacacatatatacaaaaaaaaaattagctggtgtggtggcacgtgcctgtcatcttggctactagggagggtgaggcaggagaattacttgaacctgggaggtggaagttgtagtgagccaagatgcactccagcctgggcgacagagtgagactgtctcaaaaaaaaacagaaacaaaaacaaaaacagactttaataaggatttaatctttatgacaacactttgaagaaggcatcatcctcctaattgacagaagtggggtgggggatttaggcacagagaggggaggcaactgatccagggtcaccagcttccttgactagggtcaccagctctccaatccctgtgaagctgagggctgggcttgttagcctgatgtgcagcccaggaggaaggctgccacagccggaatacatgcagggccgtctgtgtttactgtcattcctgagagctgtggaggagccagctcctggagggagaacaggacaccaacagtgattttgcccttgacattcaaaggtgacctgcttactagcctttcaggggatcatcttcactgggaccagtctccccttagagttgtttccagtaaaaacaaaaacaaacaaagaaaaaaaaccagaagaggccatttatccctttcttttagccccgctacctgggggcttcagatattttggccccttcttctggttgtatatggttctcccaaactgaagagccctgcttcctccgctgaggctagagggctgaggttgtgcatttcaacactgaagggctggttgagggtctgaccccagcataggtgccatgccagggccatcaagaaaaattgctgagtggccagagtggattggtgtgtgtgctctgagatcagcaggagctaaggaagtgctctggggtcagctgagagggagccaccacttctgcctagcaggtccaggaggtcggtgccattggctggagttgggccttgaaggatgagaattattcagccctggtggggaagaggcaggcaaaattgggcattgggaacaggatggggaacaacagcaagacatcatcctggcttctaattggcctcctgccccgcccccactgccatccatgggttttctctcccaggaacagaaacacaaaccagatcaaaccactttaaaatccttcagtactcgccactgctcctaggaacaacaacaacaacaaaaatctacatccttaccagggcctctatctcagtaggatccccccactcctccactgtgttggagccacactggccgcttcctcagtctttcatgctctttcgagtcgcagggcctttgcacttgctgttcatgccctccgtcggagagctcattcctgctgtctctatcttgcttactctttatcttgtaggtggcagcttccagatcattgcctcagagacctctgatcaccaccccgagccctcttatcctctatggcttcactcccatcatgatttggaattatttatttgtgaacttgattagccgagattgtaaatgacatgaggtcagggactggactgggtatgttttcttctctgttgctttcctggcatgaagtacagtaaatacagcacctgatacattatacatggccacaaatatttgttgaatgaatgaataaaagcacattgggttctgaccattcagtgtcctgaaagaatgcagtttttcaaactgtgcctcaccatccattagcggggtgtgaaatcaatttagtagatgatgtctagcattttttttaaatgacacggaatagaataaaaataatcagaccacgctgaggtaaaggatgttctggaaattattgtgtggttatgtacttgtgggtcatgatgttaaatgtgcttttccaagaatagccaagataaatccgaaaaagaaaaacaagcagggacgacttgccctaccagagttcagaacttgtcatgaaactgcagtaatcaagacaatgtgtcattggaggagggacaaattgacacacagaacagaaagctcaggcacatattcacacaccacagggcatgacagagcagtggggaaaggaggaactggaaaaaataactccccgtatgtaaaatgggattactacccaccatgcacgcatttgtttacaaatcgacttgcaatagttgaaaagaatttgaatgttgaaaataaactaaaactctcagtagatttctttaaaaggaaaacatacacacattaaaaaaaaaaaagcagtgaccataaaagtttgcttaatctgactatattacaattaagaatgttggttcattgaaagacatcttggctgggtgcggtggttcacatctgtaatcccagcaccttgggaggcagaggaaggtggatcacctgaggtcaagagttcaagaccagcctggccaacatggtaaaatcctgtctctactaaaaatacaaaaattagccgagtgtggtggcacgtgcctgtagtcccaactactcgggaggctgaggtgggaggatcacttgaatccaggaggcagaggttgcagtgagctgagatcaagccactgcactccagcctgggggacagaatgagatctgtctcaaaaaaaaaaaaaaaaaaaaaagtaagaaaagaaaagaaaaaaagaaagacatcttaaaggaagtgaaaagtcagttacaaactggaagcagctattcaagatgcacacccctgacagagattagtgctgagactcacaagagcacaagagcacagcagaaaagtgggtgggagacataagcaggcgtttcaccaaagaggcaacatatggttaaaaaaacaaaacaaaaaattagccagcattgttgtaaccccagttacttaggaggctgaggcagaagaagcgcttgaacccaggaggcagaggttgcagtgagccgagatcacgccactgcactccagcctgggcaacaagagtgaaactccaactcaaaaaaaaaaaaaaaaaggacaaaaaaaaattctataattatggaaaaaggaaagcaagggcgttatgatcacaggattcatgatgtgctgagttctagttcaggggtcctgggaaagggatgcaagaagggaccctatggctagatgtggactatcctcaagatgctaccttggccaggtgtggtggctcatgcctgtaatctcagcacttcgggaggccaagcagggaggatcacttgaagccaggagttcaagaccagtctgggcaacatagcaagatcccatctctgcccccaaaaaaatttttttaagagaaaaaatttttaaaaaagatgtgaccttttcttttaggtagtgggttcataagtgcttactatattacttaaaatcaccaattaaatagttaaataagtgaaaatgggtgatgaatagaccaatgagtagagtttggtcatgagccaaagatgattaagtgaatgctacgtacttatgggccaaacaacaatagaaataaaatgtattggccgggcgcagtggctcacgcctgtaatcccaccactttgggaggccgaggcgggtggatcacgaggtcaggagatcaagaccatcctggctaacatggtgaaaccccgtctctactaaaatacaaaaaaattagccgggcatggtggcgggcgcctgtagtcccagctacttgggaggctgaggcaggagaatggcttgaacccaggaggcgagcttgcagtgagccgagatcgcgccactgcactccagcctggacgacagagccagactctgtctcaaataaaaaaaaaagaaaggaaacgcctctctgctcatgggctgtgatcaaaagtataaaagctaaagcatggccaggtgcagtggctcacatctgtaatcccagcactttggcaggccgaggcaagtggatcacaaggtcaggagttcaagaccaggctggccaagatggtgaaaccctgtctctactaaaaatacaaaaaattagccagatgtggtggtgggcacctgtaatcccagctactctggagactgaggcagagaattgctttaacccaggaggcagaggctgcgatgagccgagatcacgccactgcactccagcctgggcgacagagcaaggctgcgtctcaaaaaaaaattttaaaagaaaagaaaaaaaaagctaaagcatgagatgcgcgggtgtgcaggtgtggcggggctctggggcggggcacagtgcaatcggggacacaggtgctggggacctgaggagttgccaggaagtctttggacttgttctttggacttgttcttgttctgttgagcaaagcagcagctatgttgccccatgcagcctgattcagacaacagagggcgactggcttctgagtgcagtgcggccctttgtccctgcgcttgcctcctgtcccgtggcggggctggcgcttggctcggcatcaactgctcacctctctgggggtgtgggtggttcccggcgggaggtgagatttaaacaaagcctcattgctgttcccaggattatccgagccttgtgcggccccgccctgcctcacagagcagggaactcccaaccctgggctgaggccaggcctttgggtggcaagacaggtgggctgggggctgggggctgcgatcctatctttgacgggcccgtttctgcttagctctggcgctgtcccggctcggcgaccattcccccgaccatcctctccctcttgcttcaagttcacctgagcaggagcccaggagcctctagcctgctgctctcgggaggtctatgctgttaccagagtttcaagcattgagggggcggggggagaaacgaaaggagttttccatcggaaacagaaaagagttggggttaaatctgggaaacaggccgggcgcggtggctcacgcctgtaatcccagcactttgggaggccgaggcgggcggatcacgaggtcaggggttcgagaccagcctggccaacatggtgaacccctgtctctactaaaaatacaaaaattagctgggcgtggtggcgggcgcctgtaatcccagctacttgggaggttgaggcagaataatcgtttgaacctgagaggcggaggttgcagtgggacgagatcgcaccattgcactccagcctaggtgacagagtaagactctcaaaaaaaaaaaaaaaaatctgggaatcatacaaagtaataactgccttaggcattttgtttttccctaaaacctgtaagtggtggccccaggcctctccttgagggtgtcttccaccacccctcgccccgacagcctcggccccgtgtctgggtgcttcctccataaaccactcctgtcagcgtcaacgggaggcgcacggtgctcctcctccactcatccctgctgggtccctgtgcctgaaaatggagccgaatcctctttcaggaacgctttagattttcgtgaaaacacagtccggcttcccaagagcagccgccttttgcaggggctttcccgacccctgtgtggttaaaggcgcgctggccctccacattccacaggtggagacgagaaggccccggctgctgggtgactaccctaagcgcagactctgggggcctgagactcagctcccttctgcctcctcagggagcctctaaggggctgcaatctgagcaccaggagggagccttgagaccagggattcgctctggcatcttaattattcacccgcaaacacattctggcccctgagcctcagttttgtcgtctgtaagagaggtgtcgcaatgtctctctctcagggtttctgccaggatgaaatgagcccaagaggaggggcagtgggcatgggttggtccccttccgtccctgccccgaggggacccacaactcccagactggtcccccaggaggatcttggggcctgggccggcgaagcctcctatctgtcctcctcctcctcctcttcctcctcttcttcctcctccccctcccctccttttcctcctcctccccttcccacttcccttccccctcccctcctcctcttcctcttccccctcccacttcccctctccctccttctccttcctccacctcctccctccctcttcctcccctccccctcctcctccacttcccctccccatccttcccccttctcctccatcactctctctcctcttcccctccagcttcacctggctctgcggacacgtgcaccggaacatcctctccaagttcacaggccaggcggtggagctgtttgacgaggagttccgccacctctacgcctcctccaagcctgtgatgggcctgaagtccccgcggctggtcgcccccgtcccgcccggagcagccccggccaatggccgccttagcagcagcagtggctccgccagtgaccgcacgtcctccaaccccttcagcggccgctcggcaggcagccaccccggtacccgaagtgtgtccgcgtcttcagggccctgtagccccgcggccccacacccgcctccaccgccccggttccagccccaccaaggcccttggggagccccgagtccccaggcccacctctccccgcggccccacgacggcccgcccgccgctgtctacagcaacctgggggcctacaggcccacgcggctgcagctggagcagctgggcctggtgccgaggctgactccaacctggaggcccttcctgcaggcctcccctcacttctgaaggtcccatcccctgctgccctccgcaggcccagggctgggcactccctgagacccaaagacccacctcaacgacgagtggcgttgagccacttccctttgaaaagacactcaaaatcactgccatggttcaatgttcccaggccccaggccatccacttgccggcccccaccagttcttgggttccccgctctagtttgacctgtgcagcacattccagaaggttccagggaggttgtggggcagctagaggacaaaatcatgaaaacagagtccctgtcttccagagatcatccggggctttaatattaatggcccccaaaactccgtaagaagcaggaaatgcagcccaagttttacaaatgggtaaacagaggcactgagagatagatggtagtttggtacttctggttcccagtgcccaggaatggtccactcccaagaaattcaggaaagaaagactgaggagaaggtgtgggaacattctggatgtttcgggagagttggggaaactcctcctcttaggaaaggctaatactagggtatccttgggcccaatgaattaggggtgaggccccagaacccgttatctatgagttgtatgggggagccatctgaagctgtagccaccagggatgcagctagctgaggagtttggggtgttgggttggacaaggcaggttagtagactcagattcttgcttcaaagagccttgggctggcctggaggtccctggagtctagactggacctaggagcttgagttgtcaggggccaggactggccccactgcagtgcccaggccagtcttgagcagcagggagggctcagctgtccccagatccaggtgcctctgaccagcctggtcacctcctgaggaataaatgctgaacctcacaagccccatcattcatttcttctcaattcacagtgcccctctttgtttctggggtggaactaggtcctgagggcacagcctagctgagtgcaaagaaatataggatgcttagaaagcatacaggaggggccaggcgtggtggctcatgcctgtaatcccagaactttgggatgccaaggtggttggattacctgagatcaggtggattacctggtctcgagaccagcctgaccaatatggtgaaaccccgtctctactaaaaatacaaaaattaggctgagacaggagaattgcttgaacccaggaagcagaggttgcaatgagctgagattgcatcactgcactccagcatgggcaacaaagcaagactccgtcacagaaaaaaaaaaaaaaaagagagagagcatagaggagggttggccagccctgtggtgggtgggatgtcagagacacttcccagataaagtaagagttaaccctgcacctcaggtgtgatagtggggtcagtggtatgtgatccaggctggggagccagaggggagcaggtgccaactccacatccttctcctgtttctaggccctctcctcccttgtcggtttttggcggggaagctcagccttcgctgtggagggacgagagcacagagctcttcctcctggtggcctctgacccctgacggcctgtggcatcctccctagtcccctctgcccatccatccctctgttccaattctccactgctcccagcatgatctggggcatcttggcttctggtttcttttattattattattattattaattattgtattcctgtccttcacttttttcctccttagttcctgaaagtaaacaaaacaaaacaaaaacaaaaaaacaaacaacactttggttcctgatggctttctgaacccagccctgaccttgttgtttcacagctgacggctgagatgaggttagaatgactgggcccggctgaacattccaaattggatttcaccatctgctgagaaagtttaaggaaggcaaagcttgccaggtcacagaagctcccaagcccagctttccaaaggcctcagcctgtgcctgtgtcgagctcagtcctgggagataggggagaacctgcaggcaggaacaagcccccctactcctgaccaccctccatcagcagtctcccctccgtggtcgtctttgttgacaaaggtgcagtttctcctctcctgggcacctgtaacatgtgatgcgctgcctgctgggaggttaggtcggggctgccccggcgagtggagcatgagcagaaccgccgagggtcacttctgggcagaagctttgagagcctgggtccaggttgccacatagaagcagctctccagttgaaaccctcctctgccagcctggggtcctaagcgatgagcagaatcccccactcccaccccaccaacccacaatggatatgtagtgagcaagaaataaacctttgttgtttaagccactgcgatttggggattgtttcttcctgcaccatgatctagctttgcccgagtgatacagcctctgagaccccccaactccaggctaggccattgctctggattcccaagaccccccgacacatacactatttccaccacaggattaggggtggtttgacacacctggcaattgtctatctgaaagctagaagaagtctttatccaactttcaaatcctacaaaaccgggtcacgttccatctttaattctgctctgggttataatcacacctgtacctccctcactgcggcctgcttgctagagtgtcactccgtgtctttaaacatatggagtctctactacagtgtgaatttcaacagctgcagcttagcatctcttatgtgccaggcactgtgtcagctccggagagggctgggagggaccttcatgtgaacagccaccatgaagaacatgagagaatgaagaaatactatgatcttcatgtcctggggtacctcacctaaggtcaaacacatcccccaaaccagggactttggatcataggacctatctacaggacagtcagccaacatggactgaggtgtgggttgctaatgatcaacgctgctcctcagagcccctgtctcctaggaatgatctgttacctgcacttggtcctcatcagatactgctctcctgtctctccatttacatcataagagcccagagaccaaaggtatctctctggacccacaggtccagagctacattggtgccacagacagtccaagggcacagtcagtcctccctggttgaacactggtgaggagctttgctcctacaggggagacgaataatcagataccccagaccaccttcactctctgtccctccagaatgtaggggaggaagggctgcctcgccttcacttagtcttcgtgctgaccctgctagcctgtcatgaaaatgtcaaagcagcttcttcaaataattcacttttttttttttgagacagtcttactctgtcgcccaggctggagtggcgcgatcttagctcactgcaaccactacctcccaggttcaagcgattctcctgcctcagcctcccaagtagctgggattacaggcgcccgccgccacatcgactaatttttgtattttttgtagagatggggttttgccatgttggccaggctggtctcaaactcgcgacctcaggtgatccacccacctcagcctcccaaagtgctggggttacaggcgtgagccactgtgtccggcccaaatatttcactttctgaacttgatccaaaaagccggtggacacagagaaactgtcactcactttcctagcttcctcttgaagagtgtctctgtgttggaactgttattagaggatgtaaatactgcagacacacgtgcaaacataaacacaacctcctcttgctgttgttcactgtatttcgtttgacccaggcattgcttcctagggcgctccatccttctttcctctgtagcgtgtggtgaaggagagcatgaaaccatgatgcagcacacggggcggatggagagacgcggcgcagacgacggcggcgcgccggggaggctgaagtccaccatagctatgcttgccaaggccaccttcccctactgcccactccctgagtcaggcaaggacgcccttcacaaattcacacaaagacactttctaggctagtggccttgacttgagaacagagattttcagattctcccactgacatggtggtgagtgaagaatccccaaggtcgttgagccctatcttcccagtctccccggaaaaatacaagcaggcctttcccttgattttcaggaacgtggaggaataacaaatgcaaaccctggagataaggaagatgccaccgacgaagcacacaaagcagcccagagaaaagggaagagtaagaaaaatcctctgcagggggctttccctgtttgtgtttggaagggcagtgtgtacctagctagggctgctgaaacataaacaccacacaatgggcagcttcaacaacagaaatgtattctctcatagttctggaggctggaagtccaagaccaaggtgtccacagagctagattcttctgtggccgctctccttggctcacagatagcctttctcctttcttttgctaccccttcatgtggccatccctctgtgtgcctgcacccctggggtctccctgcatctccaatttcctcttcttataaggacaccagtcaattggatgaagagtttaaggagctgtgcactgatgccaggtggacttatgatggttaatttcatgtttcaacttggctacggagcgtccagatatttggacaaacattcttctcgatgtttctgcgagggtgtttctggatgatactaacacctgactttgtagattgagtaaagcagattatccttcctaatccggacgggactcatgcagtggttcccctgctgaatatcctattccaaatcctggatttgcaattaaaaagggggtgtagagccctggaggtctgggcttggtgaggccagccttgggttccgcttcaaaggggcctgcattcatgtatttcatcacaattgtggcctacaacgtgccaggggaaagagaatggtgctggcactcagctcacatgaaggtgtccggagccttgctgcctctggggtttgcactgccctgatctgaggtttgttggactgagagagaatgatatggagcagtgacaggggccagggaaggtctgtatgaggggagacatcagtgctgagccctggaagggagacagagccagccacacaaaaggcaggcaaggcatgccagccagaggggagagccttggggaagagcttggctctgttcaacagcagccgagagtgatgccctctccatcagtgtggatccccaaggcacctcttcttgggtgtcttgagctcacctccaccctccaggtgagcacttatacctggggctctcccagaaaacacatactgcttgaagctcaaaggtagtttaacatttagaaagtaaaatcagatttgccatttaaagcacagcccaataccagccattctcctgttcacaagctttccgtctgactacagccaagctgctcaccagggtatcgatggggcctcgtgattcagcgctggctcacctgccagccccattccccaccacctcccttccggccgctcaactggccaccagcctccacttcctctctgcctttgctctccttatccctcagctgaggaccctgacacgatacctctcattctccaccgagcctgctgcaaaccttcgtctctcctgaggcccagctcagatgttacctccttcctgaagcttctttgagagccctagcccttgtctgcatgctgcactatccaggcctcgctccctcctgccctctcgtaagtgccacttctggccgggcgtggtggctcacaactataatcccagcattttgggaggccaaggcaggcggatcacctgaggtcaggagtttgagaccagcctggccaacatggtgaaacgccatctctactaaaaatacaaaaattagcccggcgtggtgatgggcgcctataatcccagctacttgggaggctgaggcaggagaatttcttgaacctgggaggcagaggttgcagtgagccgagaccgcaccattgcactccagcctgggcaacaagagcaaaactccatctcaaaaacaaacaaacaaaacagttccacttctgtggatgtcctgaactctagtagatgggagctgcctaaaagccagtgtggcctctgatctttgatattgcctacaacaatgctaaaccaaggtttaccattaagccgatgagtgaaagtatgtcatttataaagagccttctgagacacgaagtgttatcctcaagccaaggttagaaggattcaagtggcccatattaggattcttgagttgcaaggactgggttacttggtgtgttggtttcctattgctgctgtaagaaattaccacacgcacagtgacttagagcaacacattttcatctacaattctctcattccgactctcaagacgggtctcactgggctcgaatcaaggtgtctacagggctgtgcactttccgggacacactgtaggagagaatgtttccttgccttttctacccaaatttcttggctcatagctccttcctccatctttaagttagtgccgtagcatctttccaactctgattctctccacctcgaccttccatttttaaagatctcagcaatgacattgggcccacttggatgacgcaggataatctacctattttaatgtcagctgattagaaacctcaattcccctttgccatgtaacctaatgtattcataggttctggggattaggatgtgggcacgccgaccacactccagggttctcatggaggcctcaggccctagagaccaggaagagcctggaatcctaagtagtaaagcagacaggggtggtggctcacacctgtaatcccagcactttgggaggccaaggcgggcggatcacctgaggtcgggagttcgagaccactccgtctctactaaaaatacaaaattagccaggcatggtggtgaatgctactcaggaggctgaggcaggagaattgcttgatcccaggaggcaggggttgtggtgagccgagatcgcaccattgcactccagcctgggcaacaggagtgaaactctgtctcaaataaagaaaaaagaaaaaaaaaaaagtagcaaagcagagaactgtccctctgcccctttggggcatctccttcattttgcttctctgcagtcctgccctgtctattcctcagtcactttggcagaacacagccacccccctacttttgagcttgctagggtcagacccatgagaagaatcatttctgaacctctgggagagaatctgattagccaggtacagcttgggtcaggtacaccccccgactcccgcatcagttaaggtagttgagtacaaacatgattgctaggtactcacccctgtgaaagagagaggaggggggcaagggtggtggttagctcagaagctgggcagatacaacaccaaagcgctaggtgatgaagccaccccgtgcgaaggagggagaaaaggacaaggaggacaaatgcctttcctctccaaacttctttagcaaagtctcctgatggacacattttgactgggaaaacagaaatggagctgccactcttcggaatgttcttctgcaggttcggggggcattctcttcagcttctgaccctacagcacagggccaggcacagagaaagcgagcgcgtgtggatgaccgagtccgacttgactgcgtgtgcagccacactggcagagttctgggctcttctgcacatccctctctgtttgctcattgttttgttgttttgattaatcccctggaaagcagggtgtaaacagactacctagattcaagttcaaaagcactataaagctgccctttaaaacatcttttaataaatggtggccttagatttgttttgtagagattttttgcccaaggttttcctaaaaggaagcacatttttttgaaacatggttctgtgcagggtacagggccacctctggcaccagaagtggggtttggtggggacaggctgtgcgcttgtggcttgccatgcctcagactgcctctgcaagggcctgagctccaggaaggcagcaatgacagatgccactgcacgtccatggagctcagctccaccacagaaggcaaaccagagacaccgccctagagcttgtgatctggccaggaggaattatacaataaattaattacaattccaataagccattaaaaaaaaaaaagcacagggcatatgatgacatttgaaggggaacccgagccagtctggggatcgggagcatcttgtctgagagtgacctttgggtggagatccacaggaaggggacgtttaaggctgggctgggggagtgcaggggagaatgttcaaagtggaggtgactggatgggcaaaggcttgagcaagggcaagcttgaggagtcaaagaacaagagaggaaaccagggtgggtacagtaccaagggaagcaaagcgagttgggctggagtgggtcagggccaggccatgtggggcctcgcaggcctcatgaaggactatgagaatgatgtgttcttcgtttttttgagacagagtctcactctgttccccaggctggagtgcagtggcgcgatctcggctcactgcaatctccgcctcccaggttcaagcaattctctgcctcagcctcccgagtaactgggattacaggtgcctgccaccatgcccggctaatttttgtattttttttaaaaaattttgtatttttagtagagatggggtttcaccattttggccaggttgatcttgaactcctgacctcgtgatccacccacctcggcctcccaaagtgctgggattacagacatgagtgagccactgtgcccggccaggactgtgagaatatctttccaagatccctctgacccagtgtgaggatggtaggggtgtgagaatataaaggacaaaagatggccaggcgcagtggctcatacctgtaatctcagagccttgggaggctggggcaggcagatcacctgagttcaggagtttgagccagcctggccaacatggtaaaactcccatctctaccacaaatacaaaaattagctgggtgtggtggtgcgtgcctgtaatcccaacaactacttgggaggctgaggcacgagaatcgcttgaacctgggagggggaggttgtagggagccgagatcgtgccattggactatagcctgggcaacagagcaagactccacctcaaaaaaaaaaaaaaaaaaaagactcttacccgctcagacatccagcatagattccccttgaggagcaaatgttgaagacaggccttttgagagtggaagaggcaagaaatttcccttaggtcccaccccatgcacctggagtgcagtcacatctgtggtgcacatttgctcaccttctaagtgactcactcactgttaagggtagtgatgtctgaattggcaggcctgaaggtttttctttagtgtaatcattgctcaattaccttcaccatctgtgctggaaatgattgtgatgactttgtgtgatgaaacccagaggtgcccagtattcctgggtgtcctttcccaccctttattacagcagaggcatcagagttcaagaggccaggttctcacttgcgtcaacacactgctgccaggaaggcgaggcggggcggaagtgaggtgtgagtaggatctgtgaagaccacttgggcattcaggatgatgcagacagcaagttggagaggaaagccagaagatgaaacgctcaaagcaagggccaagttggcaagtgggctaggatacagaccagaagccgagaggggttagaggaaaaaaatggggcatttctagggagatcacatggacagaaggaagaggtttagctacagacagaaacaggcagagtgctaggactgcctcagcacagtatcacatctgcagggtattaaccttttgcaaaattaagatgctggccaattcattcagtaattcttccaacaaatatttagtgagatgccaggttattctgccttggggacacaaatatatacaaaacagtcacagtccctgactttaaaaaatttagtggcaaaccatcaggcaaacatggaatacaaaacacaggaataagagtcagtataggactgaaccagcagtaagggagcacagaagtgggaaacctcccaccactggcaggtcagaaagacttccaggaagctacatctaaaccagacctgaaaaatgaatgtgaattagccattggatgggggcggggatgggttgaggtgaaggtcacagtccatttaaaggcgagcagcagtgaaggatggggctctaggtagccagagctgtaccacgaagggcttggcaagccatgctagagtctatgtcccatcccgagggcaatccacagctagatcacaaactccacgataaccagcgtctccccagcaaccacacaatgcttgacacatcatagctcaatacttgatagctaacgaccgaatgcatagagggacagcaatgaggtgctgtggaaggatcttcacaatttttaattcctaaaattgaaatgtctactaattatacagtctttggcttcacattaagactaatgtgcaactgctggtcatgctatcgaggtcactaaaagaactgttcaactggacgcggtggctcatgcctgtaatcccagcactttgggaagccgagacaggtggatcacgaggtcaggagtttgagaccagactggccaacatggcgaaaccccatctctactaaaaatacataaattagctgggcgtggtggtgcatgcctgtaatcccagctacttgggaggctgaggcaggagaattgcttgaacctgggaggcagaggttgcagcagtgagccgcaatcgtgccactgcactccagcctgggcaacagagtgagactccatctcaaaaagaaaaaaaaaaaaagagttgttcaaaatataagagcagttctttgcctgttttgaggagagtactagaaagggcaagtgagacagaagaatgtggaagggaaaccctgatgactgcaccttttagcccatggctggcattctcttcctctgctgagagagatcaaataaaagttgtgcaggacaaaaatacaaaaattagccaggcatgttggtgcatgcctctaatcccagctacttgggaggctgaggtaggaggatcgcttgaacccgggaggcagaggttgcagcgagccgagatcacaccactgcactccagcctgggcaacagctagactctgtctcaaaaaaaaaaaagttgtgcaggacaacatttgctggtttttgatttattattaaattcctcatcagggagctcttccatcccagctaattcactgagtaaggtaatcaccctttgtatttaagatgatgttacagactgtgattaaaagtcatgtggctgaaaaaggacaggatgatcaacctggcagacaaagctccacagctctctcgtgtttctgtgcatcttgtgagagaggcactcagtgttctttgttccagtctatcttctccaagatgtctgcagggcgaacagccttaaaaaggagacagcatctacctctggagcaaagggcaagcatgctcactgcccattatcaaagtctagagtttcccaaactcagcactcctctcctgtacggcaaccagtcatattgcatcacgagacatggtaatgcacattcactgtatgtgaacgtaggcattccttctgtgcccattatgtgcccttgggacttggaggcagagaaactgatgcaaatacactgaagtttatactgcttgctgggccatgggtcataaaatcctttgtctctgacccaggagtctcctttctgccagcatccatgaaaagcgggagaggctaagctgttagcttacaagtagggtaagatctcagacccttcacaatgcttggcacacccttcttagaaatagcttagtttcacatctcaacattcttggtcattcccaatgaatttacctaaccaatgtggattcttatgctgctggctataatatagtaactgtttttaaaagaccacaaatctaaaagcctccttgatacacttccccaacagattatcttccaaaggcataatagtcctaagatacagtacttgtaacgggataggagaaatccaaataaagaaaacaaaacataaactgaatgcagtagaaatcatttgagacagaagccagttttataaaacataaataatcatttatactccatgattagcaatggatcctgtctgaagtaaacaaggacaattaatacagtacaagatatttgtggttttgttttttataacccactaagccaagatttgtatctctgtatggaactgattttcaaatggacagaaatggtctttgatctttctgaaccacttgtcttcaaattcttctgaggatacagtcaccaaggcagtcagggctacggagccaacacacttcacctctgggtgaacttcatcttttattttttctgggatatcttctcccataacctataacaggaggaaaaaaaaaaactgtcccaataaaagaggcagagacatggaatgctagttatcaactgcgaaggctttcattcaaaggcagaaaatacttgagcagccaggggacattcccaacacattgaaaagatgtttgttcagaagtagttatccgtctatggccataccaccctgactgtgcccgatcttatctgatctcagaagtagttatccaaggacaaataaaatatcccatatttctaccctcattctccccaagtgaaagaatcactttggtgctgctgcagcagcagtactatttggcttaccaggagtactgagttaccctttttgtttcaaagagcatattctgttggtgagaatgcaactgtagcatgtagctgggcccaccttttcctgacccaaaaggactctaatccctctataaccaaagcaatcttggggatttaaggagcccgttaccaatgaaggtacaatactgctccctactggtcagaatcaggcccagatgaacacagggtcatgtcccaagattctgggttagtttctttgagaagacatcacaaagttaggttgtagaaagcttgtacctgaacccactaagtaagcagactgaccttgggtaatgacaatgaactaaaattaagttccaaaacatttcataccatctgtcacgaaagcttatgtagtcatggagcagggatgttgtagagggaatttaagttccacatagatttgcattagataatctccaaggttcctgcaaacccggatattgaatgtgttcatgaaaactcaaattataatgaattagaagcaggctcaaataatggttttgcggactgggtttaaatcttcaaagattacatattgtttgaggaaattgccagtgagagccaagcttcactaggcaacagtcagtatttactaaagcctggtatttcaccagttctaagatacttttttgtttttgtattttaacatctctaaaatcaagatgtatctgagccaggtgtggtggttcacatctgtaacaccaacacttcggaaggccgaggcaggatggtcgcttaaggccaggagttagagaacggccagggcaacagagcaagatccccgtccctacaaaaaaaagtatcatttttttgagtcagagtctcgctctgtagcccaggatggagtacagtggtgcgatcttggctcactgtgacctctgtctcctgggttcaagcaattctcccacctcagcctccaaagtagctgggactacaggcaagtgccaccatgcccagctaatttttgtatttttagtagaaacagggtttcatcatgttggccaggctggtcttgagttcctgacctcaactgatccacccgcctttgcctcccaaagtgctgggattatagatgtgaatgaaccactgtgcccggccaaaaaattgtttaaaaatcagccgggtatggcagcactcaactatagtcccagcaactacttgggaggcggaggtgggaagatgccgtgagcccaggagttggaggctgcagtgagctatgactgtgccactgcacttcagcctgggagatagagtgagaccccacctccaaaaaaaattttaaaaaatgtatttgataaccactggagtgaggctctatgtgatagtgtaaatggcatcttatttttcttttttttggggggcggggggtcagagtctcactctgtcgcccagactggagtgcagtggtgcaatcttggctcactgcaacctctgcctcctggatcgaagctattctcctgcctcagcctcccaagtagctgggattacaggcgtgcgccaccaggcctggctaatttttgtatttttagtagagacagggtttcaccgtgttacccaggatggtcttgatctgacctcgtgatccacccgcttcggcctcccaaagtgctgggattacgggcgtgcgccaccgcgcccggcaggcatcttatttttcttttagtgacacatcaaatgatatgtcttaaaactgatgatttcctggattcagtgaaatgtagtattttaaaatctgggataaaacaccaaaaatgcctttcttaaaaaaagataaatgaataatagtaagacccaaacaacacactattcccaaaagagggacagataggcacaatatttacaggtgtcaaaaatctgccaaaacattcagccacataaacattttaaacttccatatgccaaaaaaaatcataaacttcagaaaatatagtaactatagaaagatacttaagtctaatatagggagaactcttaaaattgctatgaaaaacagaaagaataatgaagcaaaagcaagactaggcatttgacatgatacaaatggccaataacacatgaaaaaattgttcatcttaatagtaaataaacattaatgctaaaaacattacatttttatctaccaagctaccaatttttaaagtaatattattaagttaaattatataaaacagaggtcaaaatgattgatttcacatggttcaatctaatagtcaggatcagggtagaaaaaacaatgctttcacatattgctagaggatatataaattgaactaacctttctaaatgataatttggaaatgtgctttaagtctttaaaaatgctcatatatttaaatccagcgattctatttctaataatctgttccaaaaggtacaaaggcacatattgattttcttgcaaggatttattaaaataggtactgagtatttgttaaatgttcaacacagggaactaagtaaattatagtttgtccaaaaattgactatccagtcattaaaaattatgtactcaaataatatttaggatatagggtcatgcccatgtcataatgttaggtaaatatcagaacatagaaaataaaatgtacagtttggtagttcctaaaaaagttaaacagagctaatatatgacccagtaattctactcctaggtatatacccaaaagaattaaaaacagagacttagccgggtgcagtggctcatgcctgtaatcccagcactttgggaggccgaggcaggcagatcacttgagatcaggagttcgagaccagcctggccaatatggtgaaagcccttctctactaaaaacataaaaattagctgggcatggtggcacacgcctgtagtcccacctacttgggaggctgagacaggagaattgcttgaacctggaaggcagaggctgcagtgagccgagatagtgccactgtactcctgcctgggtgacagagcaagactccgtctcaaacaaaaaaaacaaacaaaaaaggagacttaaacatacttatatgctaatgttcatagcagcattattcacaatatccaaaaggtagaaacaactcaagtatccatcaaaagatgagtagataaacaaaatgagatatgtacatatatatgaatattatttagccatagaaggtatgaagttttgataaatgctaaatatggataaaccttgaaaacattatgctaagtgaaataaagcagacacaaaaggacacatatggcatgattccacttatttgaaatatctagaatagataaattcacagagaaaaatagtagattagaggttctagtgggtagagagagaagaaaatagggagttattgcttaatgggtagagtttctgtttggggtgatgaaaaaattttggaaataatggtcatggcggcacaacactgtatacgtacttaataccattgaattgtacatttaacaatgattaagatggcaaatttaagttacatattttatcagagtaaaaaagaaagagggagaagagcagttgttatagaataaaaaagacatgagacaaaagggccacatatagtatttagaccttatttggatcctaattcaaataaaagaattacaaacaggaaaaaaaagcatgtgatcatagaatatttaaggatacagggctatgttattacaagtcaactaaaattaaaagcacaaaataaaggccaggcatggtggctcacatctataatcctagcacttagggaggccaaggcgggacgatcatttgaggccaggagtttgggaccagactgggcaacatagcaagaccctgcctctacaaaaaattttaaaattagctggacatggtggtgggtgcctgtaatcctacgaacttgggaggctgaggtgaaaggaccacttgagcctaggaatttcaggctgcagtgagctaagattatgcactgcagcctagcctgagtaacagaatgagaccttttaaaaaataaaaataagcacaaaacaaaatgtacattataatcctaattacaatcctaacgagggcccagacattttccatctttttaaaaagctccactggtatatcacatgcattgtctacacaggaaactactcttccacccaaccaacagatttatcgagcatggtgaagaatacaaagatgctcaaaacatactattacttataaggaacctagtatctagttgaaaacataagatacattcttatgtcttcttagggcccaaagagctatctattcaagcaatcactatctgagctcagaggaaggagaaatgaccacagagcagaatattccggaaaagcttcctggaggatgtggaacttgggagaattaaaagactgatcagaagtgtttttttgtgttttgttttttgagatggagtctccctctgttgcccaggctgtagtgcagtgacacaatctcggctcactgcaacctccacctcccgggttcaagcaattctcccgccttagcctcccgagtagctgggattacaggtgcctgccacctcaaccggctagttttttgtatttttagtagagatggggtttcaccatgttggccaggctggtcttgagctcctgacctcaagtgatccacccaccttggcctcccaaagtgctgagattacaggaagtgttctgatgagtagttccattttagacattttgtacttgaagtgacagaagagtaatcaataattatcccaggttaaccacctagtaggcaattaatctgatgtgagacacatgtcccagagatgagactagagataaagactggagagtaatcaacccagaggtgacaatggaacctaggggtgtggtgatgatttctgtgacagaaaagtagaaaacagagaggccaagggaatctttagcatgccattacttacgctacagaagaaaccagctgagtcccaagaggcagaggaacgttaagaaacacaggagaaaaacaaaccagtgtagcctctcagaagtaaaaggaagagatcaggcatggtggcccaggcctgtaatcccagcactttgggaggccgaggtgggtagattgcttgaggccaggagttcaagacagactggccaacatggtgaaccctgtctctactaaaaatacaaaaattagcagggcgtggtggcacatgcctgtgatcccagctactcgggaggctgagacatgagaatcgcttgaacccaagaggtagaggttgcagtgagccgagatcgtgccactgcactccagcctgggagacaaagcaagactctgtctcaaaaaaaaaaaaaagttaatgaaggtttacatgttagtttaaaaaaaattacctttgaatttctatgcaaccatcaaagtagtaacagggtagagcaggaataaaatggacttgcagctggcaaacacaagctccagaccagctctcccactgaaaatctgaccgcaggcaagtcacaagttctctgagcctcaattctagctctactcaacttcacaagctgttatgatgaatggaggaaaaaaaatagaactgctacacaaatgtaagcattcattcattcatttattcagcactgaaacaaacaattattgggcattgatgatgttcaggcaggcaggtgctaacaagcactgacaagtacatgaaacacagcccctgcggtcccgcacgctgcaggggaatgccgatcaagaggccgccttggtgattgctgagtgatcaaaaggcacacagaggagggagacaagtccttcagtagattaaatttggccctgctttataaaaaatgctatcagagccagggaaaatatctatgatgcttcgtttcacataaacccgagggatacactcacctcagctatcaacagcaaagtgtcttctttgaagctgaaccctttcattttatcttcaatttcctgctgagtccttaagttcctctccaaagcaaacgatgtttgctgaggttgggtaaactgaagcagaagcctgaaaaaccgaaaagtctcaatgcgtggcgaaaagtcccaacgcttccagataaaggaaagccgcgaggaaatgttcagaaagcccaggtattgagtcggctgcaagtcccaccaggttaaaaagcaggtacccaccctcactagaactatcatttcaatccctaaagcttccgacttggaatcaattgcccaactttacattggagattcatcttttctaaaatataaagactaaaactgctcaaagaaatcttcagagagcaacacctgaaaagagcttccggcctcaaaagagcttcctgtggaagtcaagggattgaaaggataagtaatttggagtgaaaggaacgagcctcccaatcagactcctctcacacaggccctctggatttgctcctttgaagtcagtgttctgtgacccttccatctcgctgaccccacagcaacttgaccgcaaggactaattagattcgctagcacacttcaattaccccaagcagggccaaatctttgatgaccctctgacaaccactctgcgataccttaccactgacttccctgtcatgatcatagctggtctcctctctcatttaacttcctcctgtcttcctcatttggctcctttttttttttttttttaataaatactcaatatgcagattttccccttttttctcactggtacctactgcaatgcccagaagcactggctctccatgctgtggaacatgcccaacactacgctaggcaatgagagatactgatgagcaaaacacacttgtggcctcatggaatgaatggaaggagggagatagcacataagtatttcaggtagtgacaagtgctatggaaaaaaacccaagacagggtggacacagtaacctcttcagatgcggcggtataggcaggaaggcttccttgagataccaggcaagctacgagctacctgatgaggaaccagtgggagaacatctggtggcgagggcttggccagggagaagggggctctgacacaggaacaaatttgatatgcttgaaaatcactaagatcactgtggctggaacacagtcagagagaaaaatgtgtagtaaatgaggtgggaaaaaaaagcagggccaattcaaatcagaccttgcaggccatggaaagaaatgcggaattgacgtaagtgcaatgggaagccatccgggcgtttcagaaaggagcctgacctgactcacaggtaaaatgatcatctgtctgcttcagtctgacctgttgacatcacctacccggcctcgggaagcattcaccttcgttacccctttgatgtaacttgctttctgccctctggatatactccaggcacccgcgactcggtacttcaagcctaaaatcattgccttccaccccaaatcggctctgctcatcctcccagatgtcctatctcagcggaaggcaccaccatccacctgtgcatcctcgagagactctgcagagactcttccggtctcctcaccctcaaccttcccacacactccgctggtcaccaagtcctgtctattctatcgtgcagtgacatccatttcttttttttattaccactgtaccagcctaggtcaggccctcatcatcttccactaattactctacaacctctagtccttagctcctccttctaatccagcatcgcagtcaccagagctctctaaatcacaggttttggccaggcgcggtggctcacgcctgtaatcccagcactttgggaggccgaggccagtggatcacctgaggtcgggaattcgagacagcctgaccaacatggagaaatcccatctctactaaaaacacaaaattagcctggcatggtggtgcatgcctgtaatcccagctactcgggaggctgaggcaggagaattgcttgaacctgagaagcagaggttgcggtgagccgagatcgcgccattgcactcccacctgggcaacaagagtgaaactccgtctcaaaaaaaaaaacaccaaaacccaaaacacacacacacacacaggtcttatcacatgctcctgtatttaaaacctgcaaatactcttcaggccttcggcacaaagaccaaacccttgtgacaccaaacatcttgtgttaacaataaaaacaacaaaaataaaagtactaatctaacatttaccaaatgcctactacataccatgcaggacaataagtactttaaatactttaattctacaaccccaggaagcaggcattttccccatttctccatctgtcaagattaagcaactagagagcagagtttaaggaatgtgtgcaaggtcagaccgcttgcaagagttcaggttcatccacttagcatcagcaattgactaagttcttcaaaaccagttctgacgccaaagtcctacttcctacttcctctgccaccctggcactgtggccacagcctaccttgagcccttaccaccaatgctgctcttaccaccagacaatgtgacaacactgttctagaacggatcctctgcccctctgggcggtgccttctttttacctagcatgcctcttcccacgtggggaatattaacgtggagtgagcaagataagctgaaagaatacagggtctggaatcagagaccagctccaaatcctggccctgcacttcacagttgcaccactttgggaatgattttaatagtttcctgatccatctagtgggatcccaataggtatcccagagtcatgaggattaaaatgaaataatgtatacaaagcatctagcactcagtcaactgacaagggttcctacagggaccattcagcagaggcatcatcccctctgtaaaggcttccttcttttggccacgccaacagctccctgacgttggtcacagcactgatatactatttagcacctgtgctggcagttacaggctagacataccatttctctgagtgagtgaggggcataagggactgctttttaaatgatctttgtgatcctagcaccaagcacatgtctggcacacggttgtcattcaatgtgcctctgaattagtgacatggtcaatctaaacaagcatccactgaatacattttaaaatttgccaaatagctgggaacggtagctcactcctgtaatcccagcactctgggaagccgaggcgggtggatcacctgaggtcaggagttcgagaccagcctggccaacatggtgaaaccctgtctctactaaaaatacaaaaattagccgggtgtggtggtgcacagctgtaatcccagctactcaggaggctgaggcaggggaattgcttgaacctggagacagacgttgcagtgagcggagatcacaccactgcactccagcctgggcaataagagcaactccgtctcaaaaaaaaaataataataataaaataaaatttgccaaatagataccacttctcagtaagcctcactgttaatatttcttgaatcctcctgagttaaaaaatctgtatattctttggtaccatttgaaacatgagagagtctgcttcttctctcatcatttatagaactggtcaagtgtattctccctacccttccctcaaactcatactttaaagataaaaagtacttggtatccctaggcacaaaccatgggaattctctgtagaatgaattaagcatcatctactcccattatcagcaattcaaatacaagagctaattttcttctttagtagatttctgtggaatatacgaacagaaaattccttctttaaaatatgtcttctccctttttcagtgttttatacatttttattttcctaattttttaatgttttctaatcttaacattccatcttggacaatgacacaggttatattcctttttgtttctgagagtttcattctgttgcctaggctggagtgctgtggtgtgatctcagctcactgcagccttggcctcccaggctcaagcaatcattccatctcagcctcctgagtaactgggactacaggcacgcaccaccatgcctggtcaactcttttttttttttttgagacggagtcttgccctgtcgccaggctggagtgcagtggcacgatctcagctcactgcaacctccgcctcccgggttcagcgattcccctgcctcagcctcctgagtagctgggactacaggcacgtgccaccatgcccagctaattttttgtattttagtagagacagggtttcaccatgttggccaggctggtctcgatcttctgaccttgtgatccacccacctcaccctcccaaagtgctgggattacaggcgtgagccaccgcgcccggcccgcatagttaacttttcaaaaaaaaatttttgtagaaatgggatttcaccatgttgctcaggctggtctcaaattcgtgagctcaaacgatccacctgcctcagcctcccaaaatgctgggattacaggtatgtgctaccacaccagctaacacaggttgtattcttaaacaaatgtagttttgtttccaagtattacacactagaatgacaaacgttcaacacaaccataggaaaatttcaaaaatatataccaaatgtctagcctagaactttttgaagcttaaaattagaaaataaagcctttactctgagctgattaccaagcgttgcttaagtgactctcagcttacctggttcgtataaaagaggcacatgctttcagctgagtctctatcaacactgtttctctcttttctgccatacagttttggatatttgtcagagctttctcatttttctggctattactgctattcgcttccacagaaaataaagagctctcaggcaaggtttcaggaaaacacaaaagacagtcttttcctgagtgtggaaagaaggatttgatagttttgtcacttgaggtgaaactgtgctgtttctgagatgacgcaagtgctgctgaaagagctggccccagattcaggtaagcctctgccaatttgccccagttccaaggattaaaaggatgcaaagaaatcagtttctgcaggcagaaaattgttttctccaagttctgcaaacttgaacaaatagcaagctggaggtagagtaccgtggttaaatggtctgtgttggttgctttattttcctaaggagaaaaaaaaaaggttaagaagtttaaacttcaaagcattttccatataaaatgagaatgcctaaaaaaccaagttgtatatgttataaattagaagtatctttcagtagctatacgagtgacctaaatatatttcaatatatctcatgtttgaaaccgtaaacccagagagatatatgctacctagagaaagagtcaccagccattcccaaacatcctaatgtcataataacttaacaattcctagatggtggcctgccaaatgttcagcatcaaaaacataaatatccatttatttccaatttttattataatctttactgtcttcagccaggtatctgaaagacccagccacttttcttagatcctggcctaatgattccattgtaatattcaaggctttctaaaaatccaaatggtaatttccttgaggatttgaacaaactccacttccaaattttatttggcttagacattttaaacaggatagccctgaagctctccatgcttcatgacgcattctaattgaatccaaatgccttccctggtaaccattaccaaggtcaattataatttttggccaaaaggggttgcttagtttccttttgatcagaaaatccttttcaaatctccttaaccagcgccaacatctcttgcctaacttgccatatggcaaatgtcctctgggttagtaaaaacaggcctgctttttgtaagttgaagtttgcggagagcagatggcagactcaaattaccttcaagttgatgtgaggtctaaggaaagcctggcctgcaagcgtccagatcaggctccctcacagaaccacactgagcatgaaacatgagcaaaactacctggtgtacggccccaggaaactgtacaccagcaagtgaaggcctgcgggcagctctaaatattcccacattgagtgaaaagataggagataaagccccatacgactgatttgctgacactgtaccttcccaaagacagaacacatctcgttttattgttactattgttcagcatctgtccttcccaacagaccatttagctccataagagcttttgttcaatgtaaattcctagtacagagcacagctcctcggccatcacagatgttaaatcacgtttgagtaatgacttttctaaagtcaaatcatgtcatttataaggaaaacaacatgtatagactacatctgtaacaaatgctacccttcttctgtaaccagtctatagggctttatattgttcaaaaactttttttttttttgagacagagtttcgctctcgtcgcccaggctggagtgcaatggtgcgatctcagctcaccgcaacctctgcctccctggttcaagcaatcctcctgcctcagcctccggagtagctgggatgacgggtgcctgccaccacacccagctaatttttgcataaagtaaagacagggttttgccatgttggccaggctggtctcgaactcctgacctcaagtgatccacccccttcggcctctgaaagtgctgggcttacaggcatgaaccactgtgcccagcctcaaaaacattttgatattgataaagcaagtgtgtgttagggtggaggctgttactcacaaactatgatcctgatgacagggttttgtttgtttgagatggagtctcattcttttgcccaggctggagtgcagtggcgtgatctcgactcactgcaatctccacctcccaggttcaagcagtcctcccacctcaacctcccaagtagctgggactacaggtgcccaccaccacaccaagagagtttttaaaattgttattagggatgcggtttcaccatgttggccaggctggtcttgaactcctgaccttcgcccacctcggcctcccaaagtgctgggaatacaggcatgagccactgcgccctgtcaatagtagggttttgagaggtggattagtaaactccttctggaaattaaattctatttaggccgggcgtggtggctcacatctgtaatcccagcactttgggaggccaaggcgggcggatcatgagttcaggagatcgagaccatcctggctaacatggcgaaaccccatctctactaaaaatacaaaaaattagctaggtgtggtggcgggcacctgtagtcctagctactcaggaggttgaggcaggagaatggcatgaacccgggaggcagagcttgcagtgagccaagatcatgccactgcactccagcctgggcaacagaacgagacttcatctcaaaaaaaaaaaaaaaatctatttaaatgagtgagtgatttttccagaatactgcaactctttctgtaacaataacatgatgatgacagttaacatttactgagtgtttacgcagtgccaggcactattctaagtgttttcctcatttaatcctcctgacagtgctttaaaatagattcagtaattttccttatgttacagataaggcaactgggtcacagagaggttagataacttgcctgccataacgtggctggtaagcaggagagctacagtcagttatactaaaagtcaaggaataaaaggtacttacgaagagctgatatggccaggcaaggtggctcacccctgtaatctcagcactttgggaagccgaggtgggcagatcacttgaggtcaggagttcaagatcagcctggccaacatggtgaaaccctgtctctattaaaaatacaaaaaaggctgggcgcattggctcatccctataatcctagtacttcgggaggctgaggcgggtggactgcctgagctcaggagttcgagaccagactggacaacatgatgaaaccccgtctctactaaaatacaaaaaattagccagatgtggtggcgggcacctctaatcccagctacttgggtggctgagacaggtgaatcgcttgaacccaggaggcggaggttgcagtgagccaagatcgcgccactgcactccagcctgggcgacagtgcgagactccatctaaaaaacaaaaaaacaaaaacaaaaacaaaaaaacaaaaaaaaatgtagccaggtgtggtgacacatgcctataatcccagctacttgggtggctgagacaggtgaattgcttgaacctgggaggaggaggctgcagtgagccaagatcgcaccactgcactccagcctgggcaacagagcaagactccatctcaaaaagaaaaaaagagctgatgtatatgtgcgctggctaaaccgaccagacactagatgagcactgcatgtacacgatatattgtttgtctccttagcatcgaacccagaaccaggaaaatagtaggactgaaatgtttgttgagtgctgagtggataaatgaaaaggagtcacttactaccagaaagccattttcttaccacagttaccacacaggaataccaaccactataagaaaatgttgtaattatttaagaaataagtcctactataaattttatccaaaaatcatgaaaagaggtgaatgaatttcagcagaaattgtgaacagaaaatgttcgaatcttgatggccaccccgggacttgctgtctattttgttcaatgttacatactgcgacaggtccccctacagaatgtgaaaagacagtaaccaccgtcacaaaaaaacagatatgggccagagctagtaacaaaaggcgagggtcctcaggtagagaagaaattttaaaaaacaaaacaaaacacagcttaccaggaaatgagaatgccgtgcagacacgcaaggtccgctgagatcatgtgtgaagccgacagaaaggggcgaaccccacgagcccgctttccacctgacagtcctgcccaacaggttgccaggacgcctgatgcacagttctgaaagtccagggttttctgactggtgtttctcctgcctagtaaccatccccagcaccggagacctggcatcggctgattggcaacagatccttctctgagccaccgaaacagattccctaagctagaaggaaccagagatgacccaacccctgccaggaatccagctgccactaccttcaacaatcaaagaggaggaggaggaagcacaacagtgacgtgcaagaaacgccgagcgagcaggacagtagtaaaggctacagaaaggcaccggaagggccaagagcactgttaatttgcggactggggaagactagaaatgaacacaatgaaatcccatcaagttaactgctcatgcaaacgcttaggaagtcgatttatctatctttcagcttaagcactaacccccaattagtagagaacagaaaagaaagaacaaaacacagctgttttccatgttcttagaacaattactgccaaagtttcctcgaattgcaagaggctgaggtcctatgcagtgaaggcttaagcaaacaaaggttagggatttctcttagttaatgagatggcagatgtcagctcaattgtgtgcatacgttaggctgatctgatcgctgggcggtacatccacaaagctcaaaatcggtgccacagtgtctccttaatttcctccgaggaagaaaactagtccatttagactaattcccatataaaatttacacaacaatcaatacaaataatgccttaacctagaaacaaaagcaataaaatctagaactggaaagaactacctttctttatcccttaaaaaaaaattccgctttagaatgtgtggaaaaaggcaataaaatttttttttaaagaaaaagaaggccgggtgcagtggctcacgcctataatcccagcactttgggaggccgaggcgggcggatcacaaggtcagtttgagaccagcctgaccaacatggtgaaacctcgtctctactaaaaatacaaaaattagctgggcgtggtggtgcatgcctgtaatcctagctactcaggaggctgaggcaggagaatcgtttgaatccgggaggcggaggttgcggcaagccgggatcactccactgcactccagcctgggtgacagagtgagactctgtctcaaaaaaaaaaaaaaagaaagaaaaattccctttttcttcagcgaggctgccgagctccagatgcagagatgcagatctttgtgaagaccctcacaggcaagaccatcacccttgagatcgagcccagcaacgccaaaattcaggacaaggagggcatcccacctgaccagcagcgtctgatacttgcgggcaaacagctggaggatggccgcactctctcagactacaacatccagaaggagtccaccctgcacctggtgctgcgcctgcgaggtggcattactgagccttccctccgccagctcgcccagaaatacaactacaacaagatgatctgccgcaagtgctgtgcccgcctgcaccaccccgtgctgtcaactcccgcaagaagcgcggccacaccaacaacctgtaccccaagacgaaggacaaagaaggctcttccttccccaaagagcggcgtcctgcccaggcctcatggccctggggcctcaataaagtgtcataaagtgtccctttcgttgactggggaaaaggaaaaagaaaaaaaaattctgcaaattccacttaaaaataaaaaggactactaagtgtggcttggtaatgagtatttagtcattttgggggggggaccttttttggcttagaaaaatactgttcattgtagaaattttggagaacaacgtctaaaaacaatctaacgaagaaaacagatcactcatagtccttccacactgaatgttactcctaacaagagaaaaacctctgcaaaggagattttcaggcaatacagaattttgagcatgacacaagaaaaatattacaagaaaatgattatgtctaggttccaagttgttcatcataataaaactctcacacccctgacaattttcttctgcttatccaaacccatagattttgctactagcaagaagtttgttttgttttcaaaaaatacaccattcgaccacccttataggaatgtgtgtgaaaataagcaataaaatcactcaccaagtttgcagcaatctccagcgcctccatatgcctacccaggtgagccagacaccgagcctgaccttcctggacatcccttttcatggcaaaattggttgatgacaatttttcagagatactggaatactcctgcagtgctttctggaaattatttgttaaataaagaaatgaaaggaggaaaacataacagaaaaaaggattcagaataggggtgattttttttcctaggtggaaagtaatgttataactgaccaatgaattacatgaatatttaaatgaattaaagaagatttcactattctagtgatatggtttagctgtgtccccacccaaatctcatcttaaattgcagctcccataacccccacatgttgtgggagggacctggtgggaggtaactgaatcatgggggtgggtttttcccatgctattctcatggtagttagtctcaggagatctgatagtttcataaaaggcagttcccctgcacacactctctttgcctgccgccatgtaagacgtgactttgctcctccttcaccttctgccatgattgtgaggcctccccagccatgtagaactgtgagtccattaaacctttttttttttaaataaattatctagtcttgggtatttcttcatggcagtatggaaatggactaatacatctagtcaatcctactttcctaaaaggtagagaaggaatggctagagaatataatcactactactatggaaagcatcatgatatagcagaaagaacattctgggaccaaatatactaggctttgaattctggtattgccactaacttactttataaccttttcatcagcaaaataaaaacaggattctcatgcagatgaaatgagatacatatgtaacgcaatctaacatctagttgttagttctttttcttatacattttggggtgatttgctcctgtggcactgtgaaatgtctgtgctagagggtcctaagtaatgaggagattcagaaccttgaggaataaacctacaaggacaaggaccccaaagagatccttttgttggagttacagaaaacaaacaaatcatacagagccaagcagaaaagaacggaaacttgggagcctcagattataaacacacatcacaaaagattaaactcatcttcataaacaccacactaacttggtacactgttatttacatatgccataactgataaaacaagagcccacttcaagcaccatatgttgaattctacctgatactcttgtcgtctgtaggccaggtctcctttgaatttcttgagagtcagcacttcaacatcatcactgctttctgtttcttcataaaaccacttgaaatcatgaaaatagcctattacagagtgagctatgcttttccacctcatattcagaagcaatttcccataatataattgattaaacgtcaaaaaaagacttcttcaagagtctggccaggttagtcttgaactcctgagcacaagtgatcctgcctctgcccaccttggcctcccaaagtgctgggattacaggtgtgagccaccgcacccagcccacattggttctttaaaatgagacatgctttcttgtagataaactttagtgtgactggaatagggattgacaattctttactgaaaggacataggaaagaagaattatagatatggtgctattatgaaaatgtcataatggcaaaaaactagaatttcagcaaaggagacagaaattaaggctagaaggaggctccaatgcaaccaaataccaaaaacctgtaggagagaagtctgaggaaatgcccatctaggatactttatttgcttttctactgatttaaatcctatggataaaaaggaaagtgagactgagattgcttgactattgaataaataacgtagggaaaggcagtggcttacacctgtaatcccagcaatttgggaggccgaggcgggcagatcacttgaggttaggagtttgagaccagcctggctaacaacagtagagaaaccctgtctctactaaaaatacaaaattaggccggcatggtggcacacgtctgtaatcccagctagctgggaggctgaggcaggagaatcgctttaacccgggaggtggaggttggggtgacccgagatcgcgccactgcactccagcatgggcaacaaactccacctcaaaaaaaaaaaaaagaaaagaaaaaaatcacttcattttagaatttatattaaattctatgcacctgtacagcacatcagatctgacaaagtattttcatatacattatctcatttcactcccacgataactctgtgagccagcatgtattatttttctgaagggacaaataaggagctgacaccttcaaggcaagtggttaaagccaacactggaattcaagagtcctatctcataaccagagtttttttaatgttctgccacatgatttccaagcccaatccctgttttgagtctacatgatccagggctgaaggtaactttgaaagatcgtatgtgataaggagaaaatgcaactgaaataaccaaaaacacaattcagtaattatcgagtgcctggcatcttgtcagtacaattgtgaggaacgaatgagacagtatatgcgaaggaacccaccacagtgcccggaacacttccgtattttccataaatattagttttgactgatgaactatttacactcatgaaagaataggaagtaatactctactaattcaaaaatattcgcggagtcactattattaataaaaactgttaggcactgccaagggcatcaagaacccatgctggtgcgatcatttagcactccgggtctcaggactttgtgggaatactgacaagtgctttaagtagaagctaaatagagggaagggggccaaagacaaaaatatttggctggaagacgaaatcagaaaagacttcctagaggagatgacatttaagatgtgccttgaaaaacggatataactgaaggactttaaccatcagcgcggggttggtacgggcagggggagctcgccgaagagggaggggagagtgggtttgccggaggtcaccgttttgggaggcctgactgcccagctgtaagagcagtgaagacaaacgggaggtaccggagattgcagggcaggggcgttgagaccagccggcagcagccaggccggccaaatgccaagtgggagtcaagccgcttacaacgcggggattctcgcccatggacccggaatggggcctgggaaagccgcttccccgtggaggaggagggacggcgggggacgcggcgggcgctggagcctgccagggtttgcgttcgcgcggacggaggggccgaggccggggccggggccccgcggagggcgaggcctggggcccgggataaggcgaagaggccccagcttctcacctgcggctcgcagagcttggcgcagtaggacgcgggcggtcctgaccgccgctccggcctctcctcgaacaccgagtcctcgaactcgccgccgaacaaccagcacccggaatccatctcgcgcccgcggcgggggcaacgaggaagcggggcccgccggaaaaggcggggcttccacggcccagagcgcggcacgctgggacttgtagtctttgagggcgacgcggggacgtggccgctgctggttgggagtagtggttgagctgagatgattatctgacccactaactgaccgaaccccaggacggaggttttgacttctctgtgtcaggagatggacagaatgatccttacctgcacgcatcaaaaagcacgctggccccagagtagctgtttaaaactcgcaggtacctttttaaaaattaaaataagaggccgggcgcggtggctcaagcctgtaatcccagcactttgggaggccaaggtgggcggatcacttgaggtcgggagttcgagaccagcctgaccaacattgagtaaccaggtctgtactgaaaatacaaaaattagccggccgtagtggcgcgcgcctgtaatcccagctactcggtaggctgaggcaggagaatcgcttgaacccgggaggcggaggttgcggtgagccaagatcgcatcattgcactccagcctaggcaacaagagtgaaacttcgtctcaaaataaaaaataaaataaaataaaataaataaaataatttcgagacagggtctcgctctgtcgcccaggttggagtgcagtggtgagatcatggctcactgcagcctcgaactcccagactcaacctatcatcccgcctcagtcccccaagtagctggggctacaggcgcgcgccaccatgaccgtctaacttgtgtattttttgtggagactgggtttccctacgttgcccaggctggtctcgaacctgatctcaagcgatccgcccacctcgttctcccaaagtgctgggattataggcgtgagccactaagcccggtgcaagtaccaattgtcaaccactgtgcattcccgtcactgtgttaagcacattttttcttttcggctaacaaccaccttatgaaagccaaagtgattcccattttgcaaatcctattttgaagatattggagtttggagaggttaagtaacttgttaagtttcggtcattatgtggctgaaacttgggaaatacagaaatgaatgcgtactctccgtgcttccggacaagagacactaccaccaataacaaagaccggagtcattcacgcatttatgaaagaaaagacacagaaatataccgtgggaggctagatcagggagcattcattcgacctggagaacaccaaatctcaaaattctaagactaacatttactacaattcttatacttttaagatatttcttgactctagaaagtaaagattgttgacaaaatgctggccaatactgtacagcacaatattgtgccatattacacagtaggaaataaacataaaggttttccccgatttttttcctgttcctcttcactctcaccagtttctcttccaccatttatctgtcttccaggtttcttttttaaaattttatctgtttatttatttctgagacagggtctcgctctgtcgcccaggctggggtgcagaggcgcaatttcggctcactgcgtcctcaacctccttggctcaagccatcctcccacctcagcctcccgcgggccaccacacactgctacttttttgtattttcagtagagaggggttctttcatgttgaccaggttcagcgttctttcttcaacccaactttttcctccacaaactcacctaatccactcccccaggtttcagaatccatctctctgctaattattgccaaaatctagaaccagctcatttatccagcagcctcaggtgggaggctccagctgaacagcctccaggcattagttactgatgaatgaattcatcaagatccacttaagaacatttttctggccgggagtggtggctcacgcctgtaatcccagcactttgggaggccaaggctggtggatcacctgaggtcgggagttcgagaccagcctggccaacatggagaaaccccatctctactaaaaatacaaaattagcagtgtgtggtggtgcatgcctgtaatcccagctacttgggaggctgaggcaggagaatcccgtgaacttggggggcggaggttgcgggagctgagatcacaccattgcactccagcctgggcaacaagagcgaaactccgcctcaaaaaaaaaaaaatttttttttctgctgaaacggtcaggaagtgttagggtgcttatggataaaaggtagttatttgccctttagactcaggattcctgggctcgggtgtttccagcctttttaccactaatgaccctttcagtttctccctgaaagttgtggaggatttctatataaaataaaactgcatttattagctaataattatttttcctttaaaaaatagaatccagatcctatataacagccaatccaaacttctacccagcctgagtctactggcatggcctcattgtacattagaattccacttgaaagcaaagcaccagctcttagggccctgggaagcctgaagaaaggtaaaatatgattagcatcggacctctggcaataatgaaaacacttcaaagactcctatcactactgaggaccaggggtctgggaccccaagttacacaccactgcctcatttgatagagaggcgctagggtaatgtcatttttcaaaagtaaaccaataaaatagaagggtattatatgctctgtgactgttaaatccaccttatacactaaggaaatgccaagtgttaggcagtgttaggaaactggaattctgcaagtatccaaaattgtgtggttgtgattaaaacctgtttctgtagaattttatctataaaaatctgatttttgattgaggtgactgattgagttccccatcacaaggtaaccagcacctcctccaggcagccctccttctttcctgtaattcttccatgcttctatccatccacggtggcatttagcactctgtggactgttggaggttagaggtggtgtctttttcactcttgtcaactcagcccccagtcagggattggcccagaccaccgcaataaatgtgtttttttgatttatggagatccaaatcctgttgaatggatgggtgaatgggtaaatgaaagaaaggagccgggcaaggtggctcacgcctgtaatcccagcactttgggaggctgaggcgggcggatcacctgagatagggagttcaagaccagtgtgaccaacatggagaaaccccatctctactaaaaatacaaaattagccaggcgtggtggcacatgcctgtgatcccagcttctcaggaggcttaggcaggagaatcgcttgaacccaggaggcagaggttgcggtgagctgagatcacaccactgcactccagcctaggaaacaagagcgaaactacatctcaaaaaaaaaaaaaagagagagagagagagaggaccaggaaatggcaaaaggaacagaggagcacttctcagttctaagtcagttgttcatgtcctatctgcaagtaggggagggaaagaaccaacacttattgagcatctataatgaggtcatgctatgggcaccctattgtttttatttattctcataatctctctgagtttagatactattattcccatttttatagatgaggaaatattaataggatctgagaggtaacttgtctaaagtcccaggcagtgagcagatcagttcaaagttaactttatttgacatgttgttaaatatcccccaaaaacaaaatggcagagcttcatggagacttggagaactgtctgtcactggctggttctgcctgccccatattctagcaccttaggtactctcatttattctgtttgtctaggcagaatggctttctctgccttgtctgtacacatcccaaacacggcctctctagcctgagcttaccacagagctacagtaattaaaacagtgtggtactggcataaggatagaaatatcgaccaatggaacagaactaagagtccagaaataaaccttcacacatttatagccaattggtttttgacaagcgttccaagtccattcaatgggggaaagaataattgcttcaacagatgatgctaggacaattggattaccacatgcaaaagaatgaagttggacccctgcctcgcaccatattaagaaattaactcagaatggattaataacctaaatataagagctaaaaatcataaaacccttagaagaaaattattcatgaccttgaatttggtaacagatttttttttttttttttttgagacagagtctcggtttatcacccaggctggagtgcagtggtgcgatctcagctcactgcaaccttcacctcctgggttcaagtgattctcctgcctcagcctactgagtagctgggattacaggagtgtgccaccacacctagctaatttttttatatttgtagagacagggttttgccatgttggccaggctggttttgaattccacctcaggtgatccacctgccttggcctcccaaagcgttgggattacaggtgtgagccactgcgcccagcctgataatagattcttagctatcacaccaaaagcacaagcaacaacaacaaaaatagataaactgggcttcggaaaacttaaaaacttttttgtgcatcaatgacattatcaagaaaatgaaaatacagcctacagaatgggaaaaatacagctaattctcattattcacagttattacattctataaagtcacactgaattagcaaatcctgaacacatgctcctagggttagggtcctgggagcctctggtcacaatatatttatcaatcaatcaaaacatcaccatgttttgtatttttctgtttaaagacaccttatttaatactgttgattgattaacactgaactcatgactaacagcactgtaactcatgcctgaatgaagcttatctaacgcatattttctccatagggcacatgacagccttctaatatttagaaacactgacaacacttcagcactacacttgggaccattttaaactgcagaaagcagaaaaatatggaaaacacagcactaaatagactacaaaaggatgctttttcattcctatggacacacacacacacacacacacacacacacacacacacacacttctctacagtatgagacctgaaacaaggcaaagcatctctttggttgacctttgctgggaacatctttttgttgccattctgtacatgtgcaggaatgaccaaggaagtactatgaatactgatttgggggttacaaatacattttaatgtgtaggcaaatttgcatatacagaatccataatgaggatcaacttatttgcaaatcataatacagacagtccccaacttatgatggacttaagatggatttactaacacataatcccatggtaacctaaccccatagtaaactgagaaacacatggatttataatttatgattgtgaccaggtgcagtggctcatgcctgtaatcctggcactttgggaggctgaggtgggtggatcacctgaggtcaggagtttgagaccaatctggccaacatggtgaaaccccgtctctactaaaaatataaaaattagatgggcatggtggcgggcacctgtaatcccagctacttgggaggctgaggcatgagaatcgcttgaaccaaggaggcagaggttgcagtgaactaagatggtgccactgcactccagcctgggcaacagagactctgtctcaaaaaatagtaatagtttatgatagttcaagtttatggtgagttcatcagggtattaaatggattttcaacttacaaaaattttaacttacaatgggtttatcaggacaaaccccattctaagtcaagaagcaactgtatctgataaagctgtaacatccagaatatataaagaactaaaactcagcaacaaaaaggcaacccaattaaaaactgggcaaaggattgaacaaactttcaatatattcaaaggaagatatacaaataattatgtgaaaagatgtagttttgatttgcattttcctaatgacattatcactcatcattagggaaacacaaatcaaaaccacaatgagacaccacttcatacttactaggatggttataatttttattattttatttttagagatggggtctcactatattgctctcactggcctcaaatacctaggctcaagtgatcctcccacctcagcctccctggtagctgggactacagacacagaccatcgcactgggcttataatcactttttaaaactgaaaatgaaaggtgttggcaaaaatgtggagaaactggaatgcttgtatattgctagtggaacgtaaaatggtacagatgcttcagagaacattttagcactgtggaagagtttggtggttcctcaacaaattaaacacagaataccacatgattcaggaatactactccttgatatactcaaaagaactgaaaatgggtactcagatccttgtataccaatgttcaccgcagcattattcacaattgccaaaaggcgggaaaaaaacaagtttccatcaacagatacatggataaacaaaatgtgtgtgggaggaagtgcacgtgtacagacaaacacacacacacacacacaataaaacataaatcagccatgaaaagaaacaaagtcttgatatacgctaaaacatggatgaacttgaaaacattataagttaaaataagccagacacaaaagggcaaatattttaggattctacttctttgaaatatcaagaatacacaaattcatagagacaaaaagtagattagaggttaccaggggctgggaggaatggggagttattgcttaatggttccgagtttctgtctggggtgatgaaaaacttttggaaaagtggtgaaggtggtgcagcactgtgaatataattaatgccattgaatttacacttaaaaactggtataatggcaaatagtatgtgatatatattttaccacaatgttttaaaaattgactttgttaataaaatgaaaaaaaaaaggtcactgtaaactactaatcactacttttattttgtattcaaggtcacaatcaaccagaagagggttcttttgctctgtcaaataaatatatttaaaagctagcaaacgtcagagaagagttttatcaggcctataaaagagatgagggaaattaatagttatatacagctacacagagttaacatattgcaagggaaacaactatattcaaaggcttcatttctaatacttgacatttcaaattttgagaacattaaaattattgtcaaacaaaactcagaccacattagcaatgtttataaaagggagcaatttaatcattatattacagagtgctttaagaagtttttaaacgtgtaaaagaaaaaaaaaaagcttagtgcattacggtctttacattgcttcttttttaaaaaagttaacagtagtatgaaaaaagccacccacaaagccagctgtctgagtgaggaaatcagctacattgcagcattttggaattactaataaagctatagttaaaaaataaaaagtttataaaaatgaaagcagcatgcatattcaaggctttttcataacattttcaatggctgaaaaacatttaaccaagagcttaatatttattatccattaaattagagaaaataaactggctaagcctacatctggtcattcagaaaaacatgttaaaatccaaagctaattaaactgaacatttcttctacgaagaaagcgcattttgaaaaatggtcctatggtcacaaaagaaagggttcttcccaatatgaatgaacagcaccagtctttacaaagtttgtaaattagtatgaactttcagtctcctgatacggcaagagttaacagttaacactcccatgattcataagtgaaaagctaacttttaactcattatgatcagttcagaattttttctctattcactgaaactgttataaaatttcactgaaagataactcttaaaaattctgatctgacacctgtataaacatttctgatttccacgattgtaagaaaacactaagtatacatttactacgtgattctttttcacatttttggtgcagtatttatttcaaagcttcaccctatccaaattaccatgtcagtttcttttccttcttcagaattaatttcctgcagtttaataaaaagcaaatcagcttctaatggaacaagtaacagtagaaacagtggtattcatggatgtgtttaatgaaggatccaattattaagggccagtgaaaccataaaatcttattgtttcaacatatataaataggctgtttttacatttgaaattgtataagcccatgcacaacttttaatcttagtgcagggtctgataaataagacatagtaataaatcagggttttttttttttttttttttttacccatttctaacaatttttactgtaaaatttttggtcaaagttctaagcttaatcacatctcaaagaatagaggcaatatatagcccatcttactagacatacagtattaaactggactgaatatgaggacaagctctagtggtcattaaaccccctcagaaagtctaagattcagaatgtctccatcatattagaagaaaaatgtactgtattaaaatttaaattgcatttttacaagttgttttttaattagtgttctatttacattgcagaacttccaccaactgcagtagtttaactttggcacaacattaagttccatttcttttgggtattggatcctgctttttgagtgtgtatgccccaaaacgttttcaatgtcatcaaagattgggcaaattcacagtaaatcagacatcttgagttgaagaattgattctccttcaacgttttaggcagctaaaaaagaaaaacatcataaaaaactgaaaatttaaagaaaaccatattttaatttttactacttttagaaataaaagtgaaaatacatcttttgtattctcttgagattacctgccacatatgtcttccataatacactaggctttgtgtgcaactcatctatgtatatgttcttcatatgctagatttgcttataaacatttatcatctttatgtaataatttatttcaaactgtatgagcagggagtatatatttcattgtcagtatctgtaataagcagactatgaaatctaaagacttgtacttttttctatttctatacaaggtgcaaaagatatatatgtacctcacttcctgtaataactattttgggaaggttttggtaacttttttggtaaattgaacaatatttaaatgaagaaataactatttagagaaggctatggtgaatcctcttataagtgaaaaattattttactcagccaaggataacttgatgtttcagaaatttagacttttgtgtatttaaaaaggcatgcttctatgctatcacaaaagtatataatatggtttggctctgtgtccccatccaaatcttaccttgaattgtaattattaagggacagtgataccacaaaatcttattgtttcaacatatgtaaataggctgtttttacatttgaaattgtataagcccatacataacttttaatcagggagtgtcgggggagggagcctggtgggaggtgactgaatcatgggggtggacttcccctctggctgttctcatgatagtgagtgagttctcaggagatctggttgtttgaaagttgtgtggaacatcccctttcgctctctctcctgttcggtcatggtgagatgtgcttgcttccccttcttccccttcgccttctgccatgactgtaagtttcttggggcctcccagtcatgcttcttgttaagccggcaaaactgtgagtcaactaaacctcttttcttcataaattacccagtctcaggtcgttctttatagcagtgtgaaaatggactaatacagtgcatgtatagcatacatcatacagtcttttgaaaactgtagttttaggatgaattttctgaccagaattagtatccattacagtgttaatatataacataagaattatctatacaaaattaaaggtcaaactaaactgtacagaaaaattcacattatttttggaagactgcaactccccaaaaaaatcattgcagaggttacaacaacaacattcactgcagcaacaaatttgttgatttaatcttggctgagtgcacattcttgtgtttagcaataaaaaaaatgcctgttaaaaatattttatgtatctgggtcagaagaaagcctgctctgaagatttctgacattaggaaatggagggctgcacttcaggataaagctgtatgaaactgtttaacttcttataacctaaaatgattacattataccctataacctggaatgatatttatactgcttattaaaacaggtacatttttagtttcatctgttatcccttaaaaaatattaacaaggagaaaacctgaaaaaggattgccaagcagtaagaatagtgcctggtacatattaagctctctataaataattgttaaaataaataaaaccagagagaagatgtaagggaattaaggaaaaactgcacagaataacagagcataaaagtaggggatgggatactcatgcaaaaagccaaggaaataagtaagcatgctcacgtataaaataataatgagggtctacgtctcatttccttccttactgtttgaacacagcagtcatttctgatagcaagatgctatttggactactgacagacatacacaaacatttcatgacaactgcattgttttcaaaacagtgtacttttaccccggaacactccaaaacaaagaatagcaaagaataaaactatgttattaaattccagaagtattaagaattcaattcctaactccaaagcaggtatctgatttgcaactacagttcaactttaattaatccaatttataaaagaactaagatttaaggaacatgccaaaacctttcaaatttaagccatatttatttgcatttttaagactacagagatatactttaaatcaaatacaatgttagtgctggtagcaggtttgttttataccaaagaatgaaaagatattttaagcaattgggtttatatcaaatctgttatttgccttttgatctctaaaacagaaataatttatatcacagttttcaaagacagatgccgcctaagcaaacatgaatttatatatggcctaaaacagacctttgacttttaacagaaaaagatattgagtaattttataaattactaaaaagatactgagtaatttcataaatacataaagcattttaaactctagttaaaagtctagtaaagttttgggagcaatgcaatgaagatgaaaagatacccattttcacctagtttcctaaaactgcacaatcctcaaccctgtggtaagtctttcctttggtgtacttttccccttctttttagttttcatttttgaattatttccttaaataggcaaaaaatgaagctttagtgaagggggcattgcaataaaatacattttagttatctttagtatttgtttgtgaatcccctcaacctgcctgccagtctcccttcatagagattgggtaactttccttcaaaacaaagtaaaaaaaacccaattcatatgaaaaataataattaagacattaaactctacataataataataaaactacacatgataatcatttatctcttagctatactagtggtacctagtcttattagggaaaagaaaaactacttcagaaaatatcaaaaatgaagatgactgatacaacaaggtgactgttcaaaatgtatgtggttgatgaacatatacgcagattaaaaattttcttaacttacatttcagtcatctgatttagacagcttccgtttcacatgtcgtggaggttcccaagtgtcactatcatctgtttcttcttcatcctcttcctggtcatcaataacttcatcttcctcctcattttcctcaaataattctatacctaattctgatcttctctgtctttctgcaaaccactctctgacctgctcatagcccatatgtgatttgttaacaagttcatcaaggtcttgctcattaagaaacttgtgcttcaggtaataatccttaagtattgcagttccagttttaaattttatgagtgatggtcccctgtcccagttgttaattcttttgcttcctctaggccgcccacgcggtcttcctcttccccgtcctttgggtctccctctccctcttttcctaagggaagacagaccattcatactacttgaattggcgctctgatagtagtagtaccatttcaagtttccattcttccaagcataacgggtgtccccaaaccaactaactatgtctgttctagcaagcccgctttctttggccaacttgtcatactcttctggtgatggccactgtgtccggacaaatgcactcttaagcatgtgcagctgctcaggtgtttttttacatatcttgcctgtactccctgacttaggtgcaccagattcatctgcaggagaagtttctccagcttcttctttggaactacctgcattactttcatctatttccattttctcttcctttaaagcttttgatttcttcttctctgtaaaccaagcatcgatttctcttctggtaagtttggtttgtgcccttaacctatttaattcttcatctgtaagtacagagctgttgagaaaacttgcctgaaggacacgaagctgctctgcagttttctctttaaacttttggggagtaaagtcaggaaaaggattccaggattgcttaggctgtgcagtaccaacagttggggattccgtggtttcatcactggagtctataataatggtggtagaggaatcattgttgagatgtaagcactgattactctttgaatttctctggttgtaccttgtgtcactaaaccattttttaatctctcctttcgtcaggcctgttattttcataagtctgataatttctgaatcatggggaaactgatttttaaggtagctaacttttaattctgccagttgctcttttgtcttttttgcccgaatgccaaatgaatcagggtttaccaatgcagtttcatgtttgacactttgagaagttggaactgctgctgttgctggctttgtttctgcagtaggctgagcagcaggtacctgacttttctgtatattattttgacttggaacgcctgccactgtcaaggctataggtgctgtaactggcaaggtgtttgttccagccacttgagtaaggaccagaccaggctgaccaactatttggcatgtctgtaaaatagatggtaaaccattactccctgtggaaatgtgtgtaggaataacagttatggtctgaggtacagtatgcactgttccattgaattgtttccttcttgcctcctctacttcctcgggagtccaactaacaccatgttttaaacgttgggctgaaaaccatatcttgatctgttcctctgtatattttgcttgagcagaaagaactgtaatttctgacattgttgggtaagggaacttgttgtaggtgttaagtaaaaggggattgttatccaatgcagcattgtaggtgggaatgctattaacagggattaagactttgggaatcaaattagaattctgctgagcagatacagcagttatcacctgtgccaatccaggaagaactgctgctggtgtcactaccgtgctggcagtacttggatgtattctgtttacaatggaagtacttgtattagattcagaagctgaagaacttggattttctacaatttcttcacggtctggtttgatttcattctctttctcttcaggaacgtcctcaactgagttatgatgaactgcaatccgtttattttccactttatttttcatcattttcatgataggagttttactgatagatattcccgaagaagaaacttctgtagattctgcttgctctgcattctcctctttaacaaaactaccatcaaaagtcagatcatttattgtttgttcaaagattgtctggttattacgtttcaccatagtcaacttaaaattctcttctcctgggtgatatttcagattatgctcagaaagtgcatcataccttttggtaagaaaattgcattcgacacaaacataggatgaatttagcactacattgggatgttccgaatccacatgaaaagtaaacatatttagatctggagtttgaaaagtacaatatttacattcatatccaccttcaacttttttattttgctgattgtctgaatccacagattcatgaacctcttcatcacttgagatactctctgctctggtgttttctacaggtgtaagcacaggaggaccttcatccaaatctgatatcaactcaaggtctggatcttgttcactggcaaggaccatgcaaggtgttgttgattttcgcctgcttgccattctgatgttatgaggaaaagctcagtggtgattaaaaagcatcgaggcttaaaactgttcagtgttcttcatttgaaaacaatggcttttggttcttcaagtccatttttgtgctcaacaagtctcattagcagctttctcatggtgcaatcaagtaaagagcttattgttggcagataaaatactgctgaatttctgaaatttttgaagcacaactccaatcacctacattaaaataaattttaaaatgttttaaaatgagtaactatgatcttttaaacaaattatagttatagttcacttatatgaagtggctggatagctcagttacaaagatctagaataagataagaatcagaaaaaaatgtcctctaaagatcaaaataaatctctccaggccaactcattgaatgttaagtactttaccttgggtcagacacaagcttattcatttaaattttttagccagctatatattagaagacaagggggaaagggcctgctttggcaagcacactattattaatgtgaaatggcaatgttaacaaggaggaactttaacactataaaaagcattcacagatactaaaatattatggccattaagtgtgtaagaaattcagcctggccaacatggtgaaactccgtctctactaaaaacacaaaaattagccaggcgtggtggcaggtgcctgtagtcccagcttctccagaggctgaggtaggagaatcgcttgaacccaggaggcagagattgctgtaagccaagatcatgccactacattccaacctgggcaacagagtgagactccatctcaaaaaaaaaaaaaagacaagaaatttaatccattagttcattagttatgtcctcttcttcctactggtctatctcatcagccaaaagcatgcttcaagtatggcaaaaatagcaaagatggaggatgaatgatcaaagtttcagaaacattattattattattattattttttgagacagagtctcactctgccacccaggctggagtgcagtggcgcaatcttggctcactgtgacctctacctcctgggttcaaatgattctcttaccttagcctcctgagtagctgggattacaggcgcttgccaccacgcctggctaatttttgtagttttagtagagatggggtttcaccacgttggccaggctggactcgaactcctgacctcaggtgatctgtccgctttggcctccaaaagtgctgggattacaggcatgagccaccgtgcctggcctaccagaaacattattcttagcacttgccacaatgctaccaaaagttataaagcagatctaatcacatcagtctcctgacacaggttcctaatgttgaaggaataaagttcaaactccttgtgggacatataatccctttcacaacctagtctaacctcactttccttcctcctgtttccttatgctttaggtataccagaaatggctgccattccacagacattcaatgcactttcagacccttactcaggcccttccttaggttaggacacttgatgtgttgatctgtgtgccctctaggacagcagtcctcaacctttttggcaccagggactggtctcatggaagaccatttttccacataccgcggtgcgaggggatgagatggttttgggatgaaactcttccacctcagatctggcattagattctcacagggagtgcgcaacctagagccctcgcatgcacagtcacaatagggttgtgctcctatgagaatctaatgctgctgctcatctaacagaaggcagagttcaggtggtaatgcttgcttgcctacctctcaccttctgctgtgcggcccagttcctaacaggtcatggattggtactggtccatggcacaggggttggggacccctactagagatcaccttctccctttcatttggtcccatttcctcccgtttattttctagtctagtacttaccatactgtacatggcagagtaatgttacatttctgtccctgcaccaccatccatatctgtggtctccttactctagatattgtgtctcatttttaataacagcttgctataatttggatgtttgatcccttcaaatctcatgttgaaattcgatccccaatcttggaggcagagcctaataggaggtgtctgggtcatggggtcagatccctcatcaacagtttggtgctgtccatgtggtaatgagtgagttctcgctctaccagttcctgcaggagctggttgttaggaagagcctggcacctccccactgtctctcttgcttcctttcttgccatgtgatctctgcccacatgcattccccatcatcttctgtcatgagtggaagctgcctgaggccatcaccagcagcagatgctggagccatgcttcttgtacagtctgcagaactgtgaaccaaagaaaccctttatctttctaaattacctagctctgggtattcctttataggaacacaaagagactgagacacagcttttttgagataaaacaaagtcccccaaactctggattgagccaaggaactttgtatcttcaacctaatactctcccagctgagctattttggctgacatctcattaatgttgcattcccaagtgcatataagaagcctgaatttagggaggtaatcactcaatgtttattaaattgactagaatgaagaggaaaatagtcctacaaaactcaacaggacctgcaggaggcatcaccatagagaacagtatctgaaattcacaataataactttaaataatcaagaaaaaatgaattaggatcataaaatatatttaaataaattttatacctaaaatttttaaaataaaaagttttatgctaagtaaagtttgtgtttctgaagtctaatccaactgaaaacgaataaaatgggtaagtgatttcatttattcttcaccacaaattagagctatttttaatttactggcatcccagctgaatggagaagaagagagtttgcttcaaaaattattaagcaaaaccaggtccctatgagacaatacatctagtcagtaaatggagagacatttttaggaaagagagcagtcctaagagagaatatcctgactttgaaggacggtaaaatcctcctcactggaattattcaaatacagactacacatccaagtagcagaaggaaaattggactaaatgtcctttgttccctaatttcccatattaccaaataaagagcatcagtttaaaaataatagtggtattaataatccagatccctactctcaaagatgtcattctttttttctttaaaacactcttgatttctaagatattataaagaaatcactgatatttacaactatttcttaaccaaatgttataaactaagccaatgttatcttttaatcaaataggggttgccattttttttttcaagtatcaacacagatgtttgatcattttttgtcattagaaacagggaattccttaaatggctccaaataagtggtccagacatggtggtacacatctgtaatccagctattcaggaagctaaggcaggaagattccctgagtctacgagttcaagactgggcaacatggtaagatactgtttctaaaaaaaatagtaagtggaagagtaataaatgagcagcactcatattttgaacagtaaagggaattgttgaaaggcagaggagtaacctattttgtgactgttactttcctggaatctgagagagactatatttaattggggtataataatagttggaaggcaagagggtttctttctgaaactttttcctcaaagtggtggttttcaaactttttgttttaagcaggggagccctttcatcaaacaaaatgctatgagaaatcccaggtcaaaacagataaaagagaagccatcggccaggcacagtggctcacgcctttaatcccagcactttgggaggccgaggccagtggatcacaaggtcaggagatcaaccatcctagccaacagtgaaaccccgtctctactaaaaatacaaaagttagccgtacaggtgtggtggcgagcgcctgtaatcccagctactcggaaggctgaggcagaataatcacttgaactcgggaggtggaggttgcagtgagccaagatcaagccactgcactccagcctgggtgacagagcgagactctgtctcaaaaaaagaaaaaaagaaagaaaagaaaaaaagaagagctatctggttggaggaggcagaggctaaactactctctgaccaaattccacgaatcttacaatccccacttccacctttcaggggttctgagatgtgtttaaaagccttttgcttaaaacttaaacatatcggctgggtgcgcctgtaatcctagcactttgggaggctgagaaggatggatcacttgaggtcgggagtttgagaccaggctggccaacatggtgaaatcccgtctctactaaaaatataaaagttagccgggcgtggtggcgtgcacctgtaatcccgctactcggaaggctgaggcaggagaatcacttgaactcgggaggtggaggttgcagtgagccgagatcaaaccactgcactccagcctgggcaacagagcaacactccatctcaaaaaaaaaacaaaaaacaaaaaaaaccccacatatatatatagagagagatctcaagacaatatatcagtttcatcaaaaatcctcctctcattgagccattgctcagccatgaaatttgaaaactcatcttgagaggacaggtgcagtggctcatgcctgtaaccccagcactttgggaagctggcaggggcgcggtgcatcacttgaggtcaggagttcgagaccagcctggccaacatggtgaaaccccatctctactaaaaatacaaaaattagctgggcatggtggtgggcgcctgtaatcccagctactcaggaggctgaggcaggagaatcacttgaatccgggaggtggaggatgcagtgagccaagatcgcaccactgcattccagcctgggtgacagagagagactctgtctcaaaaaaaagactatttgcttgctataatccactgtcaggtccccatgattttgctaacaaaagtaaggtcagtgtattatttaacatatttctaaaaagagactgagaagtcccaaaagagtttcaagatttggtccaaaagctcaattctgcataatgtgtatagtctaaaaatagaccaaagggcaaacaaaggtatcctcggaattattattataaagtcataagtttggaggaaacaaggatcttaatcttagtacaactgccccatttttatggaagaagaatcccaggcccagagtaattaattcataaagtcattgtgaatagggtaaagccacaggttttgcagtcacctctgtcaattagtagttaggtgcctggaagagctattcaattcaacctcaattttctcaagattcttcaattcaacaaatttgttgaatgtcaaccacatgaaaggcaataatgatgcaatggtgaccaagacaggcagtctctggtttttcaggtaccagcagtgaagcaaggaaagcaagcagtaaacaattacttagaataactatgatcagtgcagtaagaaagatatcagtacactgcaggaggcttctagaaaagaagcagagaaggcttccctgggggaaaaagaaatagtagtatccacatcagaggaagtaaaaatgcttccttcacttactttgatacaaaacaggtgcctaattgatgctattttcagtccctgaaaaattctttccagaaaaaaataacattttttaatattataaattctctcacttttttttagcaacttaatcagctgaaaatgcacaaaaattggatgaaaaagtaaaagtaaaaatacagaataagaatttctaggatgtcgttcctattcatctccctttgtcattaaagtgcaatgggactgggacaggaaaattgctgtatagaaatcactattagctgaaggcatcacatcctctatttgaaggtcaactaaaaatagggctcaaaatcaatttggggaagcttgcactatttacctataaaaagaggttagaggtcagttgcacaactcagtagctaggtgactctgcaattaaaacacaattaaaattaagttggccaataaaaaaaagtatgctgtcaatgcatccagcactgtaaatgtaattacttttcaaaactgctttcagttaacttttcagtacgggaagtgtttttagaaaactgatcaaattaatttaattgctatactgccattaaaattgataatcttaagagtaattaaggaatatggaaaaactacccatttactattaaattttttaaaactcagaaaatttgcatataattataataactgtgaggaaatatgtatgcatgtgaacaaagatgaaatgagagtatgtaaaaaaatgaaaatttcacgagattatgggtgacatttttatgtgtgatattcacaagttttctttttcttttgctttgtttttttcctttttagggagaacagagtcccgttacgttgcccaggctggtcttgaactcttgggctcaagtaatcttcccacctctgcctccctgtgttgggattacaggcatgagctatcctgcctagcctacaaattttctttaatattgttatcacattgctttattataaagtacaacaaacaacagcttcaagaccctaaaattgcaaatagactaaaatatttctatggccagtttatgaccaatctttctacggtcaagctggaaacaaggtttcttttctattattaaggcaaaaaacatggctacataaaggattttccagtgctggcttccacagcacaaatactaaaattggaaccatgcggagaagattagcatggcccttgggcaaggatgacatgcaaatttgtttaaaaaaaaaaaaagaaagaaaagaaagggagggagggaggaagagaggaaagtaggaaggaaggaagaaagagaaggaagagaagcgggaaggggaggggagaggagtggaggggaagggaggcttggaagaaggaaggaaggaaatatcaaagtaaaaaaaaaaaaaaaaaaaggattttccagggaagcaagaatccctcagtatgtagcattcaggtatagtttttggagctctgagaagtcagattggctctaagagctctcaagaccactcaaacacaatctccagggtgtagatctagactagccagtttccgtagatctatctgtatactggatcttctcctgagggtaggatacccatcaatcaacttatgattctgaactcatcaaaacaattacaatttttacaattttacaggtaatagttctctacagaaaagcatttaatgaaagcaaaatgtgttttatcacaatctaaaaagtttgagagttcttattcaagttcttcttttatgatcagaaagagtatctacttagctatccactatattcccagggcccaacaaaatacttattaggaccccaataatgtttgctaaaaagtatctttaggccaggcatggtggctcacatctgtaattccagcactttgggaggccaaagtgggcagatcaattgaggtcagaagttcgagaccaacctggtcaacgtggtaaaaccctgcctctactaaaaaaatacaaaaattagctgagtgtggtgatgggtgcctgtaatcccagctgcttgggagactgaggcaggagaatcacttgaacccaggaggcagaggttgcagtgagccgagatcgcgccactgcactccagcctgggcgacagaagaagactccgtctcaaaaaaaaaaaatctttaaatataactatactatgtattattacatacattttacttcattaaacactcatttatagaagagctataaaaacaattgtgcttgatttactatagattactttcgatggtaaaattcttaataaaaattaccttagtcatgaatattaaaacacccttgaatctaaaacattctatttactaaagtacagcaatgaacattcaataaacatttactaacatctaaaatgtcattgtaatacatcagttttatatatgaattgagtatatttaaatctgtgaattaagagtaaaacaagggagataaaacattcaaagaatgattttggcagtgaaattcaggagaaaagggtatagttattataaagacagcaaatgcaaatttgcacttagaatcattacttctctgttttatgagaaaactatactttaacagtgttctactacattttaaaaaagattaaaaataagtcctcaatgtaatacactataagaagttagtggattgtttcaaattctatgcttacccactactaaaaaaaagtctaaaatattttataattaaacagagccacaactgcactgaatttgcaagcttctggtttttctggctgtttggacttcaaattaaatgattaacagataacaatatgttggcctggttagccacaaaagcatgctatttggtaagattttacatgaataaaaacaaacttttttttcttgagacggagtcccactctgttgcccaggctggagtgcactggggcaatctcggctcactgcaaccgccgcctcccaggttcaagcaattctctgcctcagcctcccaagtagttgggattacaggcgcccgccaccacgcctggctaatttttgtattttttttagtagagacggggtttcaccatcttgtccaggctggtcttgaactcctgacatcataatccacccgcctcggcctcccaaagtgctgggattacaggcatgacccactgtgcctggccacaaactttgttttttacaacaattctgggtcaaataagagcatttagggctgagtgaggtggctcacgcatgtaatcccagcactttgggaggccgaggcgggtggatcacctgaggtcaggagtttgagaccagcctggccaacatggtgaaaccctgtctctactaaaaatacaaaaattagcccggcgtcgtggcgtgcacttataattccagctactcgggaggttgaggcaggagaatcgcttgaacctgggagaagaaggttgcagtaagccgagattgcgccattgcactccagcctggatgataagagcacaactctgtctcaaaaaaaaaaaaaaaagagcatttagaagatactatagtttttagggatcatgttaattttgatgtagcatcaaaaataaaactgttcttaggtagcaaaaatatacacactgagaatcccttggaatctgcatttgtatatataccgagaatgtttgggactctgtattctatttagtttcacttctctctgagtcaagagttctgtttagccagctgaaaatactttaacacgtttgtattcaactagaagttacaaatccacaaaaatcacggaatgcctaaacagtacaaacaaagaattaggtcatattaaaacaaaaggtatccaccgtgttaaaaaaaataaaggtgattttatacaattaaggtattttcaaagttaaaatgtaaaaataaaaataaaatgttaaaacatttagaaacatcaagttcttaaaaaattaaattaggaatttgacaacacaaatttacatccacagcaaatgtttttaaagattgctggtaacctacaatcatgacctgagagataagtctcaagaaaactgtaaaaaatagtctcaagacaatagaaaatcaagtattaaagtgaatatacaaacaggaataaaaataataaaagtgaaagcatctaagaaattgtggtcaaagataatcaaatgtcagaggatacctttgctaatgctaattaaggctgaaaggtaagaaaccctatcctctctatctgtttttttccatctgagaaagcagaccttaatgacactaaagattaaaagaagaatccaaatcggacagatttttttctggcaagctctgaccacagatttgcgggagtgaaatgtctttttgaaaggtctctccctaggacactaacatcctagttttctccccacagctggcaggtaggtaggtaagtacgtaatacattgaaagtgatatataaactagcagtatcatgaaatctcttatcttgtgaagagtttgtgaatgtgatcgaaaagtcattttctactgaaaacaatttttccctacttttctcaagaaggtgtgttaagtcttttacagccagtctaacacaagaatgctattctcagttccaagtgagattacctttgaagactgaaaaaccattcatctggtcattatcttccctatttataatggtaaggtaactgttacccacttcactgaggatataatgatttgatttttcaaaatactttgaaagataatagtaatcagtattggtaatatcaacttataagaactctgttatccattttttaaaaatgaaaactgccacattaatgtttatcaaatctttcctagtattttctggaatcatctaaaataacaataggacaaatgcttcttataaaagccaattaattaatcagataaaatataaaaacaattatgtacaaatacattcaaatatatatatattttttacgtcacacaggtaatgtgccagtgtcataacaaggtttgagaaaggcacatttcacacataagcatgaaaacccaatcatcacacttaagaactacaaaaggatcaatattcaaatatttaagttttggtatggttaatataagtaagagtatttaattaatatcctgactcttataattaactattattagtagcctacgttttgaaaatacagtttcagaatttgttcttgtacatcctgaagcatttttctggatataggcaaaagcatagcaaaatttctagatcaatttccccataccaaaggtacattttgtcttgtttacctctgttatcacagcacttggtatagtgcctgacacagcagattttatcaaatactaattttaaaatcaattataaatatacaagatttattatgaagtatgatgccgtctccttttaaattaaagcagtcctatacttatagctcttaaaatttgaaagtatattaaaaaaaagtgttaagcatatgtctgctgctttttaaggaaagcttttaaaaactttagacaaatatagtatcatgggatctaaagtgagtacattcagtatctgagttttaccataccaaaacaatgaaacacatacttgccacagcttccttagcattctgttctttgaaatggaagggtatcccttctagttagatgtttagctcaggccatcattaccaacaggtccaaagcagcagtctgtcttctcctacaaaaaagtcatattttattattctagatataatttagccttagtcaggaaatttttacaatttaatgccttagcttttaataaataaatgtaattttgaaaaaaaaagtttattccctcatcaaaactttaaaagaaccatttaaataccaatcctaatattggtagtaaacacaaaaactacacattaaaaaaactctatttatatcatatagaacaactaaataactattagaccattttgaataaaatttcaaaacgtgaatatatgccgtctctagtgtgaaaattgagatgcagaaattgggagttctttaaaatgagtataccggccgggcgcggtggctcacacctgtaatcccagcacttcgggaggccaaggccggcggatcacctgaggttgggagtttgagaccagtctgaccaacaaggagaaaccccgtctctactaaaaatacaaaattagctgggcgtggtggcgcatgcctgtaatcccagctactcgggaagctgaggcaggagaatcgcttgaaccggggaggcagaggttgcagtgagccgagattgcgccattgcaccccagtctgggcaacaagagcgaaactctgactctaaataaataaataaataaataagtatacaaaggttatgaagacaatttagttaaactaagaaatgggagtagttgtatatgtttatgtgttagtacataaacctagtgatatttgtatcctaatttattatgttaatcagaatggagaggattattaatgctgacaacacaagccaaaacaagttaaacaaactagtagtacttgatctacaaacatggggttatctaacaaaatgactggtgtttagccatgtcgtttttgcctgaaagctactaccaaatggctttacaatcagtgcactgtgaagtattaacatcatgcaatcaaataaacagaaaataattctctgaaaattcaattactgtccaaatatgttgttgtatataatctagatcagttaaacccatcagaaaagtttaataaagctacaattgcttttcttactagaacagtcataaataacacttttgaagggttaaagcattttggttgtattcttttttttttgagatggagtctcactgtgtcgcccagctggagtgcagtggcgcaatatcgaatcactgcaatctccgactccctggttcaagcgattctcctgcctcagcctcccgagtagctgggattacaggcacacgccaccacacccaactaatttttgtatttttagtagagacagggtttcaccatgttggccaggatggtctctatctcctgagctcaagtgatctgcccgccttggcctcccaaagtgctgggattacaggcatgatccctaaccggccttttgttgtattctttaagcactattctctgtaaactataatgaataaatattaaggaagagtattttcccaattaaccttatttttttattcctgctactattacatacaagtttatgaagaaacttctcacatcaagaaataatgtaaatacaccagtcctttagtaaaatacctctaggttaggttaaaacttaggctgaataagtacactattttcatgaaaagcaaaagagcattttcctggtaggcccagtggagcatcttattatctctgtagcctgggactctacagtttcatttcctggtatctccttgttccgccactcgttagccatcaatctacaggatgtggactagaagagaagataggaaacagctgccaaagagggaaggttattttccaaaatgaattattaatactttaggaatctggtaacctacttcaatccattcttaaaatcacacagtaattgcaagatattttaccgaatgagtctcttgagaagagctgccaagacatgtaaaggcaccaggataccagaggagcaaaaatgagctcatcagtgcttttgaatgaaaatcctagttgcctgatgttatttaagttcctgatactgggattactttagaacatttctatctaattcaaagtatttttcttaatttagtatgagtgaattccaaaaattaaagagctcatctcagctatgtacattatataataaaacagaacaagctgttctggtagtagatggattacaaaaaaagactgagagcttggaatttggaacagactgggttcaaatacagcatgccacttactagctgtgtgactttagaaaaatggcttagcctatctgtgcctcagccccatcatctataaatgggactggtaatattaataggatactatttacttaatagggttgttgtgaggattggaataggtaacacgtgtaaagtttctggaatattccttggtacttagaacacaatgaatgttagcaaagaaatctttctttaaaatttgctaactgttgacaagtgataaaatactttaagaatctgggtaacaaccaaccaacaaaatttatttgccatttcatacctctgagcatattaaatcatgctggaacaagttggcttcaaaaggcagatactaatcaatcaaatttaacctctccccccacaaactttttctgaccttagcttcaaaataaatcattactgtatgacatatttaaggggtatttcatagaactagcaaacatctgatataagtaattttatcatagtaacgaggagaaattgttctcatgatcttccccactcccaagtatagcccatgtctagcaaaattttaacaaacttctttttaagaatattgatggtaaaagagaataaacttagaagaaaaatataattattagtttagtgcttagaaatatcagaacctcctatcttctttcatttctcactaaaaaacaaaaaaggaaaagacttttaagaaggggaaaaaggaagttagaaatcttgagaaataggaaatcaccaaaatttaatgaaagagttattttatttacaataatatatgatatggctatgacttcgatattttaattttgttaagataaattctgataatattttttaaaatctaaaactaagaactgaaaattaaaatcttgcattaaaaatgatttatttggctgagtgcagtggctcacacctgtaatcccagcatgttgggaggccaaggcagaaggattgcttgaggccaggagtttgagaccagctagggcaacacagtaagaccctatctctacaaaaaaaaaaattaaaaattagccgggcgtgggtgacacatgactgtagtcctagctactcaagaggctgaggagaaaggatcgcttgagcacaggagtttgagggtgcagtgagccatgatcatgccactgcactccagcctgggccacagaatgagaccccgtctcaaaaaaaaaaaaaaaaaaatgtattcaactggctcccttgaataaacataattcttaaactgctcatatatacttattttacaaagtatatcatcacatttgtttagaccaaaggtatacagtcttacctcttaagttggaaactgattgtataaaatgccaagattaagtatcttttaagatcaaaacctggcaactacatacaaagttacatattaatatttactttaagaatatcctgtataaaatgcagatctccaaaatgtaaactcaaatgtatattctgattaataatctaagtcagcaactttagtcatgcaaatctggttattgatgactacaaatatatcagagcaacaaggatacaataaaatttatcaataatagtatagaaacattggctcttattctaaagatagtatcagttttaaaaacagaactataacttacttttgaaactacgtaggattatttaaaaggattttaagttcaaaaaatttagtcttaacagtaaatgtgcttatcacaacataaataaatatttataatgatttaaaaaatgtgtattactggctagcaccataaacagtacaatagataattccaaaaatctctctgaataattgcactgactatgatattagattaaaaactaggtgctgaactttcaacactgtttatttaagtaaagtctttgggcccaaatccacaatgctgcaacacaaataaaagggttatttcctcagctacatttgtgatcattttaataattttaaaagcattttcatttaagtattaagttataatttacagcaaactaagtctcaaatatcacattttatgcttaattagcataagaaatataatacatcataatataacctttccatcttaatataaaatataataatacaaaagggagaaaaatcttcaaaatgaaccacctctcctatgctattaatttcgctaataactgtaaaactttgtccccaattattgaaaaaaaaagaacttacaattatcattaaaggtgaaataattgctacatcatgcatgaactaccccccaaatccggtgaaataataagcttagctataaaggaaagaaatccactaatgagtgttcactagcacaggcacatttatgttttcggatttagcatattttcaaaccatctggcattaatgcctctctggttcacccagcctaatctgttcagaattgaatataaaaccagagctacatgaacattgaggaaaccaaagaacagcacacgtgcataaaatgttccaaatgtaaagttctaaactagtttctatttgaactgtatctttaaaacatttccattgaagacgttaaagctctttcgaaaatacaagaatggttcaagaaatctctatgaatcatcactatcatcagttacccaagtattaccctttctcattttaatcctgattgtcaaataaggcgtctgaagaggtacttcaacaaaaaagattcattgataactgaaatgctatcattttatatcgaaaaggtccacgattatacattttactttgtataaaattagtctgcttagccttaacatgctttgggaaaggagagaaaagctaaaaggaaaaaaatattcatgaaagccctttttcttttatgtcctgttaccgcattattgtcattggcagcactcacatttcttttgcttaaaatcaggagtcagaattgctactttagaaattaaaataatcgatgggtatactagggccaatttccctgttaaaaccaactcctgctcaccttcgctcccgacataaaaacaaatgactttttcagaataatttttcagaaacgaagataattaatgtagcaccatataacacaaattaaagctttcagacaaagactgagaaacaatgaccaacaccagcaaatctaaagtgctcttatatatgtatacacacaacacacacacacaccccaaaccaaatattcactgttcctggggggagactgcttcttcctccctaaccgtgaaccgctgtatattttccaattttgtgattttcctttttctgctatcacattaacctccaagagaactgcttaagttacatggaatcccaacctaatcacatcacgacttctctctcagcctttacatttttctctcaaatattagctcttcgcatttttttttttttctaatagctgggctgagttgacagaaaagggctgtggaattc

SEQ ID NO: 186 - protein, 745 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 187 - DNA, 2518 bp, Homo sapiens
cttcgggtgtacgtgctccgggatcttcagcacccgcggccgccatcgccgtcgcttggcttcttctggactcatctgcgccacttgtccgcttcacactccgccgccatcatggtgaagctcgcgaaggcaggtaaaaatcaaggtgaccccaagaaaatggctcctcctccaaaggaggtagaagaagatagtgaagatgaggaaatgtcagaagatgaagaagatgatagcagtggagaagaggtcgtcatacctcagaagaaaggcaagaaggctgctgcaacctcagcaaagaaggtggtcgtttccccaacaaaaaaggttgcagttgccacaccagccaagaaagcagctgtcactccaggcaaaaaggcagcagcaacacctgccaagaagacagttacaccagccaaagcagttaccacacctggcaagaagggagccacaccaggcaaagcattggtagcaactcctggtaagaagggtgctgccatcccagccaagggggcaaagaatggcaagaatgccaagaaggaagacagtgatgaagaggaggatgatgacagtgaggaggatgaggaggatgacgaggacgaggatgaggatgaagatgaaattgaaccagcagcgatgaaagcagcagctgctgcccctgcctcagaggatgaggacgatgaggatgacgaagatgatgaggatgacgatgacgatgaggaagatgactctgaagaagaagctatggagactacaccagccaaaggaaagaaagctgcaaaagttgttcctgtgaaagccaagaacgtggctgaggatgaagatgaagaagaggatgatgaggacgaggatgacgacgacgacgaagatgatgaagatgatgatgatgaagatgatgaggaggaggaagaagaggaggaggaagagcctgtcaaagaagcacctggaaaacgaaagaaggaaatggccaaacagaaagcagctcctgaagccaagaaacagaaagtggaaggcacagaaccgactacggctttcaatctctttgttggaaacctaaactttaacaaatctgctcctgaattaaaaactggtatcagcgatgtttttgctaaaaatgatcttgctgttgtggatgtcagaattggtatgactaggaaatttggttatgtggattttgaatctgctgaagacctggagaaagcgttggaactcactggtttgaaagtctttggcaatgaaattaaactagagaaaccaaaaggaaaagacagtaagaaagagcgagatgcgagaacacttttggctaaaaatctcccttacaaagtcactcaggatgaattgaaagaagtgtttgaagatgctgcggagatcagattagtcagcaaggatgggaaaagtaaagggattgcttatattgaatttaagacagaagctgatgcagagaaaacctttgaagaaaagcagggaacagagatcgatgggcgatctatttccctgtactatactggagagaaaggtcaaaatcaagactatagaggtggaaagaatagcacttggagtggtgaatcaaaaactctggttttaagcaacctctcctacagtgcaacagaagaaactcttcaggaagtatttgagaaagcaacttttatcaaagtaccccagaaccaaaatggcaaatctaaagggtatgcatttatagagtttgcttcattcgaagacgctaaagaagctttaaattcctgtaataaaagggaaattgagggcagagcaatcaggctggagttgcaaggacccaggggatcacctaatgccagaagccagccatccaaaactctgtttgtcaaaggcctgtctgaggataccactgaagagacattaaaggagtcatttgacggctccgttcgggcaaggatagttactgaccgggaaactgggtcctccaaagggtttggttttgtagacttcaacagtgaggaggatgccaaggaggccatggaagacggtgaaattgatggaaataaagttaccttggactgggccaaacctaagggtgaaggtggcttcgggggtcgtggtggaggcagaggcggctttggaggacgaggtggtggtagaggaggccgaggaggatttggtggcagaggccggggaggctttggagggcgaggaggcttccgaggaggcagaggaggaggaggtgaccacaagccacaaggaaagaagacgaagtttgaatagcttctgtccctctgctttcccttttccatttgaaagaaaggactctggggtttttactgttacctgatcaatgacagagccttctgaggacattccaagacagtatacagtcctgtggtctccttggaaatccgtctagttaacatttcaagggcaataccgtgttggttttgactggatattcatataaactttttaaagagttgagtgatagagctaacccttatctgtaagttttgaatttatattgtttcatcccatgtacaaaaccattttttcctac

SEQ ID NO: 188 - protein, 1334 aa, Homo sapiens
MMEIQMDEGGGSDSVVVYQDDYCSGSVMSERVSGLAGSIYREFERLIHCYDEEVVKELMPLVVNVLENLDSVLSENQEHEVELELLREDNEQLLTQYEREKALRRQAEEKFIEFEDALEQEKKELQIQVEHYEFQTRQLELKAKNYADQISRLEERESEMKKEYNALHQRHTEMIQTYVEHIERSKMQQVGGNSQTESSLPGRSRKERPTSLNVFPLADGTVRAQIGGKLVPAGDHWHLSDLGQLQSSSSYQCPQDEMSESGQSSAAATPSTTGTKSNTPTSSVPSAAVTPLNESLQPLGDYGVGSKNSKRAREKRDSRNMEVQVTQEMRNVSIGMGSSDEWSDVQDIIDSTPELDMCPETRLDRTGSSPTQGIVNKAFGINTDSLYHELSTAGSEVIGDVDEGADLLGEFSGMGKEVGNLLLENSQLLETKNALNVVKNDLIAKVDQLSGEQEVLRGELEAAKQAKVKLENRIKELEEELKRVKSEAIIARREPKEEAEDVSSYLCTESDKIPMAQRRRFTRVEMARVLMERNQYKERLMELQEAVRWTEMIRASREHPSVQEKKKSTIWQFFSRLFSSSSSPPPAKRPYPSVNIHYKSPTTAGFSQRRNHAMCPISAGSRPLEFFPDDDCTSSARREQKREQYRQVREHVRNDDGRLQACGWSLPAKYKQLSPNGGQEDTRMKNVPVPVYCRPLVEKDPTMKLWCAAGVNLSGWRPNEDDAGNGVKPAPGRDPLTCDREGDGEPKSAHTSPEKKKAKELPEMDATSSRVWILTSTLTTSKVVIIDANQPGTVVDQFTVCNAHVLCISSIPAASDSDYPPGEMFLDSDVNPEDPGADGVLAGITLVGCATRCNVPRSNCSSRGDTPVLDKGQGEVATIANGKVNPSQSTEEATEATEVPDPGPSEPETATLRPGPLTEHVFTDPAPTPSSGPQPGSENGPEPDSSSTRPEPEPSGDPTGAGSSAAPTMWLGAQNGWLYVHSAVANWKKCLHSIKLKDSVLSLVHVKGRVLVALADGTLAIFHRGEDGQWDLSNYHLMDLGHPHHSIRCMAVVYDRVWCGYKNKVHVIQPKTMQIEKSFDAHPRRESQVRQLAWIGDGVWVSIRLDSTLRLYHAHTHQHLQDVDIEPYVSKMLGTGKLGFSFVRITALLVAGSRLWVGTGNGVVISIPLTETVVLHRGQLLGLRANKTSPTSGEGARPGGIIHVYGDDSSDRAASSFIPYCSMAQAQLCFHGHRDAVKFFVSVPGNVLATLNGSVLDSPAEGPGPAAPASEVEGQKLRNVLVLSGGEGYIDFRIGDGEDDETEEGAGDMSQVKPVLSKAERSHIIVWQVSYTPE

SEQ ID NO: 189 - DNA, 3203 bp, Homo sapiens
gagaggcagagatcggggcgagacaatggggatgtgggcgcgggagccccgttccggcttagcagcacctcccagccccgcagaataaaaccgatcgcgccccctccgcgcgcgccctcccccgagtgcggagcgggaggaggcggcggcggccgaggaggaggaggaggaggccccggaggaggaggcgttggaggtcgaggcggaggcggaggaggaggaggccgaggcgccggaggaggccgaggcgccggagcaggaggaggccggccggaggcggcatgagacgagcgtggcggccgcggctgctcggggccgcgctggttgcccattgacagcggcgtctgcagctcgcttcaagatggccgcttggctcgcattcattttctgctgaacgacttttaactttcattgtcttttccgcccgcttcgatcgcctcgcgccggctgctctttccgggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacttgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggagttccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcagccattacgactttctagagctaatacatgtgactatcgtccaatttgctttcttttgtagtgacattaaatttggctataaaagatggactacatgtgatactcctgtccgtcttggttcaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaaacaagtgctttttatcttgaaattcaaccaacggaaagaatatgcatagaataatgcattctatgatgccatgtcactgtgaataacgatttcttgcagctatttagccattttgattgctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatctataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaaaattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcagttatttgtgagggtgtttattctatatgaatattgtttcatgtttgtagggaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttagaaaatagctaagatctttaataaaaatttgatatgaaa

SEQ ID NO: 190-197 - skipped (8 entries)

What is claimed is:

1. An immunoassay solid detector for use in detecting a presence of ovarian cancer, consisting of at least one marker antigen bound on a solid support, wherein at least one marker antigen is selected from the group consisting of
polypeptides consisting of SEQ ID NOS: 25, 26, 27, 28, 29, 30, 31, 32, 33, 34, 35, 36, 37, 38, 40, 41, 42, 43, 44, 45, 46, 47, 48, 49, 50, 51, 52, 53, or 54, each of said polypeptides being expressed as an insert in frame with the T7 10B phage capsid gene product as a fusion polypeptide; and
polypeptides consisting of SEQ ID NOS: 11, 12, 13, 14, 15, 16, 17, 18, 19, 20, 22, 24, or 39, each of said polypeptides being expressed as an insert in frame with the T7 10B phage capsid gene product as a fusion polypeptide, wherein said immunoassay solid detector detects a presence of a serum antibody specifically reactive with said at least one marker antigen indicative of ovarian cancer.

2. A diagnostic tool for determining the efficacy of a pharmaceutical for treating ovarian cancer, said tool consisting of:
an immunoassay solid detector for detecting a presence of a serum antibody specifically reactive with at least one marker antigen indicative of ovarian cancer, wherein said immunoassay solid detector consists of at least one marker antigen bound on a solid support, said at least one marker antigen being selected from the group consisting of
polypeptides consisting of SEQ ID NOS: 25, 26, 27, 28, 29, 30, 31, 32, 33, 34, 35, 36, 37, 38, 40, 41, 42, 43, 44, 45, 46, 47, 48, 49, 50, 51, 52, 53, or 54, each of said polypeptides being expressed as an insert in frame with the T7 10B phage capsid gene product as a fusion polypeptide; and
polypeptides consisting of SEQ ID NOS: 11, 12, 13, 14, 15, 16, 17, 18, 19, 20, 22, 24, or 39, each of said polypeptides being expressed as an insert in frame with the T7 10B phage capsid gene product as a fusion polypeptide;
and an analyzer operatively connected to said immunoassay solid detector, said analyzer for determining fluctuations in an amount of said serum antibody reactive with said at least one marker present in said immunoassay solid detector, whereby said fluctuations correlate to pharmaceutical efficacy, and wherein said analyzer is selected from the group consisting of a fluorescence analysis system, a densitometric analysis system, a chemiluminescence analysis system, image analysis software, and any combination thereof.

3. A diagnostic tool for staging the progression of ovarian cancer, said tool consisting of:
an immunoassay solid detector for detecting a presence of a serum antibody specifically reactive with at least one marker antigen indicative of ovarian cancer recurrence, wherein said immunoassay solid detector consists of at least one marker antigen bound on a solid support, said at least one marker antigen being selected from the group consisting of
polypeptides consisting of SEQ ID NOS: 25, 26, 27, 28, 29, 30, 31, 32, 33, 34, 35, 36, 37, 38, 40, 41, 42, 43, 44, 45, 46, 47, 48, 49, 50, 51, 52, 53, or 54, each of said polypeptides being expressed as an insert in frame with the T7 10B phage capsid gene product as a fusion polypeptide; and
polypeptides consisting of SEQ ID NOS: 11, 12, 13, 14, 15, 16, 17, 18, 19, 20, 22, 24, or 39, each of said polypeptides being expressed as an insert in frame with the T7 10B phage capsid gene product as a fusion polypeptide;
and an analyzer operatively connected to said immunoassay solid detector, said analyzer for determining fluctuations in amount of said serum antibody reactive with said at least one marker antigen present in said immunoassay solid detector, whereby said fluctuations correlate to disease stage, and wherein said analyzer is selected from the group consisting of a fluorescence analysis system, a densitometric analysis system, a chemiluminescence analysis system, image analysis software, and any combination thereof.

4. Markers for detecting a presence of ovarian cancer, wherein said markers are selected from the group consisting of
polypeptides consisting of SEQ ID NOS: 25, 26, 27, 28, 29, 30, 31, 32, 33, 34, 35, 36, 37, 38, 40, 41, 42, 43, 44, 45, 46, 47, 48, 49, 50, 51, 52, 53, or 54, each of said polypeptides being expressed as an insert in frame with the T7 10B phage capsid gene product as a fusion polypeptide; and polypeptides consisting of SEQ ID NOS: 11, 12, 13, 14, 15, 16, 17, 18, 19, 20, 22, 24, or 39, each of said polypeptides being expressed as an insert in frame with the T7 10B phage capsid gene product as a fusion polypeptide.

* * * * *